United States Patent 7,868,149 (PLANT GENOME SEQUENCE AND USES THEREOF) - sequence listing, part 27

SEQ ID NO: 13346 - DNA, 27671 bp, Oryza sativa
  unsure (1)..(27671): unsure at all n locations
aattttggccgacggcggcagacggcgcgatcgacccaccgtctgccacgtcagcttgtcgcccaccattggggcggcagggtctattttagcaatttttttttgttgatagattatttctgtaaatattaaaaaaaatctaaaaacgaaaaaaactcccaaaaccaattcctgtgatttccgtatggcccacgatctagatgggcccagaattagtactgggccgggcttaccattccaggcccaaatcaagcccaataaatttcccctttgcagcttccctcttctctccattttcgaattctctccgcgaaaactcaattcccccacccatcgatcgagctcgccgtctccgatggcggcggaggcggaggcggagccgcggcggtgggcggcgacgtacacgaagcacgtgaagcagaagcgcaaggcgtaccaggacggcgccatcgtcctccaccgcgcctccgtcaacctcgtcctcctcgacgacgcgggcggcaccgtcgagtgcaggacgctccgcaccggcgaggaggtgttccccggcgcctcgctcgcgttccagcgccacctcgtcgacgtcggcgagcccgagccccaccccgggtcggggtcctcctccgccgccgcatcccccgcttcccgaggcgtccaccgcggcggcgcaagcgccagggcgcgtcccagcgcggtgaactcgcggcctccccgtgcgttcgcggaccctaacacgaaggggggtggcggtggcggtggcaaggatgaagccgtgggttcgagtttccaaggtttgcgagccgcctgctctgcgtatgctcacaaggtgtttgatcgctgaacagaatgggcgtaatctgatgaatgaatcgggtgtgcttttgattgcagagtggaccgcactgtacaccacccagctgactcagaaggcgaagaagttccatgatggtgtcgtcaggctcgcgcaggtcagttcgcacgcgaagcaggtaagcagaatgcgcatttcgtagttggtaatttggtatacggcatattctgattgttgggtagctaatggatgatagattggtggtaggttacttgatcctcatgagaccagtttatcttagaatgctgtggtagtggactggggaaaaatgatgtgatatgttgttttggattactcgtccagataattttgctggatgaagagggcggagtgctagccaccaggtacctcaagtcaggggaatctttggaaactgggaagaaatgtcatttccctaactatcttattgagatttgtgaggcgaagagtgtaaacaaaggttggttttgtgcattttccaatatattgacgatttctgtatctaatctttggacctgtgcgttgtgagacgtcaacatttttgctgtgcctaattggagttccttttttcctttgcccacatattgaaaggttgttatttctgcattgccaatacgcaggtttacaaactaattcctcggaggaacctatggtgcaaacaagaccaaggagtggggagaatacaagtaacaaaacaggatcaggtccaacgagtaaaccactcaaatttaccagtccacagaaatttcatggtacatgggtataatgtttttttttaagattgatttaatgaattaatgttaaacatcagttagctatgattgtccttgtccaacatatcacagtgcgaaatgtttgtctctacaagtatagatcttgaggacagtaaatcatcaaatactgctggttcaagtaagccagaaacttcaaagattggagttgtggatgctggtagctcaggaagcattatgggttcaacagactctgaatttaaaggttcatgtgttctctctgtatatgtcagatatttgcgatatgtacaaattgtaaattattgatatatttcaaagctaatagtgaatgtacattctttgtagaatggagtgccttatataccacccaactaacacagaaggcaaagaagtaccatgatggtgtgataaagcttgtgcaagttggttcgcatgcaaagcaggttagcaattagcattcaatccgttagtttcatgcttattaatatcaacactgagaagtttctagtgcaaggtttggcaatatatgattgctgttttcgatgtcactgctagatgctatgtaatgaaatgctgtgatattttgctagttgtagaatggtgttatagttttttaataattggatgttcagattgttctgctggatgaagatggtggagtgcttggcagcagatatctcaagtcaggtgaatctgttgaaagcgggatgaaataccagttgcctaattatcttatcgaagtttgtgagataagaaaacaaaagaatggttagttttcatttgtgtccactctgtagcttacgatactctgaaaatattcaaatgtagtttttaaacatatattccttttttttctatatcacatcttattttactgcattaattggtgtgcagatgtagagtctaaacacccttcagaggtggttttgagtcaaactggatcagcgaatggacataatacaactgacaggacagatgggagaaacaaatctccaaaatttgtcagtccactgaagttcaatcgtatgtgatcacagagttccacacattagtactttgctgcttatgacatactttaatgtaataattcatttgtctctacaaattttcagattttcaaaagagtagattacaaggtagtaatggtttcaacaggccaacggttgccaaatcaatacatactaacatgattgatacactaaaatttcatggtaattgaacatgatatcataaacacttagttctatgtcctactactccctatgtatctttaggtagtaaggctgctgtttgcctgtttgcagatactcagaaggctaaaccagattttactgttggctacaagacagaccttggcaaatcaacatttagtaacttggatgatccacatcaatttaatggtaattgggtttaactttatgcacaatatctgtcttccagtagttatatttttatatagttaaagtgctggttctttccccagtttttgcagataataagcaagataaaacagaatatgctgcaagctataatccacaagaagttggcaaatcaagttatgatagagtggacagtcctctaggattctgtggtaaacagacttgatgtagcatacttgcacctattttttaccctcctgctgttgacatactctaatccagaaatgcccatgttttatttattttctgcagatcttcaggatggtaaatcaggatcttccactagttttttgaggagagaggctggcagaacaacttttggtaacacggatgattctttgagaactggtatgtatactttacctactttctagtttgaataggtttgaccacgcaacagaaaaattatgttgcatgtttccttcatgtatgtcaactacacgaacagtagataagtaatctatgcacccacctggctactattatccctatacccaagcaccgaaagtaagacaatccaatcagccattgttttaacaaatttgtaatgcttttatttattgtattaaatagataattggtttgatatatgtgcacttcagaaaataaaatacaagacaagtctgctcaagtgaaacttttactggcacattctatcagtgttctctcttctgttgtgcaatgctaaggttgttgtgaccaatattggctttgttcattaagactagtttcagttaaggttgattatttcagaaactccatgatatggatttcaaaatagctttctggtaggtgccttttagcagcgtactttcaggacattctttatggtcagattagatatgtctctgttgcatgcatcttgcagtaattatttcatagttgtattactgataaggaaaatggtcgtcccttattcctgcgaatgtgtagcttaattattcaggtttatttactggtaagtagctatttaaatatgtgattttacatattacaagggatatttgaggtattctttatgacttcatcaaatttaaataaaagctgaaacagttctgtatgcttctatagtggtcgttctgctttaccctttcttgtttatcatcaaatatttctctttggcaatctgaagagcataaaataaaaataaaatgcaaagagttcctgcattgtgctcatacaataacaattcacgcagtagagtactttcaagaaattcattcatttttacaagtgtatgttagtgatcctttgtggattgcatggctaacttgaatgacttacgctacttacttattgatcatgtgcttcatattaataacactgctatgcttttttagcatcccaaatactgtctatcatgaggcccccatcggaaattaaatactcccaaagtgttccagcttcacaagtacactcctcagcatcctttggatcaaatatagctcgtgatgcggatcatagcaagacagcttctaacatttcagtgatcaacagttcaaacagaactattggtgttaatatgaactctcgaatgtctcattgtgctacacaacttcgtgcatcagtgctggcttgtttaaatttagaaactctgcagccaaggaactcaatatgcactactcttcagagtgagttatcagggagtgcccatccaacttatgatcatcagacagtcatgtaagattttgtgtgcatatcttcagttatatcctagaagattgccttctggacaataaagtagtaatatctaacatgacaagtcgaataagaaaatgggtttactcgaattatgctttataggagaccaacaacttttgatagtctggaattggacatggtggataccccaacatctgatgtatccaatgcaaaagagcagagtcaaggttcaacaaggaaccatcaaactgaaagttctaaaggtactggaagctgtttcaattaatttcctttttgtggagttagagcaaaattgtgctttacttttagggttttttgccatccaagagtaaacgtacatatattggtctatacatggcagattctgcaccagctatgtgtactactagctcagaccctccatcgggtaaaggtgaaactgcagaccaggtttgcatcctatataacctttcttggaaaaagactgccgtttgtgaatttaaggtagtttcagattcatgagagcaatcaaattacttggtttttataactgtccacagctgcatattgttttgcatcataagatcatgctgtgagtactagcacctactgtttgattatactatgctaatcaatgactagttgactacatatgcatttgcagctcagttcagattacagagtggtggaagaaaaatgtggcagttacccctttttatctgcaggcgacctgacgttaacagatgatgattgcccttcgtttgatcttggcttctagcggaaggtacaactctattttatatcccatggtagcattggataacaataacttaacctaggttgttaaccacataacatcatctatcgctttgaagaatgtatttatttatgcaatataaattcacagcatcacatcggaaatacctgctgcctttttccccaacttataaagctataactataagtctataagctgggtcattgctgcttatggtggggaaagaggggcatgtcctagtcgtggaccaaccactgccggagttatatgtggtttagtcaaaccattggccagtttgcctgaatctaaacattggccagtttgcctgaacctcgaataggaagcaaccgcgcacacagctcaagacaacgattattttgtcaagttcactaaagatcaacgtgcagaagtttcaaaaagaaaaatgaaagcaattatatgcagagaaatcattgattcctgtgggtcactgggttttcctttgcttgcaaacattaacattacttaagattgcatcttaataagtttgctttgctttgctttgcatccagggtttcgttgagggattccttggccttcttaaactcaatctgttcactgcttaaggagaatggatggcgtgaaggcgcactctgcgttgtaagttgcaacaaaacaatgggcaggtaaaaaaagactaattcttgattagtggacaggatctggttcagcttaaggtagcagttttgggagtaaagtagtagttaagacgagttaggcagataaagattacaccgtacagtttatctttcctttaccttttctttttctttttctccttttttttttaaaaaaaagatatcgtttgcctttgtttggcacggtaacgtgtaaaaggtggttgctgtagtagtgtagtgtaaagagaacatcgagaattagattcttgtgtgggataaactacaaacaaagcatgttccatgctcttttttatgatttattgaagcctgaaggaccaggatgtacgctgaaaatcttcacttcaccaacaactggaactgggagtagaattgtaagttcgtgcatcatggcagcatccggattgctgaaaaagttgggcacttcaccgacgtagctgtctaacccatgtggccatattggattggacagctgaaagagatgtggggtcgttccgttgatagaaataatcgagaaagttcgaatgaatttactatgtgctctataaaagaatttacaagagatgaagagaaaaatggtctaggttagttcttgtgaaaatctacataggagtgtgatactaatttgatcctcaagttttctacaggttcacatctatctttggcgtttcgttttgtccaattggtcaattgggctcgctctcaagtttgcattcaattcaaaatgtagcacttggcaacatccaaaggtgctacttggccagccagccagccaacttcccaaatgcttaatcatggtatagaaaaggtctgttatgcgctcacctctcatgcataagcccaaaccacacacaataaagaaaaaaagaggaacgccacgtaaacgtaaacatgaggcatcgtagatttttatgacttttaataccgtgaagaaattattactatatatttttaatttttatgagttactccctctatgtctcaaccactttttttctctgtctcatgatataatgcgtgcatgcatgtatacattaactagcacctcgtactctaaatttgctcctcgtactccaaatttgctctgttttaaatcctctaacatcaacccccctcacattacttgcatgcatcaatgtgatctaaccgaggaagtgattaaattatttttttggtctttgtgttagtgatagttgtgcttcatattttggaatatagtactttcctagtagtgtagttgcctcttatatcattgagagttattctattttttatagttatttccctataacaatatcgttccttttaatatcgtgaaaagttacttcttatatcaagaaaaataatatagtgattacttcaaataagaaaatccatgtatataattatgaatattctctacattttacttatgaatttacttcatatagtttcttatttccaacttatccctatgtaattactttagcattattttatgaaaagttacttctcaactgagttacttttataatgtgagcaaattactattaaatatttaaaaataattaatattaaagtcgttttatcataccttttaagtagagtaagatggtttaaatggaatttataaataatacatggtttgaaatatataaaccatcaaaggtttgtattaagaaaaaatagattagtgatgttggttctatgtatcaaacctttaatttaactagtacaacccaattagccagtgacatatctggtcaacccactaacagattatactaacatttttggattggaaggagggcactagggttgtgccgtaagtttaaatagtgcacgcgaactaattaaatttcactataaatttgcaatatctcataaaattacttaatgtaaaattagtgtcccgattttaaaattatgacttatcactaacagacttatgatgtattggcaatgcatattacaatttgttttgggcttatttgatatccacctcttttaatgctggaacccaattaaactgttgtaactcaacttaaaaaaaaatggaatgggttaaaatgatttaaaatataactaaagagatggatcgagattcaagccgcttcataactttattctaaagttcactctcaaagttaaattgagaaatttgaataaccttatatagactcaaaccgtactcccccgcaaaaaaaaaaaaaaaaaaaactcaaaccgtactcttttggttcttactgtactctttaaaaaaaagttgactagtcactcagcacttcatcacagcatacagtactccctttctttttcctatgaaccatttgcttttcttcttagttcttacttccattgctttaggcggcagagagagaggggttcgagaaataaattccagtggctccctgctttgccacaacactcatcagtgggggttgaggtggctgcatcagcaaggaaacacctgtccccacctcaccagcgggagagaagcccacgtcactcccataaatggatgtggatatctcagattctcatcacccaaattgatccaggaagccacgggacggcacggatctttgccccctttcctggacaacctctccccctaaaaaaccaacaaaaaaaatgaaaaatgagtgagaaaatgagatgacacggcgaggagaagaacaaaaataaaaaatctgggagttgggagaggaagaaccggaccaaaaatccaatctttgtgggagaaaaaatggcgctttcaggggcggtgagcagcgcagaaacggcagcttaattggtctttcttgccaatttataaaaagttttgattttgggagtaattgaaatctttattactactattattattgctggatggattgtttcttctggtaggattgctgcttgctttgccttcacgtcattatccggagaggagcaaagatcccttctttattagctcctctcccttggcttcctctcttctccgtgttcttcttgtccgctttaggggttcgcttttctagattcagtctgtcagcggcgacggcgagggagctgcgagatccggccgtgagatggtggtgatccgaaggagtcatcgtcatcgtcgtcgggttggagcctcttcgtccaagaacctgccttgatcttgcagccttgttcaagcttccgagtcttttgctgatccaggtgaggtggcttttgccttcacctgtaaaattttagagaatcggatcatcgggaggagggagcgaggagaatcggagattcggaatctttcgattttgtctgacttgctcgagcatctcgggttcagttttcattttgcgtgcccatttggtccagtcaagtactttgaaatgttcctagttcgaagaattcgacctgtttctgtatttctgcatctgtgattcgtcccttacctcaaatcagtgaaatctgtcggagaattggataatcgtttaccgcctcaaatctggctgtaattagtagtgattgttttctttgccatgggcatttcatttcatttcatttatttcgacgttgcttgcatatctgagcatcatgtcttctcgttattgtgcttgtccgtattcattttatggttgtagattctttttgagcaaacagttcatgaatcttgatggatcggtcttcaaattttctagcgtggatgatgcatgcactttctgtcatgaaaacattgtaaaataggctgttaatactatcatttgttttctttagagcttctatggaagtagtgctgatgaacaactttttctgaggacattgacaaacaatttttctgatgtgcagggtgcagtttcttagcatgtgagtaatggcagctgctgaaacaagggctgcttggcagcgtgctgctaaccgctgccgggttcaagaggacgcaaagagagctccgaaactcggttgctgcccgccatctgggcaacagcatgagaccaacaatggaaatcaaacaaatccgcaagactgccatatccccaactttatgcctttaaactggaatgcaatgaactccaatctgccaaaagatacccaatggtggcttcagttgcagcccaattttgggtgccagaatgtgcttgctagcgaggacctgaattatatgtgtggggaagttgatgtaaagaaagtcgaaagtttcgcaccagtgtccaaacttgaggacatcaatcctaagaaaacagctgatccttttgagcccccatggatagtttcaacagcttttatgaaacaaacatatgagacaggttttgaagagctcaagagtcttcctgcctattctgaaatgaccctcaaatgcaggggaagtgccacctatcttcatgaggacaaagaacatatggacttcaaaacttttgatcctttgtatccaaagaaaccacagacggcatgctatgagatggatgcaccttggcaagaaaacaggaagtctcggccatggtggcaggtagctgaagcggatggtttggcttccgtagttgcagaaagtgaaatgcacaacgtaggcaaaaatgagctgccaagacccacccaacgtgctcatggttcaaaattgaacaaccatgaaaacaaggatgattatggaccttatactggcaaagaatcacctccagtgcagtatgacactatgctgtgcagctatagcatttcaagcaccaatgagacaaattcatctgatggtggaggctggcaacatcaaagaaatgatgcacgtgggtatgttatattctttcacaatcgctggaattcactatgatttgccggtgtcttccttcttggattcacgccgtcttaaattcttaatgatactagttattttaagaaagtggtatgtggctttttgtttggtcccaaacctagggaaatccggtctaactggccaatttagagggccaaacaggtgattacgtgataacaagtaggtgtgcttgttccttgtgaacagcccagtagacccacttttagaataccgatgttttgctttacaaggataaatcttatggcttattattttcacgtatcacattacgaactagttctgaaaatgaacaaacacaaatgttattccaattttgtatgtgtgaaactagttctgaaaatgagcaaacacaaattttattccgattttgtatgtatgaaattgtgtgaatcttttgattccttgttatgatccaaaattgaagtaatggtagtcatgcatgccttccatgtcgtgttatttctcatccctggaaagtcccagataccaatttgtttgtccaagcttcttcctggttatggtccatatattgacataatcgcattcggatgcaggggtacacaggattcttgtagttctgatgatcgcacaccaggcagcaagccgacatatcggagtgccgctgagaggacccagttgctggatgcactccgccattcacaaacacgcgcgagggaggctgagatggctgccaagaaagcttatgatgagaaagaccatgtcatcaagctattattccgtcaggcctctcatctctttgcgtgcaagcaatggctgaaaatgctgcagctggagaacatatgcctccagctcaggttgaaggaacaccagatagcagccatgttccctgaactcccctggatcatgctcaaagaaaaggtgacgccagggcaagaaaggaaggatggaacaaggaagaaaggaaggaagcagaacaaggacagccacttgcgcaaggctgtcgtgtttgcggtcggtgtaggcatcgttggtgctggactgcttctcggctggactctcgggtggctcttgcccaggttgtaagttccattatcatctaccaccatggctagattaacgcctagcgcgcacttcgatcgaataggtgatagataaagcttcaggtatgtgcttcatgatgttagaagaatgaagatcatattcttggagctcattcatatctgttctgttgttggtttggaagccttgctgatgatattttcatatcttcatgtacatataggatgaatttgctgtatatattttcagaaactgggtgcttctgtatgttgcatgcgtttgcccgaatgttgtacatatatggggtcagtggtggtggaactagggaaaaaaatccgtcgacatcaacaatgtattaagtataaaacttgtattttcagttgctggagtagccagctcttgtttgtataataaaaacttgtatttttagttgctggtttagacagctcttgtttgtattataaaggcctaggcacgcttgtgacactatgaatttccatttgccaaattggtcttttttcttgtcaaatcttggtcagctttccaagtgctgtaatcagcaagaatgtgatctgttatcctttgggatagaagtcaatatgcccagctgtcagctcgtgcatttgctactgaattttgcagtccagatatctcagacataagataaactcattcttggtaactcctaaaagaatttgttattacaggcttacagcttcgaaggtgctatcaattatgcatcaaaacttctaaaggttactgtgatttttggcatagcttccgatctaagatgttttagagctagcataactttggatctaaggttttttttttttttggagttggatatttccacctccacaaatccatagatttttcaatcggcaattacattgattacttctgaatgaaatatttattccatttttggatgaaatataatttttaagtgattataatttactccctccgtctcctaatataagggatttagacattttgcttgcattgtttgaccattcgttttattaaaaaaaaaattggaattattatttattttatttgacttacattattatccaaagtactttaagcacaacttttcgttttttatatttgcacaaattttttgaataagacgagtggtcaaacgttaaaaaaaaaatagtgaatatcccttatattaggggacggaggtagtaacatataaattttaaatctagatatggagctgtgataaatattgcctaataaagagaaacaagtgccacgtgatgccaaaggaaagctgatgtactccttttgtcccataaaaagacaaacctgagtttggataggctatctaagaataatctgaagaatattaaaatgtgtcacatctcatcttaaaatcctatcctgagtttgtattttatgggatggagggagaaagtcagcaaagagagcagtgttgcagcaaccagcaggtaatccgtacaagggaattcattagggaaattgtaacagcaataaacttaagggatctagagtcatctctatcggagcagcaacggcacaactgtgaattacataagttagcacagagatgaactagtgttacagctgaacagctcccaagtgtatgattactagtagtagtacttaattagatcttggcagtgtttttccagttctttacactattaagagtgcttagctaattgttccaatagatcttacttatccaggctccggcagccaaaagtgcacaaatgactcccaaattgtgatattacatccacaaggcctccatatccagcaacagctgccatctgcacaacaaaggtagtaaactcaggacaaatcggccagactccagaagtagggtgaaacagatacccaagtcatttcaaaatgagaatcaagagacagacagacatacccctgaagaatgtatggagacagaaaatgctgagtgaggagcacacttgatttgtgaaagaagagtcccattgatagagaaacgagagagcagaggttcagcaccgactgctaagatctgaatggtgaaaatggagtataagaaaacaaacagttgataattcctaaaccacaagagttgggaaacaatgcatccttcgtgctgctctattgtctatcgccagactcaacattgctttggtaaatctctaatagatgtgagcagacaataataaaaagctttccttgcaggaataataactagttggctgaagagtcactcttatatttgtttggaagcaaaagcttttgattttattctgtttctctccaacaataacatcacaaagcttcaaattttggcaaccatgtcataaatcatcaggaaataatttattgcattttctgtgcatatctgagagattatctgataataatttcatatccacacaattatgcaaactttcatttggcaaacaattatgcataaaaaaatttagaaagggcattggttaaatagataaatcatgcacttgtggaactatcatatgacttgttaatggaaataattgactaggggaacactaatttactacaggtatagcatttgttaaactcacaaagactaaagaatggaatgatccgtcctaaattttttgccagcccatctttgaaatacaagatgagccatttctaaccatgggcaattttactggtttgctaaactctagcttgaacatgacgaatagatagacttacttggtttctgtcaaacagcaaatcttgaacaggagcatggcaatccacattaaagatgcactcatttgaaagaaggctccaaactgatataccactagaagtaccacaagcctgggaaaaataggaccaagataataataactgtaaaatacatgatgcataacacattgttatatcagcttgaagtgcatcctaccagccagctttcacttgcatcaatggcaacacaactgacccatgacccctcaaaaatcttgtttttcaccggacgtataacctgagtgcactttccacttctgcaatctgcagtgcacaaagagcagaaataagagaatgcctttttatggatttccatgtagtgccaaatctttctaaacctgtctgaaggtaaactcataagagagaggataaattttgtgaatatgatgtgacctgtgaccagatcaccagatgtgaattaaagagtacaaaaagacaaatagctagttggtgctttttctttgcttgaatcaacgagcagatatacaaaatgaccagttagaacaggatgaacatgagaaggcacacttcaagtacaagacaaaattatcctatcaaaagcactgctcaccccagatacgggctgtgccatcctctgatcctgtaactacctgaaaaaggaaaggctctattaactaaaagttactacaaaatgaaggcaagacatctatgggaaaatggtattggactacatcagtacaataataacaaaccaacctggcggttcgcttcgcggactgcaatgctgtgcaaatagtcagtatgtcccttgaaggtcattttacatttaccactctcctgaaagaacaagacattgtaaaacctactatcagatattttctcaagcaggcacacagaaaatagaaaattatggaagcctgtgccacatgaatcataagaaatctgtagttccttccatgtagctcaggacttctatatattgcatttacctcaagaaaatacataccacatcccagcaataagcacatgcatccccggccgctgcataaacagatccttcctgttgcgaagaagaatgatgagaaagaataactgaataagatatctttttttaagcaagtaacaatatgcatcatttctatataatatacacgatgaacaaaaatgcacacaagagattattttgcttctttggatgaagtgaaaatgcagactttctggtgttgacctgtttgttaatcgcaatggcgttgttttcaggtattggagagcgagcaccccaaggacccctacaaaatcgaaaacaaaagctctgaaaagatggaggatgagagtgcaagtgcatatttctctagaataaacgatatgtcaaatgattatcagatgtatgtcctttttcacagaatacttactcatgctgagggttcaccaaatcaagtactggctccaaatgatcccctggaaagaaaagcaatgacaaagtaacctattaaacaacatgcattagccccacaaaaaaaacatgcactagagcactagaaaaggaaatgggacttgcaaaatgttttacatctttgttaaaaatttagccttttctttgtggggtgtgcgcaagcaagtacaggtagaacttctaggtaaagcacacaccaaactaattaaccaagtcaatcctagtaagaagtgagggttcttttgcagcaccttgcagagatagcggcacaaggcagctctgcatctcgtgccatctccatccccgaaggcgcccgtcatccccgccgctgccacaaccaacggatcacgtcgccaaatgtcatgccatgtcacctgaacaaaaacggccaccgagaagacgagcagcagcacagcaattcacctgaagagcagcggctgctgcgaatccgggtagaacctgacgtcgtaggccgggccactgtgcgcttggacgatgcagacgggatcaaccagagagaccgcggcatccgggtgggtctgaatccaatcaaatcaaaacaaaagatcgaacaccttagctgcgcacgaggacgcggcacatggagcgggtgtggggaacgaacgaacctgtggggtgggatgggaggaggaggaggagatgcaggaggagagggagaaggaggcgagggagccgtcgctggaggcggcggcgaggaggacgtcggggtcgtcgtcgtggtggtcgaagaagacggcgcggaagagggtgcggcaggagaggtcccgctcccgcaggatgccccgcctgtacgccgcctcgtcccacccccgcgcgtccatccccgccaacgccgccgccgccatctcgcctcgccgccgccgccgccgctgcttcggaagcgagagcgagtcgaggagtggggggaagagacagcggctggttgggctgggcctttagatcagaaaccaacggccagatctattcattattaaaaaatataatatgaaatccctatttgatttgtttttgtacagtattgtaataattatttgagggtacagacaaataaaataactgttataaagttttaaaaaataggttaaaacaatattctaataaatttatatttattttttttgtgatgagaagccaacgacgagatcttattcattgataaaataatatgaaatatctatttgagttgttgcttcgcgtaatgttgcgataattattcgagggaacaaacaaattaaataaatgttactccctccgtattttaatgtatgacgccgttgactttttaaccaacgtttgaccattcatcttattcaaattttttatacgaatataaaaatacttatatcatgcttaaagaacatttgatgataaatcaagtcacaataaaataaatgataattacataaattttttgaataagacgataggtcaaacgtttgtcaaaaattcaacggcgtcatacattaaaatacggatggagtataaagttaaaaaaaaatattagaacagtattctaagaaatttatacaaaaagttttaagaaaatcacaccgtttagagtcttgagaaaggatccttcgaaatagttccctcaaatcttatggataggaaaataacaggaatgatcaattagatgaagcgtttgaaaccacacaaatcaaaagagaggaatttttttcaagactctatactactaggtgtagcaacaccaacatttaactcaaaattttatttttcaaagaacatggggtttgaggtatcatatcgttcatatctcgcgtttctgtcttgtttcactaaggaaatgctgttattttgtgaagcatgttgaacccaaaccacaggcttagcataaggttataaaattgtacagcaattgactctctctttatttatgcacctcaaaagatttttgcatgtatggtagcaagtaaaataccatatcatgcaaaggactaagttcaacatacactaaaatcaaacactgaagaacagtaatactttcatgtcacacatgatacacactctgctcatatatatatcagtggtacaatgaaccattcaacagttacaactccatagtttggcaataataagaccagccgatggatatctcacaactcatccatggatctattaataactcatgtcaatgttttcacatcaagtgcagacagaggcaacagaacatctcaatcttcacttgtcagatcccttctttgggtggaaggcttcaacaatagcttcaatctcttccttggcacgctcaaacacatttggacctttaactctctcaactggtgtattctcatttatatcatcgcttgtaccatgagtttcattcttgtgggtctctattttgttcattgacaccttgctttcatcctttgagtccttatgcaggtctacacaattttgtaatggtgtgtatcataatcattagacaggaagataaggttaatcaatgcataaaagaatctgaccatcatgcatgaatatcacacacaaagagctgacaagtcattgttgatttttttttgtgtgctgcaaattcttcgaaggaattcaagcaaagtatttgtattcaaactatttttagggcatacatatctaaacttttatgcctgaaaggatttccagaaagtttcatgatttagctgcatcatgttttaaagtcggttggtggcatcaaatttgacaaacaattactgaaaaggatgtttttgcaataaaagggagaaaaatgaagatgctaatattcttgaacttgtgtttgtgttatctcagaaaaatcttgttacagaaaaccagactttttcaacaaagagaaataaattctgatatatgcccaatgcatgattaatgacccatcatattatacaaggaactcaatacacaaggtaaaaaacatcaagctaaaatttagcaattgtcaattgagtatgctgtagcgcataattgctagatcagattttgtactccctccgtttcacaatgtaagtcattctagcatttcccacattcatattgatattaatgaatctagacatatatatctatccagattcattaacatcaacatgaatatagaaaatgctagaatgacttacattgtaaaacgaaggaagtaggacataattactgaagaactacgtgtcggcctattaggcattgaagagcttaagcttgtgcgtttatcttatatgagctttgtgttttttggtcctgttgttaagcagctaaggtcgtgacttaggtgatgaggcaaaggatcgtgcgatactgtgatggactgatggtaacattaagcttagatgtgaattgtctctctgggtgctttgggcctagccgatgctcctctatcctatccttttttccatcttttctgccagatagtttaaaatcctactcttctttctggggataataaaaggtgctcagcatcttcacagaaattaaattacggaaaacaccgttggttcaaacaaattaccagcattatttccatggggactggaattgtgctccatcttatcatgaacagctccaacgagagcctcaacctcttccttggctcgttcaaacagattgggggccttaaccttgtccacagatgttttatgacttatatcgttgctcgttctgtgagtctccttgtcatgaactttatctttgttcatcacgcttttgattcacagtagaaagctgcctattccaagctccactctgcacaaaattccaacaagagcattcaggatttcagcccgtgataaacaacacaaaacctgatacttgccattcatccctacgcaggatccgtgcccgaaaaaaaaaaaggtaaatagcagaccatttgccttaatccaatcgagcgaaaatggtaaatacaccgtttgacatcatgcccaaataaaaagactttaatcatctttcctcaccgttctgcttgctaaatgttgcagcatccagccaaataatacactgggaacgttgcacagggcaactgtttttcggctgtcagtgctgaaccatcaaatcggcaatggcaagcaaaagaaaacataatgtacactcaatataatcagatcaccacagtattactcttttttttgttttttttttcgggagactgcagtctgcaggtagtactcttgatcgagagctcactgatccggaatcaacagcttcccaaatcgaagccctaactcctaatcctccccatccccagatcaggagaaccctacgcggatccctgccctgcgcggcgagtgctaaaacgatacgaactgctctctctctctctctctcgtcagatcccaaacctaactatggaaaaagaacatgtcgccggggtacacagaaagatatagttgcgcacctgcggctggctcccgccggcggcgcgtcgatccggcgatatcctcaccggaattgatgatgaaggagagagaggcgcggcggatggatggattgggtagttcgtggaatggaacccagacgatggagaagggaaagggaggaacggaatattcttgggccggcccaacacaaaagcccaatgtacccaaaactagcttaaagaggcccatgtggccctctgacatctactaggcccatatcggctttgaccccacctgtcaatgggatgggcgctgaacggacggaaaggtcggggactttctgtgcggttacgcggggcccacctgtcagcgtcgcccgtgtcgctccgtctccaaccccgccgcgcgcgacaagcgagcggccggtggccgagacgtcgtttgaccgtccccgattcgcccgccgccgccgccgccgcccgccgccacagcccgccggcgaaccgtggccgtatctctctctatcctctccggagatggccggcgcgggtgcgggtgcggcgcgatcgccgctctcctgcgcgccgcgcacgtgccgccggcgccgcgcgcgcgctcgattcggggcctcgccgcggcgcgcgggctccctcctctcgtccgcgccacggcggcggccatcgcgccgtcatcgttctgcccttacctcccgcgcctcagctctggtgcgttgcctggcgtgaattgctgctgccgtatgacgtacatacagctcgcgcctcagctgttcgacgtaatgcctagctccttctgatgaattgctcccgtttcttccagctcgctccttctcctcctcaacatcgtgcagcgccggcgcgtccctcggtggcgcggtgtccacctcgccgtccgagcaggagaagcagcggcagcagtcggagctcatcttcctcggcacgggcaccagcgagggcatcccgcgtgtcagctgcctcaccaatccctccaagacctgcaccgtacggccaccctcttcattgcagcagcgcgatgtcgtttctatgtcatactttgtgttgattggttgctcaatgtcatttgctcactttcttctttgtcctttcctgcacgcaggtctgtaccaaggcagccgagccagggaatcggaacaggaggcgcaacacgtccatcctcctgcgccatgccacgccgtctggcacggcgaacatcctaattgacgctggcaagtaagtatgcgcctttggttgatctgggagtctgaaagtttgcttcatttctcttccattctgggttatcattcttgaattgaaaaagagtgagagagagtaatgagacaccactgtgtttttctctgcttcctctgctaggttcttctaccactctgcgctccagtggtttcctgcttatgggtattgaactgctgacgtgctccatatttgtttccgagaaatttagccttgttaaacgctagcttctgacattcagattgaggacaattgatgctgtgattattactcattctcatgcggatgcaatcggaggtttgcaaatacttttattgaagcaagcaactttattaatattgattgagacaacacaccatgctcgttttgctcttgagctttctaaaagaaataagaactcctttggtacaggccttgattgtcttcgcgattggacgaacaatgtccagcccaccatcccgatttatgtagcagaacgtgattatgaggttggtgctatgtttgtagttttgtttttgcttctctagaattgcagcctcagaaagtttcattcctaacgtagacaactgtcatgccaattgaaatgaaactcacaacttctctttatgtatgcaagattttaacaactgggccactggctcacttttctttctatgcttgtactatttgttcgctatcaggtgatgaagatgactcactactatttgattgacacaagtgtggttatacctggagctgcagtttcagcattgcaattcaacattattaaagaggaaccatttacagttcataaccttgaggtctgttgtctaaaataataatttatgtaagcaagaagtagacataaaccacacgctatcagcaataattagctcttcaatccgcaaagaaatttctttttctcaactcatttgactgcactgtaataatactttatactctatgtaggcaggtaataaaaggatacatttacttctatatccttatttttgtttactatcataacttaattaactgaccatgtctatactttgagttatttgaattccaatgttgttctgagttaaatgttagtaaatccgtcatgaacctattagttacatcctatgttctcaaaatatgttgttttggtcatgatctccggtagacacctgtgaccatcgatttgttggccaaaagtatgtaaactataaggtaagtaattttgaatgtgcctttttaaattgcatgtccaaacgaaattaatatgtttttaattatgtcagtttgcgctaagtgtactttcgagtgtaccctgtctaatttattttgctgaagatatgatttctgtatttttcaggtcattcctttgcctgtctggcatggtcagggttaccgctctcttggttttcgttttggtcgtgtatgctacataaggtagatcaaagtgcaaagctaattttttacaatatattctgttggttcaagttcaacacacatggtcttaatatctctgatgtacacagtgatgtcagtgatatacctaaagaaacctacaaacttctggaagactgtgaacttctaataatggtattgacgttataactttttctatatatatatgtgaattgttaaagcatgagattatgggattctcttgaagctgcatattttcttatgttacttagtgtttttattaactttttgtataactggatttaagcttgattttattataattatgtccaggatgctcttagacccgatcgttcttcttcaacacactttggattaccacgggtgggtagttagttctaatatatcaatcagctctagcttcttattgcttcactgtattccatggtgatatattcttcacttctgcaggcccttgaggaagttaggaaaatcaaaccaaagaaaacactgtttactggtaatcattttgaggctcgtttaatgcctttactgaattaacgctgctagacttcttcagtttaaactctatgtgcactttaacttttcatgttaatttataaaaacattaatcactctggaacagaatgcacagtttactatgagaaaaggtacattgttctattgcatgtttgagaaagcttatctgcctttctattgattggcagaatttaatctcagaaaggaaaaaaggggcaatatactaaaaaaatgatctccttagttaactgttcaataatttggtacttcatgtgcacaataagcatgatgagggtgtcctacaatcactcacgccgagcttgctgtttgttttccaatggtgtgtttgatattttctcctattgcttgtcacataaaagaagaaaatatctgtatagtaacttagatctaaatattcatgttggtcacttttcagaacctttcaatgtcagaagttaactattactattcatgttactccagtttattcagaactaaagcatcaaagttcggctacttatttcttgtttatggacatgataagaaaaggtcgtttaatttgatcgaatttcacatgatgtagcttttattgtttacatgatgttgctcttgatgacttgactgaatgatatcttcaggaatgatgcatttaatggatcacgagaaagtaaacaatgaacttgccaagttgatggagacagaggggcttgacatccagctgagctatgatggtctcagggtacctgtatggctctaatactattaattcttttaaacacacacgacatttttttgtcttctaggcacagctaggatatgtttacagattttctaaggtttcagttagtaaaattattattacaagatgtaatctgttgaactccttgctttgagcctttgcttttcttttattctcccttctctatagagggagcttatgtagcaaatatacatcttataatttcccaatgcaataaaatttccaattgattgtttttgaaacaatactttcctatctttctgttgcccccttaaacagattttctttatggctattattgcttgggttggatacgggtgtgagggactgaggctagggatccagctgctggcagggcttattccaggcttccagctgtgaaagagaggctctgaggcctttggaaatgagaaggggaatactagcatgaacttgtatatttctgcttccgcaatgaagggtatgggtcctcacttatatagatgaggttaacccctaacaagagaatctaatcaaataaccaaagtaatctcgtctcctaaccaaaccaactaagattttaatctccaatctgctattttcttccctcacttggaggtggccttgctgattcttgcgtgtggggtgtctctacttgctgctggctgctgccccagagacactagagcccgtaacagttgtatggataactggactctaatgtaggattagggaccataaaaggaagtcatcaggacttccttgaaatccagctgaaggaacagaaaacactggtggggggggggggtcaataaaccatttgatctgcaatatcacatgacacaaatgattactgggtacagatgaaactcctagcttgtctttcttcggtgaatcacactagatcccagcaataattagtaatttttcttctctaggtcacacataacaaaaggctggtgtccaggaatcgattacactccagctgctcgacctagtcttccccttaggatcatcactccaaaatatctgagtatgaaatatgagggaagcaatttagtctttaagagtttaaagttagaatatcattaggtaaagactaaagaagttaattttttactgtgtttatgtacctgcccatcatcatgaccgtggcttgagggttcgtccctggtgatctagaaaatgttgagccatcgactacacggacgcctgaaactccaagcacacggtgttgctgatcaaccaccttccctacatggcatccaccatggtagtgccagatggttattactgtatccctgcaaaattgctctagggattctgtgtcatttgtatgcttgggtatcaagttcacattagcctgcacactcatattgagcactctttccattgaatgtccatcagtgttggcagacagttcagagaaacggtttgtcttcagtattcgttcaatggtcttgataccatagacgcaacgagtgagatcctgtggatgactgaagtagttgaaggtaaccgcagggttcttcttgacatcagtgtctatcagggcaagatgtcccgtagacagtggaccatcaatcttctcgaggataaaaccaccatggaatatctctttgggtagattaagtttggtatttgcatacttctgtgctttttccaggcttctttccttcggaggaattgtggacagctgtccaatctgtaccataggaatataatatgtattagaccaacaaggccaagtagggaacaaattgagacaacaatggaaactatgatggcagttattggagttgttgcaatgtagacaacacttattttttttaatctccaagacaagaagttcaattctgagatctgattcctagaaaatctaagcataaaacaatgacttataaatcagataagtattatttcttagaatatactattatatgcatatgcatattcacctgtaattaatgaattggtctaagttgtgtttgcaatgttgcaaaatgtgagttttgatagtttagactttagaatctgttttcctttttgaagtctgcagatctaagcagcagctttttcctgatgtttgtgatactgctttagacctattttatgcacaaaaagcttctcatgatgcaagtaagattgatgacatacctcagcggacatgattccatggtggcaatggatgctttctggtgactggccaaaaccactactggcctcaatgaacacaccagcttcagttattccaacagtctcaatcagggactggcgaggggggcttttcgtcggtatgaatatggagttcatggggttatcagccatccctttacccacatacttgttatggagaactacaggaattttatggctcctaaggtcattcttgggtccaatcccactgagcaatagcagctgggggctgccaattgcgccagcagagacaatgatttcactatcacagttgctgttgaggaatgcctggtggagtcctccattctcatcggtgaactgaactccggttgctcttggcttcagttgccctgcatcagaaatggtgtatctgaaatatggtacgtgattactgaacttactctttctattcatggcatataattctatataactctattttagaagataatacaacttgtaggagctttggccacacatgtgtaattatttacctctctgcgagttaaagactatcctgttcacactagcatgaagcagcacccttaggttgttagggtctccagctgcaagtaagtcggctgctgtgtggcggtagccagtctcatcaaagatggtgccaccaactttggtcccagaaacatggtcatatgtgtagccattgaaaggagatacacctgcttggagtagcccatcccttagtgcagcctgccaaggtgcgatcttaggccactggacgatcttgtcctccacccaagggaaggactcattcaccaggtcttcatcccagcctacctcctggatgaagctgtttgtttcaagaacaaaaacacatggtatacaagttattagcaatttaacatgtagttcaccaataacaatttaacatgtagttcaccaatatgaatatcaatatagaagtaaaattccttcttgaagactacgggattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13347 - DNA, 15892 bp, Oryza sativa
cactaatcttatagctatctggtaagttttttttttccaaatgttagctagtcagtccttataaaaatttcgctcaatttgaacgaaattgtgaagtctatagctctggagcctagatagaattcaaagtaaatttcaataaccttacttcctgacattaggactgcaatacgtcaatatatagatttgaaaacttttccatacaccactaaatctaagtcatctctaacataaacccaccactactcactactagaaaaccaattttcccaggcggccaaaactaattttcgcaggcgggagggaggtccgcctgcaccacagcgactgcgaaaatcatcgattttcacagtcggggcaacggcccgcctgcgaaaatgcaaaaaaaaaaacgaacaaaaaaaatcgccgcacgcggctcaccgccgccaccctcccccggccggatctgagaggggaggggaggggagccgccgccgccgtcgtcaccgccaccgccgccgtcgtcgtcgccgccgccgctccacgccatcgttgctgccggcggcctcccccctctctccttcggccagatctgcgagggagggagggaggggagacgccgccggccgccccgcgcgcatcgtagccgccgtcgcccccaccggctttcccccttcctcctccggccagatgtaggagggagggggcgaggggagccgcgccgtcgcccccgctggcctccccctccctcctccggccagatctgtgaggaagggagggaggggagacgccgccggccgcgctgccacgccgccacagtagccgtccatgccgcgccgccgtccccgccgcgccgccgcccccgcagcgctgccatccccgccgcgcctccgttcccgccacgccgctggagaggagaggagaggagagtcagtgagggagaggagactgagtcagtgagggagagggagagagagagagagttgagtggtgggaggggtgggaggagaagataagggtgggttttttttttggtaggcacgatttttacaggcaggacccctaaggttcgcctggaaaaatagattttcgcaggcgccgctttagtggtctgcctgcgattaggcgtacagcatacttcactccgatttatatttttgtaggcggttatttggttctaagggtcatgtccgtctgcgaaaaaaagacccctatatttagaaaaatgctttttctagtagtgacttttcctctcgttgaaatcatcataggcgggagaggttcattagatcgatggatatattgtagctcaaaacgttattagcctcgatatatatctcgcatatcttagcattgacactactagaaaaaagaattttccaggcagcccaaaaccattttcgcagtcgggggagaggaccgccgctaccatatcgactgtgaaaatggaccattttcgcaagcgggcgcatggcccgcctgcgaaaatcatctcaggaaaataaaaaaaaaacacggggcgccgccggccagggctcccctccgtccgctgccgtcggcgccatcatcgtcgtcgtcgcggcggcggagggggcgaggagatgaagcggccagcggaggcggcgaggagagaagccggcggcgcgcgtcgtcgctcgtcgtggccagcagcagagggatgcggcagcgcgcggacgtcgtcgtggagggagccggcggcgcggacgtggcagatgagggagccggcggcgtgcggatctggagcggagggagccgttggcggcatcgcggtcatcgtcgtcgtcgaggagggaggccgccggcggcgaggagggatgcggcggctcgcgggagtgagagaggagggagcagggcaacttttccaagtgtggggggagagagagaggagggggagggaaatgagtggtggagaggagaggataaagatggtggtggagaggataaggatgaggatgactagatttttttttggtaggtactatttttgcagacggaccacgtaaggtgcgcctacgaaaatctattttcgcaggcgtcgcttaagtggtccgcctgcgaaaacaggcggacagcgaacttcatgccgatttatattttttttaggcggtcatttggttcccagaatcatgtccgactacgaaaataaaacccccacgtcggggaaaatgccttttcttgtagtgtgatacccgttcaacacaaaacatatcaacattgtttcacaacaggtgtatatttgcgacatctctacctccacctctataactcctcatctctagagccattagcaaattaaacattgtatacacacgttctccaattatgggctcatggcagcatgccaccaatcaaagataaatgttgacaaatagctacgtggtttagaccggtacttagtatcaatactaatatatttaatacatctctacctactgaaatattggtaccaaaatatgccaaaaaattggtactactatagattatttggtaggataaagaaccaaacaaccccataatatttatatcttagaatggaggaaatataaaatattcttggtgaggttatatatttcatgattatctataaagttaaagactatatagatacactccctcgaaacacatgattaaaaaaagagaggaataaaaaagaatacataatgttaacaggaatgtaagtacaaaataaaagattataaaatatagaaataatcttttaaatatatagaccatagaaaaaacatggaaattggatgagagatatatagagtcaaaattttccaatcggttcaagctcttcctaacatgtctccgtaatctttataagtgtgtccatttcataagaattttaaagtaaagaatatgattcaaccctttatttcaaatactatagtaggatttttttttataagattaaaattatttttcttacaaatgaaagtgggcaaggatctcatactagctagtagttaagaagaacggagggcgcacatgttttttctgataataagggaaacacacgtccggcctctaaatcaaatatgcatgtattttttaccacaatttattacaagattacatcatcagttggtagattcctgtttttaagaataaacaactcattactcaataaaatccatagtaaatcaaccacgaggtcatgttactgaatctcaatccatagtaaatttttacgaggacggaggaccatttcaatggtgcgcaactaaaacgctggccgctgatataaaataatcgaatcctggccactggctgcacgtctttcgtggcgattggcgaacatatatatgtacagttctacttctacactccatctaattgaaaccaccggcagggagaagtcacttgatcaggtcaattaactgaatattagtactactagctggaattaatgttgactgcaaagtgattcgtccgaggatgagccagagcgacagccatccaccatccatgcatccatgatccatccatcgcttggtagtagttggtagtactttttttagaactagtagtagttgcctagttggtactccctccattctaaaatgaataaatgtagttttgcatgattcacatttaacgtttaagcgttcgtcttatttaaatttttttttatgattagtatttttattgctattagatgataaaacatgaatagtactttatgtgcgactaaatatttttatttttttcacaaatttttcaaataagatagacggtcaaacgttggacacggatatccacggctgcacttattttaggacggaggaagtacatggtagtactatcttcttcttcattgactctttttagtgagcatactcaccttttgtgatgtagatatttttttagtaataaactttattctaatatttgcttaaaatgcaattattacatatagaggttgcagtgtaaacaacaatgaaatataaaatcatggcttgattaaaaataagaagtctactttaaaataccacctaaagacagagatacacatggctaaactttcaaacaccggtggagaaacgatttttactcccggtttgcaacccccttagtcccggttttccaaccgggactacgaatccgggactaaagatcgctatctttagtcccggaaatcgatctttggtcccggttagtaacaccaaccgggattaaagatggagccatttttaaccccggttggtattactaaccggagtaaaaatgaagccagatccggttagtattttcttttttcttttattgttttttactttgaatattgatttcaccacatccccaaatcatccccaaaatcacggaacaaaatatcatctccaaatcccaaatcgatcatctacaaatccaccatatccaaatacatcacaaatattcaaaacaaatacattacaaattctaaaaagaaacatcacaaatacatcacatatttacatcgcacagatcaaatacatcacaaattctcaaaagcaaattcatcacaactccatgggaaaaaaacaaatccactggtcgcttcaccgctgtcacctggccgccaccctccgccaggccgcacggccgcagcgcacgcgccgcagcccagccgctgccgcggctgcatccgccgctcgccacgcgcgaccgccgcctgcgccgccgcagctgcatccgccgcccgccgccgccgcggcgcttctgccgcccgccgttgcctgcgccgccacaactgcatctgccgcgcgcgaccgcgcctatgtcggggagggatctgccgtggccgcaggggagggggaggagaggggaaggggaggaagggggaagaagagaagaaggagatgagaagatgagaagggagaagaagattggagaagataagggagaggaggagagatgagaggatgagaggataaggctgttggtcctctcgaggaggcgcggtgcgatttttttttcgtttttcttttgtctcggttgttataagcaaccgggattaaaaatagatctttagtcccggttggtcatagaggggtctgacacagcctgccttctttcgaaccgggactaccaaccgggactaaagatcaaaaagtgacgtcagctttttcaaccgggactaaagatcatcggttcttattcaaaccgagattattgtagattttggacaaccgaccaaagctggtttctctaccattgaaatgtgattggtaagagtataaccgtttgtttctccccagcggcttataagatgcatttagtttttgtctaccttaaaatagaatacataatctctgtaatcaacggttgatcattgtgctgattggatttcactcacattcgataaccaacgttgaaccaaaaataaaaaaaaaacgtcggaaagtaaatgagttgtaaattaatcattcagccaaatctcgccaccatcatagccatcaaatccagtttgacgagagcattgctaccaaggacaccacgtcatcagagaacccccaatgcgactcctccaagaaggtcacaacatataagatgtcgttgtcactatttccaacttccaaaactaggttttaacccagagattctaaaactagattcctagactaggataaacggtctacattcgctgtcaggtaaatttagacagtgtatcctaattatacaaatctagacagtttatcttactataaatttagtcagtctatctaaatttgtagtagtctaatctaaggccctatttgattcagcttaggattattataatctggattattagtagtaagctaaaacaaacaagtagattattataatctataagctagattagtataatccaataaactcctctataggagctttttctagattattgagtggctaaagacccactacccttatatgcctctaataatccagagaaacaaacaactcgcagcttattctgtcagcttattataatccagcttatagtaatctgatttaataatctagttacaataatcttaactgaaacaaacagggcctaagactagttatatttccagacacagcagtaggtggttagaagatttgttggagggattgtatcacctaaaagtctctaattttggacttgagaggatgttacgggaaccttggtgatgctaatcggtactcctatccttaaaaaaacaatttttgactatgtatctagatatagccaacgtctagatacttaattacataggtaaaagttgtcttttttttagacggaggatatagacttgtagattgtagactagtctggtttaatgttggtcgatcacattacatttcaatccaaataacacaataaccatccattaaatacatatagttaaaattttaacttgcaattaatagctaaaattcgattgttttggacgggaagtagtagacagtacaagctgagtggttggttaatttgttttccttgttggcgtctttcgccgtcgttatcgatcgatatcgacggatcgatccgggagaagtgacatcgatttttttcaggtttgaatcatatcgatcgcatcgcttgactggctgctactagcagagagagacgagacgagatagagctaagcttacaacttccccggtcaacgtagccggcgcaaccgcgcgcgctccagtccaagcctagccctacttatgcgcgccaccgcccgcgcacgcacgcactcgccgaggagaattggaggaggagaccacctcgccggagagagggggaaaccaccgtgtgcttaggtcgccggcggcgtgcgtgcgtgcgtgagtgagtgagtgagaagtgagagagaagaagaaggggccgggcttttgatttcgttctccatggctcgagccgccactgcggcggcgctgctgctcctgccgctcgtcgtcgtcgtcgtcgctgccgcggcggcggcggcggcggaggagatgaggtacggcggcggggaacgcgggcggaggctggggcggcactgcggcggcggcggcggtggcggcgggggcgcttccacgcaggtaagtgactgggtttataactctactattgtaggcgtatatacgtggaaatgtcaatggcgaatagatttaagtggtgttgcgttgccaacttatctcgtaagtatctttacggcatggtcacaggaacatatatttccttgtgcataaatatttttaaaatcttgattcaaatccggactctatatttaaactggatgtacacgtgcataaatatttttaaaattttgattaatatccagactctatgtttaaactggatgtacaccgtccatacttactatacatatatactctctcctttcatattataagtcgtttaatttgatttttttttctacttcaaacttatttaatgtgactaaatttatagaaaaattatagtaataacattttcaatacaaacaaatatattatcaaaatatatttaatgctatatttaattaaactaatttggtgttgtaaatggtgctattttttctataaatttagttaaacccaaaaaattataactaagaaaaaatcaaataacttataatattaaagagagaggaagtatatccgatgatcaaattggataaaggataatataatactaacaagtatatatattctcaaaaatactacaatactaatccttaatttaccagcaggttctgtaaatatctccgaatagaaaattacgtttaccaaagtgacattcaaaaccttttttagaaattaagttcaattctatatatgctatatcactgcatattatcgaaagagggcgtcctagaaattgagtaatatagtataaggacattcgtaatagttaggatccctttgaatcgcagaaataaaaaaacgaagaaatagaaaaaacacaggattctaacaggaattaaaatgtaaaacaaatgattgcaaaatatagaaaaacacacataaataaccgtttaaaccgtaggaaaaactcaaaaatcggatgagggagatagacccaaagcaaaatttccaagagctttgagctcttgctaaatttcctccaaaatctctataggattgtctattccataggagtttcaaatgattggataggattcatttctttgattcaaaagtatttatagaaattttttatatagtagaattgaaatcctctaaaatactgctatgttttttctctaaatcaaagcatgttagaatacgttctggattgtctactgtaggttgggagtactaacatatttggcattgactaattaatgctcgtggaatcacgggctaggttagttgtgtcgtattcacggtcatacccagatctgtgtagactggtggttgtagcgtgcgcatgcaagggtggatcactgcatgttactgtatgttagctgcgccatgaatgctatccgcagtgaccagtagtagggcaccagctgttgaggttcaggtctcctgcttctgctgctttcatgcagcctttggaccgtcaacatgctgggctgtacgttcagtaaagtagggccattaatctttgaggcccacttccattcaccctgggccgggccgggccgggtgatacctattccatgagagttttttttttcctcttgtgcttctcatcgtcttcttgttaacttattatcagccacaaccaaattttgaagtcctttcatcgtggtatatttttatgttagatttacatattatttatttatttatttattttatttgttgttgtatggtttatgcgctataaggaaaatgattagagcagcatgattctttccccgcatggaagcttctttgggatcagcttaaagaacaagcatattgcaacctttttaagttgtgtttactagggcttaaatttagacctctagctacgaattgaacgtatatcaactagttaaatttcttgtggtgaaaataatccacccgggttcaagtcctaaacttgacataggtgctcgcatttacgactaattattattatggtcagtggcagatatgccatgcagctatggggtcttgaatccccactcactactaaatttttttgacatatatctattagaagagtggactatagttttgtatagtttgttcagccctcctgttagttctttctagatccgtctctgattctatttaattattcttttaatggtaggtgacgtacccatcgatacgttgcttaaatcggtaagagaggacagacaatttaatcatagtctcgtcaacagaattattatacacgcgtgaccaacttaagtatgatggaaaatgcctaagagcaagttaaaaggagtgcacggggagggaagatcgctaattcactagggcaggatgggcttgttaggacaagagcaatgcgtcacattatttgttctgcctggggatgtcacattggatggaacttgtaccaagcaacttaacccacagtgcaagctaattgaaatggctccaccaacatcactttttcatctttcacctatctctctctctcctctttacctttcccatccatcccctcccaacagattcctctccatcttcgggcaaccccatcggcgcctgcctccctcccctacccgcctcagtgttcaatggcggtggcggtggcgaacggcatcccacgggctcggcgcccgacggcggcggcagacttggccacgtctcctcttgcgtgcccccgccacctcgtccgcgtcttcctcggcgcgagcagcgatgtcgcccgcggcggatcgagggcggcgcgaggcgcgagcgccgggacggcccgagcggcggcgacggcggtggcggatcgagggcggcccggcggagcggcggggtggcgagatccaacccccctctcctcttcctaagcggcagcggcggggcggctaggtgccttctcgttcacctcctcctcgtcgcctctcgtccggtcctctctctctcccctcatctcgccgtcttcggtggagctcggcacggcggatgacggcggcggcgtcgagcggccgcggcacctttgagtggcgtggcagaagacgaaaacggcgtcaagcggcgcagcggatctcacggccgcggcactgtggatgacggcggggcgcaggcacagagccacggacaacggcggcggcagcggcgctcctactcctctccctctccggcgagcttcttcggcgtggaagtggcttctccggcgagcttcttccctctctctcctgctctgtgtgtggcatgctttttctctgacaaatttagttgaggttctcggagccaaaacaagccacacgaacctagtttttacatgggtcccacctccttctctcctccacacggacattgtgcatagttggatagactttgccacatgtcatgtgtgtgcattgtgaacacccttacggctgcacaaaacacatgtttttttttcttttttttaaaaaagatcagcaccgactgcacgtctgttacggagtgcgatagattgtgctatcaactgacgatgagtcgcccactttattttcctttagttctttctccacatatatagaaattagaatgacatagcatattttatagtccactaagttagtctactgcacccactctgctctaattccaatttcgtctgctgttcaaagtgcagtggattcgtaatgtgacaaccgacaacaaagcttcttcatcctgattaatcccctgaatcaactctaattaacaagcttattcgcccatagtagaatagtgcgtgacgcttatcgataggaatttgtcatatatgttggagctgcatataattgctcgatcaaggcatctttaaaaaaactcattaatgataataggatacgataataactgaaacgcccttttgcattattgcgcttgtcggtgccgttgccattcccatttttcataaagtggcaccattcattatgaagctgatttgaattaataaaaattatgctttcaatcgaattatcattacttcatcatgtgatcctttttcgattatatttctctcaaacatcagcgacaataattggatatgctcccatgtgttaaaatagaaaaaaaaaatgaaccaacgcagtgcacatgctcatttgtttatgatccattcacagacatgcgcatgagagcagctcaagaacaaacaaaatatgcgctacagaatttggatatcattttataatatcctgatcaccctgggccccgtgtttaagctgttcaaggcacgtgctgcgtttcagtatgaaaatcgaaaatattgggtgattaatgtagagtgacagtgtgacacaccttcactttgagggagcaattatgttccacgtggcccataaaagatgacatcgatcttatattaagaacagcaaataaaaatatctcggcaaaatatttcaaaaagaaacaacggcaaaatagaaaagcactagctccctctcatcataaatatttgacgcgactgatgtagtttgatcgctcgttttatttaaaaattatatgcaaatatgaaaaatatataagtcacacttaaaatatcattgataacaaaacaaatgatgacaaaataaatagcatttacacgattattttaataagatgactggtccaactttattggtaaagttaattgtgtcaaaataattatgagatggagggagtattatgcatcaaaatttatttaaattcgtggagcatcaagtattggtgaccaaactatataagattcgatatgtatggttaacaatttaatattgtactcgcttcgttttaagttacaggatgtattttgttttttaaagtcttgaccaacagttacttcattaaatgtatccttttgaaaaaaaatgataccactcgattcgtattcaaaaatacttttttataattatatttttcgtgttatataaatattacttgttggccaaagtcctacatcctatattttaaaaccaagggagcagtaaacatcgttggtgaaatctagaataatgatccatagttacaacgccagcaacaaacacggtataaaacagtaatcatcgatcctgcaggttttgtttgatcctttgcacgttataaatttcacataaccatggtttgaacttggaaatgttttagaatttcgagtgtaacatttggagctaaaaatgagttcacaattaatagacgtatattaagggtttaaatgagttcacaataaaggagggtaactcatctgggtttaaaattcgttgtccacgtatattaagtacacaataaggacgtttcagtgggatttattgatggtattgggagttgctgctggtctctactccctccttccaaaaatataaggcctattcctttttcatcaaaacatcaaaaccaaaaagcaattaactcactcaccatatagcaaaaccaatgaacatgtaaccaataagtattagaatggcttcttggttttcaatcaacaatttaatttagcacacaggactcatattttttgagaaatcgaagaatgaaatatgtctcatatttttttttgaaggagggagtatttattttcttctttttttttttgagaaactgcgtacttcatccatcccataaaaaaccaatctaatactagatatgacacatcctaatacaatgaatctggacatacatctgtccagattcgttgtactaggatatgtcacatccagtcccagatttatttatttttggacggagggagtaagtagtaactctatttaagtcacatttgtacaatcgtcctcttgagaagatagaataaaacccttaggaacaaataccctgtaaaacagctagagaaacaacttcttttacgagcctatgtgctaccatattcgtcgagcaatgaactctgaaagacgtttaatctggacttaaactaacttcatgattctataaatagaacggtttagttctgactaaaataccgtcctagtcatttccatagcatcattattcaattagaacggtctccatttcttttaatgtgggttagaaacgtattagtgtgcgtatgttcacaaatgcttcattcattataaaaacttctgctagtagaagcaccagtgatgcgtggtagagttgtgggtgtataattttacccaccataatttaaattctggtgcccacgaatattacgtatatgcaaatgaactttcgaacatgattttagtgagatcagtgatgtgtcgctagtttccgtctcttagagcatgtgttaggggacatattagtggggtgttacgtgtgtagtggtgtgtgcgtgtgtgtaaaaagaaaacttccgctatataagtaggagtatgaaacatgtggagtagattcggatgaaactgacttttttttttttttgctgtgatgataatttgactgtcactgtcagtcgttggctagacgttaatactcctacttccgatagattataaaaccaaaccccgcacgcttcgcctttgctcgccgcgtcttcccttcttctctctctctcggccttaactaaacccgaatcttttctcttaatcccgcgcgcagtgcacgaatctcaaagcggccccggctccttccccttcaccggcggcgatggcgccggctccggctccggcgggctcggccgaccagttccgcgggcaggcgaggctgccgcggttcgcggcgccgcggcggtacgagctccgcctccggcccgacctcgacgcatgcgtcttcaccggcgacgcgtccgtggtcgtcgacgtctccgcgcccacccgcttcctcgtcctcaacgccgccgacctcgccgtcgaccgcgcctccatccgcttccaggtagtagatatatagacctctctgcaccttctcctcctcctcctcctcctcgccgcgccgcagtctcactcgccgtggttggggttggttgcaggggttggcgccgacggaggtgtcgctgttcgaggacgacgagatcctggtgctggagttcgacggggagctgccgctcggcgagggcgtgctcgccatggacttcaacggcacgctcaacgatcagatgaggggattttaccgaaggtaatttttaatgcatttaaatcaccaatggcagtggcaagttcacagcctgaaagctggcactttcgtttgttgaaatttctgctttattccgtgaacctctgttgaaatgctcggaatcgtcagtgcaaaatcgtggagttgtaggcaaaggagataactgataaatatatagtctgatggtctgcctactttgcacttatattgattgtgattcacaaatcagttgcaagaatacttttctatagatgctgagggctttttatgcaagcatgtggttggaaagtagttatgaatctgtgctttgggtctatttcgacaagttgtgtgtatcatctacattttcatatgagaaaatgccattcgttgcagtaaatatgagtataaaggggagacaaaaaacatggcggtgacacagtttgaggctgtggatgctcgacggtgcttcccctgctgggatgagcctgcattcaaggttaattcttatgatagcacgacttgttcaataatcataattttcttgtccagatgtttgatgcaatatgtgttgacatatcatatctattttttctgttgtttcccctcttcatatttaatattttcaggcaaagttcaagttaacacttgaagttccatctgagctagtagcattgtccaacatgccagtagcttgtgagacaattgctggtcctatcaagaccatccactacgaagaatcgccgcttatgtcaacttatttggtggccatagttgttggtttgtttgattatgtagaaggtgtaacatcggaaggtaaccatctttattctcgtcccagtaattcaacattgttgatggttcatagtttctcacattgaaggtgctttaggagccattttttcccttttacattccatttcattagtgtgtttaattgtgttcaggcaacaaagtccgtgtgtacactcaagttggtaagagtagtcaagggaagtttgcactagatattggagtgaagtcattgaatttctacaaagagtatgatcacaacctgtacctgtattgctttctaattagtttctaaacaactataataattcagctaatgcatattctatgtgcccaaggttgttgcttgaattaaatcattaaccaatagttcattccttctgtgctctagctactttgatactccatatccactccctaagttggacatggttgctattcctgatttcgctgctggggccatggagaactatggattggtcacttaccgggaagtttctttgctttttgatgagcagtcttcatcagcatctttcaaacagaatgtatatatcataactcagattctttttagttacatatttcatcatttatggttcactttgtaaatagtgatgcattattatttattagacattttctttgggacgtccaaattccttcagtgtaagcaactgttctttttaggttgcaattaccgtggcacatgaactggctcatcaatggtttggtaatcttgtaaccatggaatggtggactcacttgtggctaaacgagggttttgctacatgggtaatcaattatacaacactgaattttagaaatttaatatcaggatactactgtatactgaatggttggaccttttatttcgacagatgagccatttgtcagtagattcttttttccctcaatggaatatctggacacagtttcttgatagtacaacctctgctctcaaattggattcacaagctgagtcccatcctattgaggtaatagctgtttgatacatgccatggtctggtactctggttcaatggtt

SEQ ID NO: 13348 - DNA, 5148 bp, Oryza sativa
agattttcgatgccattagctatgacaagggtgcttctgttattcgtatgctacaaagttacctaggtgcagagcgttttcaggtttcatactggctctccttgaaattcttcagaatcgtgttattcttatctgtagtgagcaccttttgctcaactgtattgcttagaagcgtatgaaaattaccccaaaccattttctttctttgctctcggaggaagcattgaccctttagtctgtccactattcatttagttgaaaaacgtcaagtggacctttggatattccaagtttccaatattttaaatgcgtgaatgatccttaggcgatacaattggtgttaatgttcttttgttagtgattttgtaagtgaaattctttttttaaaagcttcctatattttttagggcaaatattaccatttcccccctaatcatcttgcttttgtttaacgagtaccctgttatcgatgacgagtcaaccattaatacttcattgcacgtacttgcatggtacttttggacatatactcaaatgatataaagaagcaagattcaacagatgaaaatattaatcctgtagagagaggcacaacttcaataagggtttgatggccatcttgtgtacttctctagggtgggtaacaatttacaacctgtaacaccatgtacaagttacaggagttggagctatctttgccctttttttgttgatcatatcataaatatgaacaaattgtaaacccactaatatgataaagctccatttttgttaattacatatttatcgaaggtcaattcttgcttacttctttatcttgtttcttcattattgctgtgtgactccacaaattctcctaatgcatcctcttgtactaaacttgtggaactgttactctttcagaaagcattaacttcatatataaaaaagtatgcctactcaaatgctaaaaccgaggacttgtgggctgttcttgaagaggtatctggtgaacctgtcaaggatttgatgactacgtggacgaagcaacaaggttatcctgttatcagcgtgaagcttaaagggcacgacttggaacttgaacaggtaataaattatcgaaaagagtagcgtcattccaatgtactgcacattcatctacttctgaaccacctatatgtaaattcattatgcatatggtttgcttttcctttctattttgccgaggtatgattagtgaggtacaattcctaaattaaaatcctgtatgaaatgtttatgacaaatattacataaaaaaattatgacagaacttcatcttagtttaatttttgtgcctgctatttatgaagatgtaattggctgactagaatttacgttgccctttcagtgcaagacaagttccacaagtagttcccataatatcaaaatttcaacggcacacgggtcaaattctgttttgacgcatttctgacgctctctctctctctcttttttgtcacaggaccaatttttgttaaatggaacctctggtgctggcatctggattgtccctataactttaggatgctgttcacatgataaacagaaaagattattgttgaaacataaacatgataacataaaggccattgtttcgcaatgtgatagccgacagaagggtggaaacttttggattaagttgaacattgatgaaacaggattttatagggttaaatatgatgatgagcttacagctgcacttcgaaatgcattgcaggccaagaagctctctctaatggacgaaattggtaaacacaacctgtggcactattaaatttctattgcaatgttttttttcctgggcgctattgcagcgattaaaggtgttataacactatattacaggcattgtggacgatgcacatgccctttctattgcctgcaagcaaacattgtcatcgttgctccacttgctgtatgcgttccgtgacgaggctgattacagtgttctttcacacataaattctgtatgtgtattttatgttgaattaaattccaggatattcagttattcgttggcaatgatttgtatatatcttttactttggcttgtcaggtaacttcaagtgttgcgaaaatatcaattgatgctactcctgacctggctggtgacatcaagcaactttttatcaagcttcttctcccgcctgctaagtatgtttaccatgtttgctgctttttagttctcaatatattatttcccattgtatgttcatactatgtgtatgtttgttaaacatgccttcctttgtggccatgcatacacgatgacataaattttatttgcagaaaattaggttgggaccctaaagatggtgaaagccacctgaatgcaatgctcagaccaatgcttttggttgcccttgttcagcttgggcatgataagactataaatgagggattcaggcgtttccaaatcttctttgatgatcgcaacacttcccttcttactccagatactagaaaggtccttcttttacccctactttacatggtcctctttcttttttgactcatctgtatctttttttacaaaaatgaattgatatctgtatatcttctatttgaagacgaattcatctctgtatattttgcatttttttttcaggctgcatacctctctgtgatgcataatgttagtagcacaaacagatctggttatgatgctcttctaaaggtctacaggaaatcagctgaaggggaggaaaagttacgtgtcttaggttgatatcttctcagccatcttgtgttaacaatgcttgctgatattttgggttatccagacttcctgagggctctgtctccttatctgtaggcacactttcttcttgccaggataaggatattgttcttgaatcattgaatttaattttcacagatgaggtaaattgctaaatggtttttttcttccatgactccattggaaggacctgattgaacttatacttttacattagctacctgtaagttatatacaggtctcatttgtttctcttgcttataggttcgcaatcaagatgcatatcgtgtgcttggaggtgtcataatagaggcacgtgaaactgcatggtcctggttgaaggtacaaaaagtccagttacctctatgcgttaccgcaacataaaatttgtgatatctggacctttgaagcatgtgattctcctaggatctttaaatataatgaaatatccacttattggatgttttttctgccctagaaagcatcaaaattatgcaaattttctacattcaaaattataagtaaatagataaatttcgtgctttcttcaagtagcatttccttcaagtaatcgaattgtgtagatacgtcaaatgggggttatatttgtaagagaaaaggacaattatagtttccttagctactttgctggactattttacactatattattttcatgttaccttacccattgaatccttcttttaaagtcacttcactccctgatgatattgtctttttttgcctccttgtacaagtcatgttttacaaagaaattttgtaggatggtagattaccgcatatgctatattactaattattctcgaaaatttccatgacttttgaaaatcagtctttattgctatgaacctatcaagtagcctctccgaagaacactttgaatgataaatcaaatgggttacccttgtttgagaattagtaacttccactcttgtttatcttgcttctatccatttccttacaaaatacccccttcgtccccaaatataagagattcacacattcaaaatttgtcctcgcaaacaaggtgtcatagagtcctgctaatccctccaaccacccgtgattcaaatttctccccatattgccccaaccaccctcccactccctacacacccctcattatttaatgatgggctcatagtatttttcctctatccttaatttctccgaaacaacctagactcccttatatttggggacggagggagtattaaacatgcaatgaagtaatagaaaatgttgagcttacaaatgttgtttcgttcggatgcaggaaaactgggatcgtatctcggaggcattttcaggaagttccctcatatcggatttcataagatctattgttacactggtattactcatctgcattctctgttcaattccgcacgagttatctctcatcatgccatttgctgaaacatgctgcttctttgtttgccggtagttcacctcgaaagagaaggaagcagagatctcccagttcttcgcgacccgcactaagcccgggtacgagaggacactgaagcagagcctcgagagggtgctgatcaacgccaggtggatcgaaggcatcaggggtgaagctaagcttgctcagactgtccatgagcttcttcacaaaccctgatctgtatccggtgtgatccctcccccccgggagctgcattccctgctatgaagtgccaactttaggcgaagcatttgtcgtagcagcagcatcccagcacattgttgctctctgtttataagtcatgaagcataggctgcatacgaggcaaagggatatatagtgcttaccgtttctcttcataggttgtgtacagcttgtgcccaggagccatgcatatgattcaagagttgtcgcacaattctactgtagctttgaagtgtccgagtgaataagattttacctttcagcattctgtatcagaccgagctcaactatttgtcgggcgattgttctccttggccatgataacttaggctgtgttcttctcccccattttcccaacccacctctcgttttccgcgcgcacgtttttcaaactgctaaacggtgtgatttatgtaaaaactttctatatgaaagttgtttaaaaaaaccatattaatctattttttttaaaaaaatacttaatacttaattaatcatgcaataaaacgaacttcgttttgcgtaccgaacacggcctaagtcagatttgcatgaactagcggactgatcacaaagcggttagtacctccaggaaaaaaaatcgtgataatttaagagagctctcccctttcccctgttttttttttcatttcattcttaaaataaccaagcacggtaaaaacgtactccatccgtttcacaatgtaag

SEQ ID NO: 13349 - DNA, 6787 bp, Oryza sativa
cttacattgtgaaacggatggagtatcttgtttgtcactttatcatgctataaacagaaaacaagaaaccattacaagcagtcttaattcttaaaccctcaatctccaaaatggaactgaaaacctcctgtttaaataatgaaaccgagcagaaagatgaatattccttgctcattagtcattattaaaagggcacctactcctcaatttctattctttgttatccatataaaacttatctgtaacaaacccgagaacgacaagggctgatgcatcgtcacgtacacaaattgggctctacaaatttcttggctccgtcaccgtgtccgtatcattagaaatcttacataaatactcgctccattttaaaaatatattacatcattgatttttttataacatatgattgttcatcttactaaagaattatataaatattatttattttgttgtgacttgttttatcataaaataaaatataatcttaacttatacttgtacatatttataataaatttttgaataacacgaatgatacgaaaagtcaacgatgtacgagggaggtcctagtatgtgtgtgtatcattcttttaaaaaaaaactcactcatgtctgagagacgctcaatgattatgatcatccggatatatgatcgaaccttccgattactgcttgtttaggatatcatcatggactcgtcggatcaaacctcccctgaacaaattcggccggccggcggctaatgccggtcaaaaaattattatttcttcttaccactattcgactcgccgccggcaatcaccgtcatttttttttggttcttgcgacgtcagccattagctacttgggccttcgcaagttcataccgatccagatatatggctgcgtttagttcccttcgaacttccaaaaattccaccacatcaaatattttgacatatatatgaagcattaactgtggacgaaaaaaaattaattactcagtttgcatgtaaattgcgagacgaatcttttgagcctaattacgtcatgatttgacaatatggtgctacagtaaacatttgctaatgacagattaattaggcttaatagattcatctcacagtttattttgttattagtctacgtttaatatttcaaatgtgtgtacgtatatttaatttttatttttgaaaagtaactaaacaaggctataaataaacccacccctcgcggcttcgcttttaatttgctcgggttcttttcgcggctaaataatttgttcaaaccttttcgatcacgcgcgcgcgaatctcaaagcggcggaggcggaggcggtgatggcggcggcggcggcggagttccgcgggcaggcgcggctgccgcggttcgcggcgccgcggcggtacgagctccggctccggccggacctcgccgcctgcgtgttctccggcgaggcgtccgtggccgtcgacgtctccgcgcccacccgcttcctcgtcctcaacgccgccgacctcgccgtcgaccgcgcctcatccgcttccaggtaagtagaccgacctgaccttctcctcctcctcctcgctcgccgtcgatcgatcgatctcgccgtggttggttgcagggcttggcgccggcggaggtgtcggtgttcgaggaggacgagatcctggtgctggagttcgccggggagctgccgctcggcgagggcgtgctcgccatgaggttcaacggcacgctcaacgatcagatgaggggattctacagaaggtaaactttgcatttgaaaaaaaattcgtggtgatcgtagcctcgcagaggctaaatttgcgctttaatctcttgggaattctatattttcaaagataaattggtctaaacccctcaaggagatgtgccctcgtttgttcaaacttcatccaaatagttgttataaattctaaatttgttttgacaatgttcataccttatatatgaactaatcaagtcaaaactaagttcacatagtactagccaaatacctgtgctttgccacgaatcaaaacaaaccaatagtgaggtttttgggacaattttgtacctatagatgatatattgtacagatgaattatgatagaatcatatatttagagggattatcttataacattaaaatacatggttggtacaaaacatgatgacgtaggtagtaaataaaaaaaatactatacttggtaaggtggttgccttttttgagtataaattgctactattcgtatgtgacttgtttttttcgtttctcaacgtgtagatcgaatttgaatatgatttttggcggagtattagatgttactctatatttgctaatttgttttgcaaattttcacaaccacttgcattgaatttgagagaaaaaagttatgttaggggacatcccctcgagaactcatgatcatcgttacaaatttgaactgatcatcagttgattgatgtggttgggaagttcttatgaacctgtggactaggatttaccctctccagcaatgaatagttgtcgctggatattattcgcatccaaagtttgaccgctcacattttagcaacaaatttataaatattttcgaaatatactatattatgaaagctcgatgcatgctaaataagttcatacccttttttcatcaaaacattgaaatttaaaaattaaattattatggtcaaagttgaaacagcagcggtcaacagtgacacttaaatggaaacggagagagtattttgatgatttctgggtacgactcatgtgaccttttcatatgagaaactgccattttattgcagtaaatatgaatacaagggggagacaaaaaacatggcagtgacacagtttgagtccgtggatgctcgacggtgcttcccttgctgggatgagccttctttcaaggttaattaattattacggtagcaaaacctgttcaccaatcagaattttctcatccagaggtttgatgcactatgtgttagaacatcgccggatctatctctctaatgtttcccctcttcatatttaaaatttcaggcgaagttcaagttaacacttgaagttccatctgagctggtagctttgtcgaacatgcctatagttaatgagaaaattgctggtcctatcaagactgtcgagtatgaggaatcacccgttatgtcaacttatttagtggcaatagttgttggtttgtttgattatatagaaggtgtaacatcggaaggtacgtaccagtaatccagcatacttcatagtttctcacattgaagtagttctgtaggtgccattcttttccttttactttccattgttttttttattgtttttaattgtattcaggcaacaagttcgtgtgtacactcaagttggtaagagtaatcaagggaagtttgcattagatgttggagtgaagtcattgaatctctataaagagtatgcgcgcgacctatcatttcttctaaattggtttctaaagaaaaaaaatgattcatgttaatatatatcctatttacccaaggttgttgcttgaaagagtcattgaccaaaatttcattctttgaatgctgtagattctttgataccccttatccactacctaagttggatatggttgctatccccgattttacaaatggagccatggagaactatggattggtcacttaccgggaaatatatttgctttttgatgagcagtcttcatcagcatccaccaaacagaatgtatatatcataacactgagaatattcagctacatgtttttttttcattatttacagttcagttcttaaacagtgatgcattacttatagttcagttcttaaacagttctcaaacataatgtatatatcataacactgagaatatattgtcactatgatccaccaattctataaagaaatttacattacagtttttaagaatgatttcatattgagatattttccttgggtgatcaagtagtttatatgtaaatctctgtccacatctgttctgtttaggtagcaattactgtcgcgcatgaattggctcatcaatggttcggcaatcttgtaaccatggaatggtggactcacttgtggctaaacgagggttttgctacatgggtaatcaattatacaacactgatttttagaaatttgatatcaaaatactaccaactgagtgcttggaccttttgtttgaacagatgagctatttggcagtagattcctttttccctgagtggaatatctggacccaatttcttgacagtaccacctctgctctaaaattggactctctagctgagtctcatcctattgaggtaataactgtttgatacatgccatggtctagtgcagtcgttcaaaaaattgatgcatttcatacggtgttcaccattttttttttctaaaaccataaatactacgcactttatcctgtataaaacagagagcgtattttgaactgcaaatttgacgatggtaagtaacggtgatgcataattttggttacattcttatcacatccgttggttgattcctcactgaatctggacaatgaatacgcgatatttaaattgatgatttaatctttttagtctcaaatgttaatttggatgtcaaattcacacgatgcaccacaccagcacaattacaaagcatcagctggtggcatcaaacattttcacttgtctaaatgctggttagcgattttcctcactatgtgttactgttttctacaggtcgaaatacaccatgccagtgagatagactcgatttttgattccataagctatgacaagggtgcttctgttattcgtatgctgcaaagttaccttggtgcagagcgttttcaggttttatacttgtcattcttttattcactctgggtatcatttgcataactttacggcttattcgaagttagaagtgtgtgaaattacctcgaaccatttccttccttccttgctgttggagggagaaatgacacttcattttattcccctatttagttattttatgaacaaacagttgtgtctcttgacttgctactcttccactctatcgcaatctcccatggcttcactagcgcaatcaaccagctcctttacccgtacatccccatctcatccttgactaaaactacactacacgttgtcatgtccctaatctccttggtatgcgctgttaccatgatcctgggcccatgactgccctatgtggagataagatgggaatttcctgaaaaactgagtagaagtgcattgggagaagcaaagaagggggaaaagttgggaatgataacaataagagaggtagtttcatgagggtaaataaaggacacactcaacttctatgagcaaatacattattatccctttgagtgtaaggtgtcaatatccttgggccctattaattggtagagtacttttacaatgttctctaatggttgtagtctactacaagtgttatcatcttagaaataatcttaactgttgacatttatgagttctactaccagtagaaaaaaatattctactaccattagttgatgtggtagtataaatggatatgatccattgaattagaaaaaaaaataaatggtccagattagttctattactagtagagagcattgttaaaacacctcaatttgtatccaattttcagcataatgatcttttttagtagtcatgatcaaacatcacaacataaaccaccacgtacaagtgagagagaatggagggataaatttttaccacatcgtaaacctagcaaatcgcacactcaataattaaaggttcaattagctagttacatacttatttaaggccaactcttgcctcttttgtccactactctacttttcttcaactaatgtatggctccgtcatcttgtactaaacttgtggaactgttgctctttcagaaagcattagcttcatatataaaaaaatatgcctactcgaatgctaaaaccgaggacctgtgggctgttcttgaagaggtatctggtgaacctgttaagaatttgatgactacatggacgaagaaacaaggttatcctgttattggtgtgaagcttaaagggcatgacgtggaacttgaacaggtaatgaattatcgaaaagaatatgatcattcaatggattacattcatttacatgcaaaccacccaatacgtaaattcattatgcacatatagtttgctctgcctttatatttttgttagtgtggttaggtagtcagaattccatacttaaaatcctctgcttattatttatgacaaaaccccatgttgaaaatttttgacaactttatctgggtttaatatttgttacctgctagttaagaagatataataagctggttggaaaattttcctagtcctcaaagagggcatgctgcacaagatccgcaatgtagcagttcttataatcttatctgaagttttgggaatttttctctagaagcttcactacttttttcatttctctaactctgctatatacatgtacatatgagtagtatatgggcctcatgggccaacacatacataactcaacactccccctcaagatgggcgatagatatctatcatgcccatcttgttacacgatgaagtacactccccaacacttaaagcttttgttaaacagtcagctacttgttcccccgacataacaaaacctagcttcaaaatccttcatctagtttttccttgataaaaaaacgatctatctccacatgttttgttcgatcatgctgaactggattgttagcgatgctaatagccgactt

SEQ ID NO: 13350 - DNA, 1171 bp, Oryza sativa
cccagtccgcatcacagtagccctccacacctagatgtccatttttcttgaaccataagccttttcctgggctcccttttaaatatctcaggattctatatactgcgtccatgtgaccacttcgagggtcatgcatgtatcgactaacaacagtcacagcataagttatgtcaggtctggtatgacacaaatatatcagtcgtcccacaagtctttgatatctttctttattcactggatctcctaattcagcacataacttatgattttgctcaattggtgtagaggcaggtcggcaaccgagcatacctgtgtcacaaagtagatccaatacatactttcgttgtgaaagaactatccctctaggagatcttgcaatctcaatgcccaaaaaatatttgagctgaccaagatctttgacttcaaattctttgcttatattctcttttaactgagctatttcttgagtgtcatctcctgtaataattatgtcatccacatatacagccaggatggcaatcttctttccacggtgacgataaaacaatgtatggtctccattgcactgtttgtagcccatgccacacattgcacgtctaaatctatcaaaccaagcccttggtgactgcttaaggccatacaaggatttcttcaatctcaatacctttcctttagtttgagaggtggaaaaacccggtggaatctccatataaacttcctcttgaagatctccatgcaaaaatgcattcttaacatctagttggtatagtggccaatcaaagttagctgcacatgatatcaaggttctcactgtgctcatctttgcaacaggtgcaaaggtttcatcataatcgattccatatgtttgactgtacccttttgccacaagccttgccttgtacctttctactttcccaagtggatcttgttttacagcatacacccacttgcaactaaccaccttcttacctgttggaaaaggtacaagctcccaggtcttgttcttctcaagtgctgacatctcctccatcattgcctcatgccactttggatcattcttcgcttctctccaatcctttgggatcactatggattgtaatgatgcaataaaagccctataggcaggagataaagatgaatatgacacataattagctaggggtgcaggaat

SEQ ID NO: 13351 - DNA, 496 bp, Oryza sativa
attcctgcagcccggagatcgctactggcttatacttcttggggacaacacacagcagcttcttgttgatgtgttcgtcctccatgactccacccatgtcacgaatgtccgcgacgatggcagtgagccgaatcgcaaattcctcaggcgtctccccatccttgaagcgcatcgcctcgaactgacggcggaatccctgctcattcgcctcacgcacgcggtcgacaccgatcctcatggttttaatggcatcacacgccgccttcgccgtgtcgtgcttcgccagcccgcgcaacatctcgcgcggcacggcctgaagtatcgccgagagagctgcccgatcttcacgaaactccacgtagccgggatcaatcgccttccacagcccctgctcctgcaggttgacgcgcatcaggagcgcccaatccggatagttcgtccttgacagcactgggaggcgggtggtgtgccctgcatctctcccctgaggcacaag

SEQ ID NO: 13352 - DNA, 690 bp, Oryza sativa
attcctgcagcccatgttatagactgaacatccatcaagattcacaatgtataagccattcatgatgggtgcatgtaaatagaaaatgtcattataatagactgaacaaccattgtccacaaactctaaaaccataaccctctgcatgcaaacaaaaagcagagataacgttcttacgcaaacctggaatgcaataacaattatttaactccaaaacaaatcctgacggtaaagataatggcatagtgccgaccgcaacagcatcaactcttgctccattgcccacgcgaatgtccacttcgcctcttgctaagctcctacttcttttcagcccctgcaacgatttgcatatgtgagcaactaacccggtatcaagtacccaagaattagtagaggaagtagcatgattaatttctataacattaatacctgaggtgaaactctttccatcctgctgcttctgcttgagctgctctaggtatttcttacagtttctcttccaatgacctatctcctttcaaaagaagcactctgcatccttagggggccatgtcttttgaaccttggtcttagagttgcttgtactcgtgatctcatcagagtttagctttctcttttgaccactcttcttgttgttgggcttgtgcttatgcataaccatcacatggttggagtttttcttaatgcttt

SEQ ID NO: 13353 - DNA, 3025 bp, Oryza sativa
atcgtatgagcatgttacatagtcccgtgattatcgtatgagcatccaatgcctcatattgcctttgaagctcaggggacatagtagcaagtatgagacaacttatatcaagataatcattgcatcgcttttcatgctccctacgttgagcagcaggagcattgttgggcaagttagctggaaaaggctctgtaagcacaaactctttctgctcttgcctaagaacaattctcaggttgcgataccaatccatgaagtttgttccaatcaacttctctttctcaagaatagaccgcaagttaaaattggatggtgcaggagctgccatgatctacaatagaaatatatgtatacaaaatcagcaccatgtttgcatttaacctttcattaaacaatttaacaaaagatactcccactatgtattgtgaaacaaaattccctctagtaacatagtgagtcaagatcctcattttattagtgtctagtgagctttggcatcgcagctagacaactatcaaaataggtaagcaacaccttactaatcacatcattgtgactcttctgctgttggggtgacatcttcatatccaacccaacctatgccccaaggtccaaaactgttttgattaccttgtcaagtaaaccaataatctctgcatatagatgtccgacatctatcctattttatcatgataaaagtgacactttgctatggcaaactcatcacttatgatcacaaccgtaataggtgcaattattagaagagcataaattacacttaatttttctgagggaatctatcctaccatgtcatatcaaatatataacagtaataaagtaagatagatataaaaaccccaagcgaaatctaaggggcaacgcacacggcagtcccagggtacatagatctcatctacgattcgccatgtgaaaaccttaacggcgtaatcaaattatgccgaaaccgagtcaatctcattggctcgtttttctcattggcgtgcggttccagtggacatcaactatccgatgaacacaatcgcgctcagccttggtgagtactaaacattccagtgaagtcaccaacacacataccgattgatctcatcaacccatgtggctatcggttcatctcatgttccgatcacctaagaactcatatacaacataatagatctcatctactacacccgcatatcaattatatgcaatgatctagatcataaactatacaaggcggctctgataccactgttgggatacgcgtagggtacgatagcatcaaaattttctatcgggtaaactaaggaccatgcaagtattagatcatagatcgttaccactcgacgcctgcgcaacggaagaagacgctgagaagtcgaaggaactctcacgaagtagcgcgcgtcgatgtagaggaagttgtcgatcataccggctcgaccttctcctcctcgtgcgttctcctcgccgtactcccacgccgatcaacatcgcaaaccagcggcgcctctaccggtatccacacgtacaaggacggaacaccacgcgcagatgtgctagcacccgcgcgcggctagggttttgctcggggagggaagtgacggctaaggtttctcacgtgatgcaatgcctccgccagtcacacccctcacgaatatataggatccatcactcgggcctccaaggcccataggactcctattcggatccctatccgaattaagctcatattggatctccatccaatccccttatttcggcccattaagcgtgcgaccctgtaggttcatatatactcggctgtaacccgaaaactccttttcggtccaggcatcaacagcggcccctagcagaacgtattgacccaccgaacatacataaagatcatatcggctgaacctctagtgtatacttgtatggacccatttgcctcacgatatggattaagctcaaggctagatatgtgccatcctctaatagctcaatcattcactcgaacctgttgatagattatatgacttgtgattgactcctcaatcacctttggcatggccatgcacttccataatctacaacatcgaggggcccagagatatctctccataggaggggcaaatcccatcttaattattcatatcccactacatgtttcatagcatacccgaaaactactttcataactacccaattacggagtagcgtttagcagtccctaagtaagctactacacatgttgggaaccatgataatctcaggtctaaggattcaacaccaacactaaatgagattactgatgatacaacacatatggctcttgcagtgtctcatgttgggtctatccaacaacatgttcactaacatgtgtccacattattaatttggtatctatataccatgatccatgagacatgatcatcaattaatacatgtgctgatcatctaatcatatttgttacacatatgatatttgatcagggatcctttagaaatagtaacacataatataaagagtctcatgaaagaatcacatattcattaaccaataatgagtttatctattttaagaaacaatgtcggataaatatgtaaacatagtgtgtgatacaatcatctttatgattgcctctagggcatatcactaacactacgctggctctacaacgtatattgattcatatgtaatgaaagcataaagacaatttcatttggttccaggagtctttttgaaacctagttccaggagtcttgatggctcataattatatgcatagtaccctttgatttacactagttgcaaacctgcaaccctcggctataaaatacgacagctaattgatcctgtgcttcacttccaggtgctatcagagtacctcaccttcatttcatttcctgcagcaacatctttgtagcggtagtgcatacaagacaggcagtacatggtttgtatagcattttaccgcgtaaatcaaatggtaattaaattgggcacgagagacctcagggaaggaaggaacacaggata

SEQ ID NO: 13354 - DNA, 7965 bp, Oryza sativa
aattcctgtgattattgcctgattgtactggcgtagcagagagagagagaaattgaacatgtctttttatttgaaaccttttggctaaagatgccatgttttctataagagtttataaaatcctgggtgataaagttctagcatgcaacctctgctaaagattcaccttaaactaactaggtggagtaatttgcatgttggctgcattcgcctgcgatttgttgtagctaatgagatcttccagttggatgtagcataggaagaaagagtcataactaatgctgaaaaggagcttagaacatatctaaagacaatagtggtggtgttgtatctactttaaacaagattaagattagacataaggcaaggctaacttggaccaaagaaggtgatgtcaattgactgttctttcacttaaaagcagatgccagaggagagaaagaattatacatagatgttacaaaccccatcaagggatgtaaccactcaagacaagaaagaacttcatcgttttttcacacaactcctaggggttccgacgatctcggtgcctgaactggtcggcgataaacctaccaaatgtatagctctactataagaccaggaggatacagcacaaggtgaattaaaggagactatcttctccatgccatctgaaaaattaagcccctgatccggatggttacattggggcctttttcaaacaagcttgggacatcattaaagtctgcaactatatatgcccgagcattatcgacctataactttgattcacagttttgttcgaattgtgacagagctacttgccagtcatttcgccccaatattgaacgaattgatctcgtataaccaaagtgcttttattcgtaaaagataaattcatgataattttctttatgtgcggaatttactgtatggcttttatgctcactactagagaaataactattaacgatagaaaatgtggtccataaaagtataaatatggtccaactttggttctataattaaagtatagtaaaaacgggtattgtttggctaaggctctatttgttttaccctaacattattgtaatctatattattgagtcagattactataaactggattataataagctatagtagatttgtttgtttctctagattatagtagattaagggtagtgaatctttaaccacccgataatctaaaaaagaaaacacgtttataggagattaacatattatactaatatggcttataaattataataatctatcgtaataatctacttgtttgttacagattattaccaataatccaaattataatattcctaagctaaaacaaacagggcctaagtcaactagtcgggataacttactagtctgttggtgtcctatcatcggaaaagaatgttttagaaggcaccaatctctacctatactaattggacactttctacgagctctcacgttaattaaaaaaatctgaccgtcaattcaaaggaggttaacatcgtgaccgtagatcaaattgatctatttccgcaaatcaggccgagaataacctcagatcagatcaacctatccgcatatctggccataaccagaaagagcgtggcaccactgacgcgttgacccggcgggcgggatgcaatgcaagcgtgttcacacggcgatccatcgatcgatctggggaagcacgcgctccagcggcggcggtcatgcatggcaatccatcgtgtatgcagcggcctcaacacgtcatcctccagccctctagccaatttcgtttcctggtgagatcatccgcttgtggttgtggatccgtacgctgctgcaatctagcctgtggatgggttttactgacggctgctaatgcatggcgtgcatgcctttttgcagttcatgccctgctcgcagaagtggaggagatcaacttttacagtggtcatcgagcaccagccaccaggtactttaatatatctaacgaactctttcacgtctatctgcttcacatttatcgtcctgcatgcatgcatacgactatatacacaaattgacaaatccttctcatacatgtatcattgaattcgtcaacaaaaagctggcgaaggtaaggcgcccccagtcaaataaccaagattggtttctaaattggttgttttgttgttcgtccaaaactcatctgcgtatgcttgcacctaataaaagtaagatctatatatcatcggcacatacagttattatagttattatgcttacacacattcttaatccatagtttttgttttaaaacaatgaatcataagtgttttgtttttccacctattaaatgagttgttttatagataatttcgacagccaaacccccataatttacttaaagaagattgaacattaatatatcataatttgttagcagataaacatatattgatccacattttttcttaaaacaaactagcatataatgattaactttccgtgccctgtctctgtaaacccgtatgcactgtatgtactctacaatatgcatattattgatttatgccattcaattttgatccctgaattatttttttcatcacaagtaatacctatatcgctaataaatatttcccattctttgtccaaatacatttctttgaatgattacatgattatgttcacggatatatataatttaccagcctattccatagttgtttttatttatcaaagttaaagtgtaacacaatggtaagtcttatggttattcacattgagaaggaatcaaggaaagtcaagagaagagcaattagactttaggagtcataatctaatcatgtaatcaacaatgtatgcatagataaaagtgattccaggtcctttttagagattaaagataaatgaaaaagactgtgatggccatcattaaataaggtatagttggatttaagattgggtgaaaattaaataagtgatccgatggggaaaataacaatataaaattccttatatttgtggataaattatgagccccaaaatccgttatgttggtggatagagagagtacttattagcctcgatgtcatacttatgaagaggctattagtataaatactttttcacgtacagatagtgttcatatttacatgtcttcccacttattttatttgttgcatgacaccatgatatatgccaataaagaaattctgggtccattaataagagatggttaagtgcacttaataagaagatgcttcattaacttcatgttgacctcaccctttttcttatccagatatcatattctcttagcatctctcatagctaggactgattgaagaaacacaacaaagtcgtggaatgagaaatatcaatgacattatgctccaaatcatgtaagtttaattaatatcatttaatccacataagtataaagtattggcagcagtttatctgaaatttcagcatgtgcatagttgaaacaatgcaaatcacactatatttggagtgacgagaaggggaaattggaaaataatttttaattcactagaaagtgtattgtttcatctaattactgacaggaataaacatatgtagagcatactatcatgatcgctaaatattaaattacaataaataaaatataattagtaatatttaatttttagttcatttggatgtttagcatcttctttgtcaaaagattcatcatcatgaaaatgtacaacacgttgttgtataattattatttttaatatttatactaaaatattttatttcaattatatttattaattaacacattactacagaaggttacaacttagatgcgattcttaccttttgattacaatatcaaaataatacaccattcaaaatacttaaattttaaaaattaagaatggtgcaatgaattctatgattaaaaaaattaattcacgcaggaaacaaattataaatgtaaaataattaaccaattaaaattttatatgattaaaattattatataaaattccccgtgcaacgcacgagttgacatctaaaataaatgtattttaataattatattgtatcaaatgtgtgaaagaataaaataagttataatactgcagaacagatgtcacaaaataggagagcactgcatgaaattactcaatttatatacgaatctaaaaacgaggtatttatgagtttctttctttctgctgtgcttgtaagtctgatatacgaatctgtgagagaggtcgaattgattaaggtactaatgtatgtactgatatactgacagagtcatataagtcttcttatgttgctacaaatatatgttccattccatttctttcataattatttaccttgagattgattggattggtacactaatgataataaattcaattaattaatgttcattgatcgcactacataaatatacaatgaattcactaattaaaaaaataattcatatataaattgccacactcggctcccaattttgcatttctttcactcaactcagaaaatcaaaccaaaaatcatgatgttgcaatttccatattgactcttcttttgattaaacccattaaacttttacatgattcacaattagtataatattaccccgtgcaacacacgggttggcggcttgttcaataaatacaggatcacaaaattgaatagatttggaccatgggctttgatggaaacttcatggcctcaagaaaatttcgagcttatttttccttaagtagccatgttgaagctccatgtctgtttcttataactagtccatctcaaaatataaaagtttctgacattttaaagatcaataaagaataaaaagaaattattgtgatgcctctcattaattgagaggtgattgcagtgtgggagggtggttagatataaaattgagtgaaaattaaatgagtagtgattgttgggagaagtagcattttagaagttattatgtttttgtcaaatttcaaatgctataatgtaacaccccaaactgtctgtcgcctatagtagtgggttggtgcaagtacctataagttgcagcagatgtgatttattactatcataaaagttaggtgagtgatagccaggttaacccttttatatgaaacaatgatcataaaaatgtaatatggaatactacgtctatataggctaattcaatgtgtggaaagaactgatgcaaattttaaaggaacggaatgagatgtgtatgtgaatggaattgtgaaatatgtgaataatagatgtgtgaaatatgtgaataatggatgtgtgaattatgcgaatggggatgctggggatgtcgatgtgctgggaatgctggggaatatatatgtttctgtcattttacagcgggtatgactagcagagacctgaggctagcaaaaaacatatttttttttgggggggatactcatcggtgataggctttaacttaaacccgatgggatgacctcatccgtgacgggcttttgttaaagtccgattgagttgagttatctccttgcctcctgcttgctgcgccaattggcaatgggtccaaaataacataatagtttataatcacttctttggacggatatttctcaaagtgcaacgacaaaaattgtagttccccgacttattagcgcgttggtgagacaactcacaaaaaagggtgtcaactgatgcaggcaaaatctgcaattcaatgttcagcgatcgacataaggtcatctagaccggtcaaaatgtcaaggtaatctgtgaggttgcacactcccagtcgagtgaaaccagtaatggtgaggaaaacgaataggaagaggtgagaatgtgcatcgactttactgatgtgaaacaagcatgtctgaaagaaggcacccatggtaaaaaccaatttgccatgtagagaacctctgtggatgaagaaccaagaattgcaatacattttttcccaacttctctcattcctattattttcacaaaactaggaagaagaagaaaacagaatagaacatgagttgtggagttctaccacaatcaagttagtagcacatgggagcagaaagtagtcggcctagttcatatatggggaatatatatataacaatccgttacagtagcaagaaccaagatcattactgctgaatattcagcataggtacaaatcaagggagattgtattgaatcaatagtaataattaacctgtaggggagtaaatcattcgcggacactgaaagattatgaaacttctatcagtgcgttcagatatttttgaacaaagcaaagatggtattatgctctggtagttcgtggatagtctgtagatatcgatgagtaacctgtgggatcacttattaatgtgttctctggagcatcatactttcatataatggctgacgaatcaattcaatagcaactttaaagctttgaatgataattgggctgcgtactattttataaaatgcttaggaacttgtccaatgtctcttggacggtgtagaaaacaaatggataataggttggtcgtatcaatcaatgactatatgggttctgattgtagtgaaatgtattttgctaaaaaatgtggaactagttttgatagaaaacaagtggtcatcacttaactagtttccacaatagtgatcacggaccgaatcttgagtgttatggaattcctcttttaagtgaggaccacttgttttctactccatccgtttcacaatgtaagtcattctagcatttctcacattcatatctattatataagtccatgaaactttctacaaacgctctcataccgccacatggcattctaataaaatagagaaaatcctagaaattctagaaaaaagcaaaacatccaaccgttaatttttatttaaattggtggacccattattttgcactattagatttatctcaataagaaaacaaccaaagccacctatttccagcgttagatacttagattagattgatctgtacacctcgcctatttccgtacacacacctctcctctcttttgctgcccctcccctcctattctctttcctatttctatgcaatcatttttttatcaagaaatcaacggttcgatgagttcaaaataattactatagtttttaatatatttcgtaagcaaacaatcagctcaagaaaatccttcatcgatatatggagcagttctaccgactgctgtatcaatataagcaatgcaagcaacttccatctctttgtttgatctctcaccttacagctggcttatcactttgattccacgtagtagtagtgcagcaaggctatctttgatttcatataaatttcacaaagcttttggaatataaattaattaattttaggcatttgagttatcaggtgcttcaaatggttgtcaaatatgcatgcgtgctccgttctaggcccatgagtacttcatggaaaactcttggcactactagaaaaatgattttttatggcgtttgaaaaatattttttatggcggctacgagaaaaacccgccagcgtaaaaaatcggggggtgggaggtcacgggctgccagcgaaaatcagttctcgctagcggccacattaagagatccgccataaaaaatattatatttttcgaggcggacctcttacgaaaatcggcgttttcgctggcggctgctaaaaagacccgccagcgaaaaacactgtctcgctaaaaaattttgatggcatttaaaacaatgcgcgctagattccttcacccaccacatttaaaaccgatttcatcccacttccactacccacccacccaccacatttcttcccactgccagaccacccacccacctcatctctttgtcctcctccccgacctctctcccttccttgcgcccccactggtgacggcgactggtgacaaggaccacggcgactggtgacgatgaccacggcgaccacaacgacgggccgggccacaggtggcgggagggggtgga

SEQ ID NO: 13355 - DNA, 6477 bp, Oryza sativa
ttcctgcagcccggcaacgacgacgacgatgacgatgggccgggccacgacgacgacgacgatgactacggtgaccacggcgaccggtgacgacgaccatggcaaccacgacgatgggccgggccaggggcggcggatgtgcggtggcgggagggggtggaggggccacgaccggagggcctcctcctcctcctcccctcccctcccctccctctccctctcccagatctagccggaggaagggagcggcggacgcagcggcggcaatggcaggcgggcgacgacgattttaatgtccagtttgatgtttatttgtattactgtttcatatatgcatgtattgatgcttgtttgtggaaaatgaagtgagaaattgatgtagtgttcttttgaggttggatctgatgtggatttgaattgttatggatttgagatttggggatgtggatttgggaatgcaggtagcaacatgtgggcatatttatttttgctggcggctgaagggaagctacataggtttttttttctcaaaatagattatctctggtggccggtataacacaacaaccaacaaaaatcgattatcgctgacggccggtataatacaaccgctagcgaaaatcgattatcgctagcggccgataaccgctagcgaagatcaatattttctctcgcctttgctccgccaaggaaaacctaaaatggccgccacgaaagatgatttccgtagtagtgtggagtcctctttcgagcagatctgattttatctcaaacttccttgtgagtcaccaacaattaaaataataaaatgttgcgccacctatcatgggtctttgggcttataacttagtttaggtccccaggccaaatggagcccaagtaggctgcatcctaacttgctgatgtacgaccttaagggttcctttgctgtcctcccacctcttcacctccttaaatagctagggacctcttcaggttcttgggttttctttagattaacgtttagtcattgttacttttctgggtaaagccatgatcagttagatcatacctttctttttatggaaccctaagccgtgatcccaagtagccttcatggcaaattttcttatttctttcacttcctagctagagattaacatgtcagcaaagaacacatcatatcaattttgaacgagtaattttatggttctttagaatgtaccaggtgggtatagcacattttctagcaactacaaattagactagctagaaatttgattactgatcatgaatattctatttctataaattaagaatggtttttttttcaaatgataaattaagaatggttctagtcagaaactaatattagatagtcttttgttcccagtaactcctcgataaccaaaaaaaaaatcaaacaaaattacataaatatgtacatgtgaataatgtacattgtataccttaattacaattctggtcccacaacttcatcatttatcatactacaatacctgagcagtctagctacagcacagccactactcccaatatatacataccaccatgcatgtatttttcctgaaatactggtacagattacaagttcatttttcatttgcccattttatgctataaaatgtgataagaatgagaagtcccaggaaatcgcaaaatcctcgtgccaacgagccaaaccgggtgcttgatgccgccagctgcatcctactacagctgcatttctaatttttagctgcgcgcctgcgccagcttactagcatccagcttactagaatctgtttctttctttggctgtgtttagattggcccaaagtttaaaatttggttgaaattagagacgatgtgactgaaaaattgtatatatacgaaaggtttgatgtgatggaaagttggaagtttaggaaaaaactttagaactaaacacaccctttcatccttttgcttggcttaggtctagtttgcaggagtaggctggctcgtccttgctctgcgcttgtgctaggattgtaaaaccggatgcgccggtgaacttgctctggctgtcaagccgtgtattcagacatctgttatgccttctataaagttgggcagtgagccttttctctaaaaattatgtttgccaagattttagtgaaaacggaatgtgtattaaggtgttgtttggatccgggactaaattttagtccctgtcacatcagatgtttgtacactaattagaagtattaaacgtagactaatgataaaactcatttcataaccctggactaattcgtgagacgaatctattgagcctaattaatcaatgattagcctatgtgatgctatagtaaacatgtgctaattatggattaattaggcttaaaaaatttatctcatgaattagcttttatttatgcaattagttttattattaggctacgtttaatactttcaattagtgttcaaacatccgatatggcagtggcttaaaatttagtactgtatccaaacgccacctaaaccaagcatgcagatcatgtaatcttgggctggatggatgttaactaaaatacattggtttctacatcaaaaagccatactggtttggaacactgttcttaaatcagaggtcataaaggttcattatatgctttaaaaagacactttaagagagaaactgccggttcgaaaaaagtacaaaatgccataaacagatgtgtttatgtgggaaatcttcaaagatcaaaacatggaaaaactaagaaatgatttaatcagaaaaactaaactaaaatattttggcatataatatatacttaaaaaggaaaaaaaattaatgttttacactactaaactttcatcggagtccaggaaaacggtctttgaacattgaaatcatgcacgtgtaggagttactccctccatattgaaatgtatgacgatgttgatttctcaacatagcattcaaccattcgtgaatgtgaggtaattatatattggggtgtttagattcaggggtgtatagttttaaagtgtcacatcagatattatatagggtatcacatggggtgttcggcactaataaaaaaactaattaaataatccgtcagtaaaccgcgagacaaatttattaaacctaattaatccgtcattagcaaatatttactgtagcaccatattgtcaaatcatggagaaattatacttaaagattcgtctcgcaaattagtcgcaatctgtgcaattagttattttttagcctatatttaatattttatgcagatgttcaaacgttcgatgttggcataaagttttgggatggaatctaaacagggcctgtgccagtattcactgcaatgtattaccacaaacgctgtgaagaagtacaaacatatgaagaagtacatccaatcaatttattcaagctttacaaatgtggctggttcgggctgtcttccagcagtttgatatcacacctaccgaacaactggataaatttcacatctattaacaacatgtcctccattcgcaatttttgtagaaatacttttatcatgttcttcacacacttcagtgccctaacttgattcagttcgtttccaaaaaataggctttacacaccacttgcaacagtttctactaatggattaggttgagactgaaatcccacaatcttttggcgaggcccatgtcgagcgcatgagattttaattcagtgacattgcagtcaacaaagtatttgccagtgactccagcaacctgaggatgcaatgccacatagcacactgtggctgcaccctgcaaaaacaaacaatgctaagcagtgattatgtgtttggatagtttgcacaattgtttgttggtaattggatggtttgcacaattaaacatgttatgaattactgaattagtaaaatttcaaggagactttgtcctggtgccagttagttcatggatttaataacattaactctacaaaaaatagtccctggtagagtcatggtaatattgcagctcctgttttttcaggttgcaggaagatgttgaatgatataagcaataaatacattttttccatatttatatatttattaggttaattattccatgatacatccaattatttaggagcagtcaaaaagttttagaatgtacacttaccactagtactaggattaaagttttagaattattttgtgtgtttctgttgaataaaatgtttcagaaaacatatgtaatgaaatagacataaattgcatacacaataaaatacaaattgaatatacaataaaatagtgaatataactgtcacaagaacatatgtaatgaaattgacataaattgcatacgcaataaaatacttaaattgaatatacagtaaaaatagtaaatacaactctgtcactttagtcttgtgaaaggaacagaaaaaaaatgatccaaaacttacttgttcaacacctttaacgaaaaatttaccaagtgtagatagcatacctgaaattaaaaaacaaggaagaacaatcactgtgcattgtttccagttcattattcattcaaataataaagcacaaatgtggggcttttacaatttgcactggacaaccatagtgatcttcgatgaatgaaatatttctttaataaggtaatgctctcaagaattttttgtatatggaatgatcatgcactttaatgaacaaaaaagttctggaaaaactctttatacaactggaagagaagtaaatcagattaataggctagaaagaagatgtatccatgcaattaagataatagtgatggcaactgaagcctaaacttatgtgactacatagaagaaatggatgtctcatagctgtactatagatgaatatgagcacaacgaagcaaaaactcaactagccagaaagataaaagcaaatactgtctgagattcgatgaaccatccatgaagattgatttagctttattttgccaagaactatatgcatttgtcagatatgcccataccatttacgaaataccagtgacgcataatgttggtgacaacagctccaggatgcagagagttgactgttacttttgcatcttgctccttttagcagacaaacattcatcatcaagaaaatatgtgaaactttttgaaatagtaatgcgatcattgatatcatctattcacagaacagctccataacaaaaataacagggctttgacatccatcctctgcatagctttgctattatgagatctattttgtgataacttcatattactgtctcagccaaagatctacatgatttagttaacagcatgtctaacatattacagttagtaatttcaagaaaaatagcctactacaatttcttttccattttacaagattacaaaattgtgtaattttgaggacaaacagtgtgtacaattaaataaacaagagttagtgtgaaccaccagttgttccaaatacgagcttaaaggaaaacaagaagaaaagtggaaccttcagattgctagatagtaaattggaatgcagtatgttggcaagcttggattggccgtaagcgaagattttgttatacctagcgggagagaataaaaataattaatttcgaatatgatgtttttgtgcagatctgttttcttacctttgatcgattgaaaaggtaaacaaatgtaaaaaggagtatacgttgggtcagaaagtaatacccagattcatcattgatcttatcaaaacgaatcccctctcgataagggtgcttgtagctgttagaagcaactatcacaacccttccttctatcccactttctatagctgtaactttcatcttctcaagtaaaagatcggtcagtagaaaatgccctgcattgcatgattaattgcacgatgcagttacacaataataacagaaattttgcacgtttgtaaccaaacatggttacaagatcagtcaagtgaaatatgaccacacacaaatgtgtaaagtacatctgtcttagtaacaaatagaaaataaaacaataatattctatgaattttggcaaaacctacttaaaataaaaaagttttagtatgcagtttaagggactgtaagagggggcctaccaaggtgatttgttgaaaaatgcagctcaatgccctcctctgatagcttaaatggtacaaacgcaatccctgcattattactttaaacagagaagactaaaactattttctcaaacataaaatggatgacgtattcctcgccaaaaaaaggcaatgtaaaaaaagaacacttcaacatagatggaataaaagttttttagtagaggtctgatggactgttttatcttccagaaaatgactgtactaatgacataacccagtaatacataaatactgtctattaagcatgctttgagtgtctgaatcccaatagccagctcaaatgctcattccagtttatttagcacccaaattctctatgttgcagaaggttttgctgctacaataatt

SEQ ID NO: 13356 - DNA, 5024 bp, Oryza sativa
aaacatctccaatcagcaactattccaccagcatttcaggccttcagtacaaaattcgattaacgaagcaggaattggagcaatatgcaagatttactcctactgcttgcatcagcctgaagagtaaatattggggaaaaattgattaatggttggtaaaactataaatacatttagcatataaatcatctttcataatttccccccagatttatctactgcaatatgcaagatttttatacaccgaacagtaaactttgccaatttcccctcaaatcgaagagaatcactaaattcctcgagcaatttcagttcagaccaacgattcttggattcgagcagggaatgttcagaagaaacaggagtcaaccgagaaccaggggacgctatgaagtatgaaccgaaccaagaaacgaccagctgctggaggagagatgagagtacagttcacttgccggttacgacggcgacgaggccggaaccgtcgacggcggcggtgacctcctccgcggtggacgacggcgagaacccggaggggcttcgccgcctcagtaggccccacattgtcttgtgctgccgtgggaagtgggaacagcttccggccggtggcttaaattaagacactcaacttgcttaaatagaacgtttcagcttccaatcaaacgtataatactcctgttttgtaagacgtttcaattttaaatggttcaactccatagaagttgacgaatggctattggtcaatttgtaaactcatttgctccctccgtttcatataataagtcactttgattttttaaaaaagttagaagtttaaccaaatttacggaaaaaataacaaaacttataatgtaagttagttttattaaatttatcattaaatatatgttgataggttgtgttgaaaatattgctaaacttttctataaatttagtcaaacctacaatagttcgacgtaaaataaaatcaaaacgacttataagagatggtagcatatcaagacggtccaatagggttccattatgtagcaaattttatagcaatccaacttttgctactaaacacacatactgccccttctgtgcattaacccttttattagtatggtaaattttgccaaaaatattgtgacttcgtgattttaaccttaggacatcatacgatgagttttagagaagacactctataaatacgataatttactcgtgtacaccacgctgattattttagtgtattcttagataccatctattttaatcggtgaggtcattaatccatttcttttctcttcctcctccttcccgaagaaacaatcagcctctcaagctagttctcccctccaatttcaccgagccaccgctaaagtcatttgcccatccgccatcgtcagcccgctccagaagcaccatcttgccaccaaggccagcattggagactgcaaaccctctttctctctcctcaaacgcaaacgtgttctaatcgttatcattctccttgttgttgccatcctccgtaacctgtagatgagtcacgttgtgggatatgtagtcctgccgccatcctcgttgtcgtttcacggtcaacacgttgaggcccgcgctcactgtgctcgtgttgtatcaagctgaggaagaacattgccggatatgccaagggcaattctgcctcatcatgtacaattgtgggccctctcacgcgttgtcagatcgaatacattaaaaaaaatggcatgatatccatgggctaattaccacgtttatagattgtcatgatttcctgtagcaaatattacctattagtatgtgctcccttcgtcccataaaaacctaatgttgagaatgagtttaaacctaattttttcctggaaaccaaagttggtcaggaacttattttcctgtatctgttctcttccagcaattatttcagctttacatttatcatttctgtacagccagtgctccattcacaatttatctttggagatactttattttttctaactagttttggtttatttcccatagtagactttacatagctattgcgacaacaatttctatcaacggatttggctgagactgaaatcccacaatcttttggcgaggtccatgtcgagcgcatgagatttcagttcagtgatattgcagtcagaaaagtatttgccagtgactccagcaacctgaggatgcaatgccacatagcacactgtggctgcaccctgcaaaaacaaacaaggataagcattgaatgtatgagtatgagtggttttgagcaattaacagaaaaaggttatgaattagtaaatttttcaaggagattttgccacttcataagtttaatataacaccaactctacaaaaagtggtgtctgagtctcctcaattctctaagtcctgtctactctcccttctccctcatcccactcctatcctccgagtggcagcgacgagaggcgaaggcaggggcggatccagaaaatagagtcattgggatcattactgaaatatggtggtgtcaatatatatatataagagagtaattcttgtttctagagtgcattagcaaagagattagtaagaagtcattggtgtccgctgacaccaatgcttacactatggatccaccactgggcgaaggcacagctggtttctagcagcggcgatggttgcttcgggctgcggatcgatgatgacaatggttgcttcgggtggtggaggtgtgtcaagcttcaagtgatcgtgacgacggaatcaatggcggtggccgcgtacaggagcggcggatccggcatcaaggatcttggctacggcggatcaggcgctagcgagctcggcgatggtgggtgtggtggtaggtgatgaggacatcactagcttagatatggtcatggctaccttaaatatttatcaagcaaaggtacatgctttctatgtaagatttacatgtcatatatttgaacaaacactattatactatgagtcttgcatgtgctcgtttgtagaggaacttgcttgggtgaaggaaaggggagcggacatacggagtgattgaatgatctatgaagttaattggggactaaccaatatccttcccaaagtttatccccatgttaccacgtcacttttagttcatagaagggaatagatgaaattctacatgttttagattcagattcgggcctcctgacagcatcaacttcaaacggatccaagccaagggggtatgcgccctatagattccgtttgaagttgatgctgtcaagaggcccgacttaggttagagacgtcctagggatagtcctagggcgcacaccccttatgacgtctctaatcatatttacagagattccttctataagttgtgggctaagcccaagggggtgtgtgccctaagactaaccctaggacatcttcagtcatatttgttcaatagttgtcatagtttagagttggattttgcttaaattatttctgccattgaagtttcgccgctagtttggtttgtgaaaccccaactttaaaatcttaatcattcatctacatattaagttgcaatctaccttgttcttgcttatgttcttcgattcgtatgcagggattagccttctcggcgaggtcaatcgggttttcgacaggattgataacaagaggaagtgtggtgctgcgattgcagggttcggatcatgttaattggtttgtcgtttgtaaaatcatttatgtagtgcaataaaaatgttggcaaaaaaatatgtgttacctatcaagtaaacacatggacttagattgcatataaaatacatataatgcatataacataaaacagaactctgttacttttatcttgtgaaaggaacaaagaatgttctaaaacttacttgttcaacacctttaacaaaatatttaccaatagcacggatagcacctgaaataataaaaaagaaggaagaggaagaatataactttctatctgcagtagaaaaaaaatgcatttcattctctcaaactatttcattggagcagttaaccctgaactagtagaaacagtgcaccatacggtatttctcttttttctctctatgtaaatcgtattttgcgccaaaaaaatggtagtgttgatagatgaagtataacctacctctccatttttttctgaaatttttaatcactgctgtttacagagattggaagcagtaagttgacttaaacatcgaagtcttaaattttaagcaaattgtcatattttttaaaaactttgttaatggtgtcatgtatggcttaaaaaattttaacttacaataagacttgcgtaaagaaaaacaaataagggagatgctattgaggattaaagtgaaccaaattagccaaaaaatagttcaggggttagcaatctaatggaagagtttgggagtagtaaaattccagcccttgaaaccaatatgtagaaggaaaatgtcatgaagctataagacctagattagttgctagttaggcacgatacatcaaactaaacattctacgaggtgagattcgaccaatcattcatgagtattgaacttgctttatttttccagtaataacttgcactcgtgagatatattcttaccatataggggacaccagtggtgcaaaatgttggtggcgacagctccaggatgaagagagttcactattacttttgcatcttgttcctttcagcagagaaatatttatcatcaaggaaatctgtgaagcttttagaaatagtaatgcgatcactgatatcatgtacttagaacagctccataaacacaaataacagggcaattgacttccatcctctgttggtgttttaccactaggaggtttatttttatgataacttcgtattattaattcagctaaagagccgcatgattttgttaacaacagaatagtttaacatagtactaccatttttttataagattacagaacaggcaaacgatgtgtggaacaaaaaaaaattaactagagttagtgtgaatcaacaggtgttcccaaagtaa

SEQ ID NO: 13357 - DNA, 10747 bp, Oryza sativa
tatcacaacccttctttctttgccactttctatagctgtaactttcatcttctcgattaaaagatcagtcagtagaaaatgccctgcatggcattattaactcaagaatgcaatcatacaacaaaagcagatgttttccacataagtaaccaaaaatgggtgtaagatgagtagtccagccaaataggcaaatatgatgaggtacaagtgaaattatgtaaagtatgtactgttttggtaaacatgcaagtccatggattgaaataaactgaaactctaatattctacagtataaatttagtttcatgttttagcaaaaccttcttgcgatcaaaagtttcagtttggagtttaaggactgtaaaagtggatcataccgatgtgattcgttgcaaaatgcagctcaatgtcatcctctgaaagcttgaagggcacaaaacaaacccctgcattatttctttaaacagagcagaataaaattgtttagtcaaagatagggcaatatgtaaaaagataaagataaaacatattcagtagagatggaatagagttttttagtggaggtttcaaagtcacttttaccttccagttatactgtcctaatgctcaacctagctaaacatcaatattgacaattaatcttgcttacagagtattttaatattattcaatatctcaaactctcaatagccagatcgattgctcaatccagtttgttcggcaccaaaatccctacattgcagattatgttgttgcaattatagttctgtaaaatgcgcaatgtttctttctaccaaaacatgccaatgtagccaatttagtactattccctccgtttcataatataaaactttctagcattatccacattcatatagttgttaatgaatttaggcacatatatatgtttagattcattaacatctatatgaatgtgggcaatggtagaatgacttatattatgaaacggaggaagtacatccaaacatagatttgcttacatcaaaatgttcaaaggaaggttcaaagctttgaaaatctctgcaaatctcctcacggatgacatcgagctaaggtcaagattaagaatctccatctttgcagacggaacttgtttcaatatctcatccctcacgcgtgcaccggcagataaattcctaacccccataacaacatacacaccccgcatcaccaggactcggcatgtttcagccccaatcccactggaggcacctgcaagaaacatatccatcagcaatgatgccaacagtaattcaggtctgcaatacaatttgattaggattttttttatggcgcattaaattactgtgcatcatccatcacccattgaccaaagggattaatgttgcatttacatcatggatggtaaaatatcatatatttttttactatttaaattctaccaaaggcaattattgtagtccaaattttccttaactaatttgacattcaggtttctaatactataaaaatacaaaaatcatgttccaaattgaataaaaatttccatagcggaaaaattgaacatggaaggttcggtttataacaaaagttaaaataaattacttttaattgtatatagttccggaatagttgtttgatttttatcaaaattcagatgattatgcaaagcgatactcttaaatcttcataatcaatctctagaaaaatttcagtgcccaaattatattttgaacaacaaagctttggtttataacgaaactttgatttaaatattttttttgcttttttttcaaattaggatgattatgtaaagacatatatagctttaaatcttcaaaataaatcctttaaaaagtccaaaccaaatggtgaaaatctggaatgaaaattttcaaatccgcataattcaaattcgacactagaatattaatgctaagattgactagaaaaaaaatccatttgaatggatatcaaaattctagtatttataatctgaatcatattttaattttatgtctcctatttggaatcaacgatttttaagtcattcatttatctcttttgtaaagtataatatttgttttgcacattcattctgtgcattagaattccttgcaaccactattaaaattctctgatggttaaattttggaaaatattctatgggtactaacgttttccttttgttatgtattttattaaattaggatgtgaaaatatatttgttaatagataaaggaaataaaaagtaacggctaagatttctttatactgtatcagtcccaaaatcagcatgcatgaagagcaaataaaaccaagtgtctctgattaatagaaaataaatattggtgaaacagaagataatatattttctaaaaaaacacggtataaacgaaggcgcttacaacacatacatttacccttgaaaactcacacactatctttatgagcatctctgggagacttggtcatcatatcttgagattgacgaagtcaccacgggaatcccgttatcgatggatacgtcgcttaccactgaagaacagatagccgtaaatctgagcatgcatatcaagtttaggacatgaacccgagtgggctagttccaccacaagtaacctaattaaggtacgatcacctcgcaataggtaacaaatatcgaatgaatggaatttctttaatttatagagcaagagcaggtaagataatagaagtagcaattatcacaagctagaaataaatttattttggaacggaggaagtggctcgattgattagttaaggacgacctggagcaatacacaatatattcactaatagatgaattagttagcatgctccaatagattgattagttaaggaccactttgcatgctctaatagatgaatcacttggagaaatacactaatagattgattagttaaggaccactttgcaagctgatgaattacttagctaccaaaccaaaaaaacagaaattctacgagcaaagccatgtttcagaggagtcaatcaaccaagaatcaggggatgagagtacagttgaggcttaccggtgatgagggcgacgaggcccgagccgtcgatgccggcggtgacctcctcggcggtggacgacgacgagaacccggaggagctgctccgcctcagcaggccccacatggcgtgcggtctttgagtttttcgccggcgtttaatagttttggtgccggaagtcatgaagaagaggcctttcagctaccaatctcaacacaccgctcctgctcatctacgatttttataagccacatattttaatttctaattatatactccctctgtcccaaaaagaatcaacattgttctagcttgattctttttgagaaatgttgattctttttgggacggagaaagtaggtgtaaggttagtagtaatataaatgcatttattataccaaaatacactggtgacttggactgcggtgtcacttaggttcatcaacttataaatcgcaagtcaaggtccacgatcttgttcaatgtaccaactgtggtccaaactacctttaatcaaaggtactgccgtggttgtcaacggagaaaaacattttgcattcagtccacaccataaataaccgtggcaacaaatttgtatttagccccttttgtatgcctaaatcgattccaccaattcggttccccgcctccctgaagtagggagtaatgattagagcagtggtgattattgatagtcgaaggttctcggatcaaaaaagagtaggagagggtgatctcatgagtccagtacggacctcatcttcgtgaagaagataccacaccacaacagttgtgccaccttcctctctctagtacaccctactctcgtcgcactttgtgccaccctagccattgccgctttccccttcctaattcaaaagaggagaagagagaggaaaactttgggttgaggatgaacttgaagcgaatggattaaatgcatatttgtttctacagtaggttttgaacaggggtaaatagaaaaggcttgacctattaaaggtgatttcaacctcgagtcgtatattaaactaaaattacagatctagatatatgatttacaagttgatcgattacattagtgacacagcggtcttaaattggccatgtcttttactctaagttttaatgaacttagcgtttgctaagaaaacaagtaaaagaatctataatattcttcaaaaatcaatttttcaaatttataatcatcttttgtttcgaagtggaagctttactatataggcaccaaataaaaggaacacatgatctctactaagatggagattggtccctccacccaccgctcacatcactccatcgtaaaaccgtataacttttatttaagcatcgataatcatttaagcacaatgtcagcgccagtcccgttggcgctgacacggccaacctcagcgccaatgcgcttggtgctgagctgacggcctaattttggttgaagtttttggcaggggttagtttcgaaataagtttttgaaaagggtcaatttgtccttgtatagctagcatttataatatatgtaaggacatattatgcgtgataggaaaatactttcatgaactcagcgcgtatcaattcctgattggacaagattaggagcttaagcatgtagttggaagataaattaattaatgatggttcgttggaacttggaaggtggagtagtcaagaaaaatgtttacatttgtgtaggaattttaaaccgtttttttgacaaattgacccttttggaaaacttatttcgaaactaaccactgccaaaaacttcaaccaaaaataggccgtcgcctcagcgccaaacacattggcgctgacgttggctgtgtcagcgccaacgggactggcgctgacattgtgccaccgtggcggccgggccgatccccagctgacgtggcagctacctcagcgccaaccggactggcgctgaggtgggacttggccgcaacccccaaggcccagaccagcaagcctgctggttcgcttgcgggctgggacctcagcgccagccataatggcgctgaccgtgggacactcagcgccaaccggactggcgctgaggtgggacttggccgcaacccccaaggcccagaccagcaagccttctggatggcttgcgggctgggacctcagcgccagccataatggcgctgaccgtgggacactcagcgccagcccacctggcgctgaggtgggacttggccgcaacccccaaggcccagaccagcaagcctgctggttcgcttgcgggctgggacctcagcgccaggtgcactggcactgagtttagacatgtcagcgccatttagcatggggttgaagtcccagccctgctaaactttagcaaaactttgcacacaacacaggcaaacatcaaatcgcagaaatttacaggcagtaatatatccagagaaccatacaaaacatacatccatccatcaatcccaacatcattccatacatccatagaatccatcaatacatccatatatgaagtccatacatataagaaataaaaacatcccatcgatcctcgtctatacatccagtcgagtccatacatccagtccatacatccatcgaaccatgcatcaagtccatccatctatccatccatccattgaaccatgcacttacctcctcctacctctagtgcgaggacgaggcacgtcgagggtgtacctccagtcctgcgaaggagcccgccggcgtcgtggtcgagacgggccgggctgcgagatatccggctgtgacgactctggtgcgtcctctagctgcgagggaccgagctcatccgcctcctcttctctgtcctcatccccttcttcctcctcatctccttcctccgcctctttgtcttgctcgccctcctcgtcacccacctccccttcttcatccccctcttggtgggcatgagcatgttcgaccatatcagtcgacctgcagccgagccttgctgccaacttccgacatcgctgccgtagtctctgcataaaaaataatccatgttaagttatcgcttttggaagaaaacaccgtagtttcatctctttccaacgattacctgtagggcgttgcggagggtgccgccctctccttcggagccaggagccgtgcctagcgccactcccgcgtcgttgacggtccgcaagagctctcgagcctgtaggattgaaatgaagtaagtcacaacatatatggcattgaaatgaaataatatacaacattaatgctagaaactaaccactctgtcgcgaacaggtcccgtctcgaccgtggtacctagacgggtacgagtatcgtactcgttctgctcctcaacatcctcggggtcatccgctatgtcggctagtgtcaagccggacgtaggacaagacggtaggtcctgtggagccacgccaagtacaagtcgaactccgtcccgttgtgctgaccctggtctggtactccattctcctcgaacttctcccattgcgtgatatgatcctgatggtagtaagcccaatcagtcaccttcttattcttccgaaggtccaccctgcacgtatgcaaaatgtccaactcaaatatgtagtaaatgttgaagtgactgattgggcaagcaaaataaattgttaagtgaaattactaacttgtgtaggtcgatactcgtggagaaacggtgcgggattgtttgaagcctcccgaattgccgcatcacgcggtggcacatctggaactccactgcatagaagcagatcagtgggcaccgtagggtcttcaacgcatcctctatatggcacatgggattcagttctagctcaagcacttcctgtgcctgatatggcatccacaccacctgcagcaacaaaaataaaacacattgaagcgaccaggctagggcagccgacccccagctgaaggtacccgcctcgtcccagtccgcgagcaacggcagccacatccaagaagccatgtctccaccagagtcagggaacagaatactgccgaagatgtacagcacgtacgccctgcagtatcgctgtactgtagcctcgtctgcctcagcgggacactgaccgaagttggctcgcaaccaactcaaaggaacccctgatgtcttcgtctgcctctgaccatcaggtgccactggaggctccagaccaaggtactcctcgaccctctccctccagttccccgacgctgtgtcacctgtaaccggaaattaaatggaatcattagtaattgcaaaaaaattaacaaatgaatacgaagactcgttagtaattccctgacgctgtgtcacctgtgaccgcctgaccccggataggaagacccaggatcatggcgacgtcctccagagtgaccgtcagctccccgcacggtaggtggaaggtgtgtgtctctggacgccaccggtccactagggccgtcagagcagcggcgttgtacagaggcaccggtcgctgcgccatggtcacgaacgccaagagcttcgcccgccgtaggtacgggacgtaccggtcgtcgaacagtatgtgctaacaacatgtctaatttttccaataaataagtacattactcaaatactacacattattgataaaaaaaaactctactcctacaaattacctacccttcaccacacatcaacccctttcaaaccctctcaatcaccacaaatccatcccacatcctaggccatcaccacacatccatctcccatcaaaccctagtgcatcaccaaacatccatcccaaatatattttgtcaaatgtatcaataacaaccaaatggataaagatatgccacctccacacttcatccccacccatattatccatctaataatccatccttagccaactattatcaaaccacgtctacaactaaaacaatgcaaaatatccaataaaactttggggaacttagggtttatagaggggtttaccttctcttccgatcccaaactcaatgccgcacaaatcaccttcgattagagaggtttttgggggagattggacgaggagaacgtggtggcgaccgaaccctaggcgggcggctggggaaaaaacggaggaagaactggctggggcggcctcggccgggctctaagtagccaaggtcagcgccaacttacttggcgctgaggttgggcacctcagcgccgaagcggttggcgctgaggtagctgccacgtcagctaggggatcggcccggccgccacggtggcacaatgtcagcgccagtcccgttggcgctgacacggccaacctcagcgccaatgcgcttggcgctgagccgacggcctaattttggttgaagtttttggcaggggttagtttcgaaataagtttttgaaaagggtcaatttgtccttgtatagctagcatttataatatatgtaaggacatattatgcgtgataggaaaatactttcatgaactcagcgcgtatcaattcctgattggacaagattaggagcttaagcatgtagttggaagataaattaattaatgatggttcgttggaacttggaaggtggagtagtcaagaaaaatgtttacatttgtgtaggaattttaaacgccacgaatacaaataaatgttgatggagggagcattgactttccatttttaagtaagagatgtcatttttatgtttataaggatgtcacataaacaataagatatttaaataataattgaaatagcttgtacgtagttttattttttttcataggtaaacatgcaagcacaaacaatattgaaacagtgtatacatagttttgactaaataaaacatatttcaccccctcactttattaatttctggtcacatcgttaaaaattcacataatgataataccattagaagtgatcgtcttaaatggaaaaaacacgtatttgtgacaggatgaagcagctataaataaatgcaccagatgctcctttctatgtttaatcaaattatgaacagtgtttcaaaaaaaaattatgaacacagtatatgtatatcccacttgtttactccacaatagttgattttttacagggacatggacagttggacacatgtgggacaacaatgctttgaaagttgatagggaagttcgaactaactctggtcatcccaagcagtaaatggtgcaccctatctatctatcgacagactaatagttccatgccatttgctcaataattacatatgctatttttttcgttaagtacttatacgtgcattacttttctgtgattaagtgtaagtttcaatttgaggaattaaataacttttctatgtaagtataaaatttgttttgattacaccaacacaaacacatactactactacgcacgtacaccaccaccaagacgtgatggtaggtgaattgtaggatcttaccatgtagtaaaaaccacacacgcttatagaagcaaaaacaacaaatccatcttccaatatttaagcgtaactgttctaaaaatacaaatatgtaccagtgttcaaacaaatattgtgttaaaccatgaagcaaacaatttttaaaaagtaaaaatatagagcaaactcataaatgatacatgtccatcgctagtttgtttgcttctgcacctatcacacacctaccaatttactcctctgtaagtgtgtgataggctatgtcgatgtgccacagaggtgttctcagccaggggtgggcctaccatgattcatgggtattcagctgaatatccaagattttagattaaaaaatttcatatatgtaatatatatttcatatgtatgtggaaaagtatgcaaaatagacttgttccttcagagaaagcctaacttagcaccatcccacctccctcctctactcggcccattggcccaataacacaaatcaacccaaaatggatgtaacccttacctctccagctctccttcccaatctcctccttggcatggcaccctggccccctccccgaccccgacacgatggcacatcacctcccacccacccccttcctcaacggcggcagcgcccagccagctgcgacgcagcagcggctgctaatctcacgccacgcgtccgtgcccctaggccggccgccacgaaggcgccattgcccacacgccgccgcccctgccctgtggctcccaggtggtgggccagccggtgcccgcactctgccgcccgtacctccaccctccaccagtccacctccagtccctgaaccgccttagacttagacagccagacccacacgacggtggaaggttagaaacattttggtaatttggttggattaggattttagtatttagttcatagttgaatccaagatggttcatttgatttaggatttaggatatctttgaatctaggaatggttcactgttgaacattttttatttaggatttgaatccagtcattcagggatggttcatgattgaacaatcaaactttgaaacttgtgattcactgattttgtgaagctttgtagcagagttagtacttataaattgcatcagtgcacatattcagcagagttagcatagttagtacttaaattggaagaccatattgttgttttataggtttgaaacgtgaataggaaaaatgctcccacggttaatttaaaggcttttttagaaacagctgttgcaaataagagaactcaaaaacaagttaagaagcaagatgggataagaatatttgaatgattgtttgattacattcgttga

SEQ ID NO: 13358 - DNA, 1942 bp, Oryza sativa
ttgaaaatcctaggcccgcccctgttctcagctggtactttacaaagcttgcagagttgaagtcttgtctgtggctttggctaggttattgcaggagatttgaagggctttgtggtggtggtgactaactcgtgtagggttacgatttatttttgttcagtaaattgtatttttttatggttttaagttttaatgcaaatctggcggaaatgtctttttcaactagaaaaaaccatcacattttgctattaaatcttcatatgttcacttaatccgttccaatttactatgttgttctggagaaacctcacccaattgccaatctaaaatccatgctagcaagggtgctgatgtattcatatgtgattcttgactacaattcagtcagaacaattctaaacccgcaatgtatttaaaaattcacgatagtttgtaacacaatgacaattggctcaacaaaaaaaaatcatggcatttggcatatgtttacatgtaaacccatatgcattataccgttggtttatatcagtttacatcagctataataataaacaagtttttattatgttgaggtgaaagagagggtgtgttaagagagagaaacgtaggcgcttgtttggccagcgctagcacaagctctcctatccgtgccatgggatctactaagagcacccacttggtaaagtaagatgctctctataaaacatgtacatctcagcaatagagtaaaccacctcaatagtatgtctaatagtatgtctatatggatatctatagctctctaatgcattgcctcgtttttctctataggttatctctaggttagtagatagctttactcaccctcttcatttaatctcttccaagtagaaaaatatgctgacatggatctcttgtagagagcctatagataatcattacgggtgccctaatgcctaacctatgggtgaccaacaagatgaaggtttgttgagtaatgaagtcgcatatttgattaaaatataattttgatatttgtataaaggtataacaatagccactagccagctattgtacatatctcctttttacgtggctgtgccgatggcgatgcggactttttaagtagcaaccaaccatactattaaactacttgctctaatttgcaaccattaagttgagttctgataagtaaatgcggtctgaaaaggatgaggagaggattagcagttattcagaactgcagagacgtcccttgacattagcactatcccaattgctgacaggaatcgtgatctggagctgaatttcaccgataggttttatgttcttggtcgttttgtgtggccatcgcctgagcatatcattgttgggcattttcggttggtaactttttctctcctttctttctttgatgatatatggagttgtttgtttcaattcagtttagttcattattttgaaataagattataagggatacactaatgtccaaatttagtccctgactggaagtgaggaattatcctatacatgtggggaatgatcatatcctccgtaaaatttctaggaaatttcaatgttataaatggggccttgatgttatctttacactacttttatactatctctctccgttccaaaaacgactttatttcgagctatacacgactttgtaaccagcctgatgccctcaactcaccaagcatattgtttgtcaaacaggtaaaggaaaaatggtcctgaaggtctgcaccggatgacaccccataatccaacctgactagttccatttattccagccaaaattgcatatcacaagcatataatctctacattgcatatcctatccagataatcttagtattgaatatccatatactccctccgtacaaaaatataaggaatttcaataaatgagatacattctactactacaaatctgaacatgggctgcaggaat

SEQ ID NO: 13359 - DNA, 2336 bp, Oryza sativa
cttattatttgcaacaggtaggagtagccaactataatcagaagtacttgcctcaagcatagctctggttagtctttatctctaattctctattactgtccaagaagtgctgttggtttcctgagcaaccactacatgacatgaatgtcgacaaactaaacaccctacattcaaatgaaaaaaaaaaagacataaccagctccaatcttatgagaacttgattgtaaactcttatggttagatcatgtgtccaaacaattgaagactatatgttcacagacgcttgttaataagatgccaaatcaccccatgactcccgacgcgctggcctgttttccttcactggagaaagcgtccaaattatttgtgatatgatgacaaggtctcagaaattgcccaaagaatgaacccactgtacacattctagcggcgtcgatgtgagcaaaacaagttgagaagttttatgaaggagcatctcctatgcgtattcttacgggtagcggtctagcaatcagaccatccatcacccagccaccatttgaaccatcaagtttgacatggctaaattctctttgagtataatcgagtgatgcttcaagccttccaccaggtctacacgctgaggcaacatcacttggtttgatgcccagatatttctccaaccaatagagatagttaacatggaataaagatttgagcatatcttcaggagaagatccctctttaaggatgacctgtaaatcaaagggtaaaatgtcagtaactttgtatgatagcagaatggcatcttgaaactgcttggttcaagataaactcacacaaaattttcccttgtattctgtaagaaggtattgttcgtttttgtagagatcaaacaatgcgcatgcatcttccttgttctcaattatttcactaagtttagaacccaactgcaaccgccgacaaattatttctgcagcatcttttgcctgtggtgacaaaatcttgctttcctggtacaaaattcaaggaaccacatatagtgggacacataaataagtgcaagaatggcacatattgtgaatttaagatgtattaagttgcagttaactcttgactagttaaagcgtgccttgggaatgggaggctgtaagacctcaacaatatgaaaatatagaggacaaaaagtatcagtgatttgatgttagaaaaatactttacttactttacgtgaagtaccaatagatagattcaggaaaaggggttcctcgtcgttaacctctttgactgaaggaacttgtccactcaatagatactcactgaacaccaaacctgtgagacaggagggcggcagataaattagttaatcttatcgattagtaatgaaaaccaaggaaagacagaataatcccactaaaactggatgattttatgacacaattgctgccttgcgagaggccacttatgcaattaatcctcactaaggctccgtatgccattgaggtgaattctgataatctaagttacaaacggtaatattaatacctactaaaaagttggaagttttgtgggaatgaaagttgcataattgtcttaaccttaaaatgattaataaaataatctacaatgattatatatttacatttctagatgacttagaaaagacacacatttatcacaacacaacaaactgcaaacagaggctaagcctagctgtagtcaatgccatctctcatccacagcaaaccaagacactaaataatctggaaaacacaagtgaccaagatttttcacagattagctccagcaaaatccctctccttgctgtctcatctcacgcggagccacaacatcattaatctgatcgttggatcagtaaagttaaaaccagatatctggcatgactttgctaatgcaaatacccttctttcagtgctgttggattgattcctaattgactgccaatttaatctacagagtagtccattttatattacaatgtatactgtgcaaagctgaccatcaagacctcacgagttttcaatcatccattcaaaaaaattacaattcaaaatatgatttcaaccatcaattctagaaaaacatacacatgttcagtgacaactgccatgcacttacaatggacaattttgcaggctatcattgcaagggagatatcgatatttacccaaaagaatagtgacaaaacgtgatttttttaaaaaaaaaatcgtgtgatgttttgctgagttcaatcagctacagtgcagttttggtatttgtatgtattgttaatatattgatccatccaccagtttatttgtgtttgaacatcaattaaacaacattattcatat

SEQ ID NO: 13360 - DNA, 2751 bp, Oryza sativa
aattcctgcagcccagcaccttgcagttgatgctaacatgcttgtcctcgtgtgaaaactagattggctccttaacaactgttaggctcttagcacacatgctcaatatctcacattaggcaaccaccaccagcatcactgaagcaaacaggcactccctgatttcaggtgtagcatcctcaactggacctcaacagggtgcaccttggtgtcgtgatgctgcccctgccatcacctgcttcacggcttcctcattgatgccacaccatcaccactaaacgatgccactcccattttttctcgcggacggttgggccactggtccaatgataaaatttgtaaaaccttgtccaaagtgccacttcgatgagaaaaaagggtcaaaattgaaacttaacccaaaaaaaaaaaattgacatggtcacaagggcgatgcaattatacctatgtaccgaaccgctgcctgtggggtttataattgtaatgtatatacccaataggaaagaatgaggattcctggtgcaggcaatatagtgaactgtgaaaaggacatcaaacgaagaaaaaaaatggagagcagcaaacaaaggtggtgcatgcatgcaatccaggagcggaagtcatcaattcagcaacaaagacaaacttgctaccaatgctatagtccacacaatgctgtcatagcaaaaggcagagaacaagaccaggaggtaggagtaatttggtccagtgtgagcaaaataaaaagtacagtggcatcttttcagaacattaaaggttcgcaatggtatatattttcttgcgtaaaaatagtatcagcaatatctgatataactgcagcttacccgtaggattggatatagattgcaaggctcatacatgagaaacaaaaattattctaacaatgacatctacatgctaaacgatttgttttcatgaatgaggatagattgattttacctcagcaaagttcctttgcacagcaaatccagcatagaaacaactcctggtggcagcctacagaattgaatcattgcactaatagtggttcaaagaaaaataatgaattggcaagtacaaaatattgttgggaagcaccataaaaatcaattcataggcagtcaggctcaaatttgcagaatagagtaataatttcaaagcattccacaagagtaagcaacatttcaaatcacccataattcggtcataccatctgccacctatccatgccaatttactgatttatccattgcatccagtagaatttcagtgaagaggtatgcaggacatgattagaagcaggatatcttcagttattatgttctttatgtagtgagcaagattcaggagacaaggcaaaaacaggggaagaatcaagaaagccgaacaagcagtacagatctgtcaggaggagataatatattggaaaatatcccaaaaaaactggactaccagaatgatattgcacgttcaattcagtgtatgattaatgccaaaatatgatacctaactacaaatttggatgacacatgtttccatactaagtgtaatctgaacaatgctgaccaaatctgtaggtggaacataatacgaagaaaatgacatgctgcagcagatttcacatgaaacaatatgaccttgcgcatatggtttgcattttccagcatgaaatgggtaaatatggtctgcacaggtgaaggggtacagcaacaatgacaatccatatcaaaatcaacagttctgacctgtatcaaagcagctgctgatcgaccagctccagcggcagccccaattggaacaaacaggtgaggaaagaccggagttaaaatctccagcccataagccgtgttctccagaagatcggcgaacaatcgccacccctttgggttaacatcgaaatgccggccgaatttcgatagcaatatcttgctcaggtaccccaacccatccttcagcacccaattcaccgctgccgcggtaggtatagcgcctttccccaatccaaccgcatacaacaatgcctagacaggataaatacacaaattcaccaatcgaaaatggcacatttcaactaatagccggtgaattgcacacagatggacgcggctcaggcgccacaaccgtacctgcgtcgagagcacgccactgatctggctggcgatgccctgcacgccgcgccacagcgagtactgcaggtagtcgctgctcacgctgtcagggtacccatccgggagcagcagctgaacggcgaccgtggcgcaccgccgccacgacagctccagctggcgccgcagcgcagccagctcggcacggccggcaccggccttctccgcatcctccccctccgcctgcttccgcctcccgtctcccgcgacgacgtaggaggtcccggtcgggtccggcacgagcagcgtgcgcgcaccgcccctcacctcccagacgctcgctccctccctgccgccgctaccgccgatggcctcggcgagcgcggccgggatggcggcgaaggcgcccgagtggaggagcacgaagaggaggaggagctcggggtggagcgactggagccaccgccaccacccgtcgccggggtcaggagggccactccccccttgcctccaccacccacctcctcctcctcctcctccgccaccaccaccgccataacagccaggagaggagatcgcgaggggtggcgggcgggagaggttggcggccaggcgggggaggcggggaccggaggtgggaggaggg

SEQ ID NO: 13361 - DNA, 4445 bp, Oryza sativa
attcctgcagcccgttaggcccggcccattttccgtgaaatgggtatcaatgcggcctgctgaggcagaatcggacggtagtacagtatcatttagcaacttttggactttgagatttacgtggctaggaataagttcattttaggtaccttaactcaacgagttcgattctcaccctcaaaccaaaatagcagatagaacgaatccctcaattattaaaaccggtgtaatatggaattataacggatggttttatccgacgtggcaatttgacatgagtcagcagcactgagtcagcatgaacccacatgtcagaatctcttcacctctctctctccctccctcagtcctatctcacgaagcagagagcagtaagggcctatttggcacagctccaactccagctccacccctcctggagttggagctcagccaaacagtttcaactccaccaaaactgggagtggagctgggtggagctctctcacaaaatgaactagagtagtggagctgggtttaggcagctccacaactccactccagactcaactcctggagctaaatttaggagttggagctgtaccaaacaggccctaagccagtgaagagaagatcggctctagtgtgggcccatgccacctaccggggaacgacggtgacggacctgcggcgcacgtgatgtctagtagaaggaggactcccttggaacgacaaggagaggatccagcgccgactgctctgctctgccgcctacttcggcaacgtagcacgtcagcttggtcgtcttcaccgcagcgccgattgctgcccaaatccccccagtgtcgggatgcctcgcttcagtcatcgtcccacctcatttggggccgatcggcaagcgagtgaactccttcgtcatcacctccgtccaagacaacgactagggcaaaggcgatcgctcgtgataaggatgagggttgggcggccggttctgacaaaggacacctcggtcgctaccgctcccccttttcccagtccaggggcatcctggcctaatcgggtcctcgtgcaaaatattaaaatggggctctagtagcctagtaaattttttatagtaaaactaaaaacgggcgtggcgatcagccgatcatcagcgatgaaatagaagcggatgccggaggagactggggagaggagatgaagaggctgcggcgtcgggatttcgactacacacgacgacgcggacgcctggacgggaatacgatggaaaatggatcggttcaccttctgcagcgttttgggcattgttttactacttcctccgtttcacaatgtaagttattctagcattttctacattcatattgatgataatgaatctagatagatatatatgtctagattcattaccatcaatatgaatatgtgaaatgctagaatgacttacattgtgaaatggagagagtactatttagggcctctttgatttgtaggaaaaatgtaggaattttggaggatttcaatcctatggaaaaaaaaaatcctatgaaggcctttgaaacaaaggattggatcctatccaatcctttgaaattcctaaggaatgggtattcctatgcacattttggaggaaagttagcaagaggtctaacctcttggaacatttcctctgagtctatctctctcatctgattcttgcgtttttcctatggtccaatcaaacggccattcttgtgtttttcctatgttttgcaatcctctgttttacaattgtattcctgtcagaattctgtgtttttcctattcctttgtttttttattcctacgattcaaagactgcaaattaacaaaattaaagcctctaatattattatatatatatgacatacttaatttggggggcctgttcggtcgcacagcccgcacgggcccaaggacacccctgctagtcgcttccacccaggtcaagccctgcagcttgctactgctgcggctagtccggccaccgcctcgagaactgcccgctggagcgttgtttcctctcggcttgttgccctctacaagactacaagtgctgaagtgcaccatggccatcgtgccagaatctctgcgccgcatgcaggtcttcatcgccatgctagctgcaggccgtcacagccggcgcttcggtcgctgaaccaggacccgccgaagcctgcccgtcatactggcccccggagccacatcgcggttcgcacatgtcacgtacgtcgactcgtcgagtccctactccctagagctcgagccttcgaacaagtcgccggcgcagcagtgtggtgctcgtgcgcacatatcgtaccaggtcacaaagccgaagctccgcgacacgtgcgaggaggtcggctccatcttgttgctccggctcgccgtcgacaggccacgggcaaaccaaggggctttttgttttgtcgattacaggtcaacgacgagacatcccgtagtacctgccgcaacggtgcaacctcgatcgccacgccctccgtggtagcgtgctccgcattggccttgccgagctggaagcgggacggtgcccgcgtggcgatggctgtggtggcggtgagctgcacgagccagtgggcatcgaggatgccacacacgccgcgtcacccggggtgttatctagcgccactatcacggattcacggtgtccctttgtggggctgagccaacggcaactgtggcctgtgggtgggagacggtggataccgtggaggcgcagggaaacgtcacgcgcgccaccggccgcatagaggccctgagacgtgggagccaacgctgactcgggtcaacttgccactcggacaaaatcactcgctatgttaccataggacctatattacacaggttttaatagttgaggtacctattgtatatggtatttcggttcgaggatgaaaattgaactccctatgaagttaaggggcctaaaataaacttattctaggactataatgaggctgatcggtagtgctatgtgcgcagccagctagtcagcccaaatctacacagaacaattgatttgtagcagcatcaacaagggtgtgttacttgctgaccgatgcactgttgtagccagcccaaacgattatttaaggttaatactaacaataggcttttggacggtctagatcgatttgagattcatcttgatatgataacacctggttctctatcggagttggggtgttgctgacactagagaagaagagttcttcaaagctggaggaagagttcgagctcaaatcttaacgtgattttggtagtgaaggattttgtagaaaatatatcctaattttctatcaaataccatttagcaaatccattgtattattgtagaatgattttttgtttattagtgttggaggtacactatgagagccttcggccgagcctaccgaaaccaagaacctgggcaacagactcgagcggaggcgagcagcgaagatcgagagggtagccatatgggcaaaaactacatggcgaaagccatggcttaaaaaacacgcgggctccaccaagcatgaacttcgtcggagggccgtacgggcgaaagcctaggcgtgaagacatgggcttcgtcgtatatcgaaccccaccggaagaaggcctagcgggccgttgcgcctttggggagtttcgataaactgttgggccgtgccatcctagcccagtaagggcccgtacatgtaaaggacactttgtacctctagtgtggtccttatcataagagtaaccatgtaaattcccctgtaaaatctaaatcctaaaggggaagtctgtaataggactataaatagcctcctagggccatgtaatgggggatcaaaaaatttttactaagcaatataattgtctttactttcaacactactgttgagagaaccacgtctttcaatatgacgcggttgtccattcgataacaattaggatgttctttgtcatgaaacgattgtgtgtattcaggacgttgtctgcagccgccctttttgttcttatcgaaatttgcatgacacagctcgcaaatataatttctagttgttgctacataacgtcaatttcgactatctcactggtagagaaaggggctttactcccggttgggaaccccctatagtcccggttatataaccgggactacgaatctgggactaaagatggataccgggactaaaaatcatttttagttaccaaccgggactatagatgataggagcagtcctggttaattgtttcactaaccgggactaaagatggtaggagcagtctcggttaattcttttttctcaaatcgatctgctccctaaatattcccgatcatattcccaaatcatccccatatcaatcaaagtagcatcacagatctggaaagaaatacatcacatattggaaagaaatgcatcacagatcacaatacatcacatcacaaa

SEQ ID NO: 13362 - DNA, 656 bp, Oryza sativa
attcctgcagcccgatcttcatcatctaaataacctcctgagagggcaactgattgagccccatgtgtagattggccggcaatcccagcaatatgagggaaatgagcaccccactgtctaccttccattctatctttccaatggtccccgactcgaacaccgcggttcctccttgggtcatgatcttcaagaattggaccaaaatagtctggtgcaatagtcacaaatatttgtccacttgaagcatttgccattccagctctctttgctctttcagtagtgaaagctctgtcaggtttatcttcattttctttataatgataaaccgttgtttcaccagttgtgctagcattgtttgcagccttggccatgcggatagcttggactagtgccaagttaattcttagatcttgtgctactttttgtgtaataggtgctcggcagatcacacaagctcttttaccattttcaatccaccttcggaagcatttcaggcagaagttgtggccacatggtgtctgcacaatacatgtaagcaaaagaaaatattatgtgatgacaattgatggacatggatgctataataatggaatttgatgttcagcaaagtaaaatattctgaaacacaagtataaatggtgttcaaattcctatgt

SEQ ID NO: 13363 - DNA, 6084 bp, Oryza sativa
  unsure (1)..(6084): unsure at all n locations
nnnnnnnnnnnnnnnnnnnnnnnnnnnnnnnnnnnnnnnnnnnnnnnnnnnnnnnnnnnnnnntgtaagttttcaattacaggccatggtgccaattgatgatattattaatcattaactcaagttctgtaccatatgttcaagtaatatggttgtcatgtggtacagggacctaagttttaacaatatcacagggaaagtttctcaatccatcctgaatttgggaaatctacagttcttgtaagaaattctttttacattaatttgttgatagaagctcctattaagcagatgaacatgttcgatcatcttgaattgtgcccaattcaggtttcttgggaacaataaccttgcaggaaggttgcctgatggtataagctcttccttaaaagcgatgtatgtcaaatacaatcgacatggcattatagcacaatttactttcataatggaatatattaactcctgtataatctaattctgtaatgtttacagagatttttcgtacaatcaactcactgggagcattccttcttgggctagccaaaacaatttacagttgtaagtgtaatattatgatatctgtgttgctgagaaaaaaatagatattctaatattctgttttgtgaaaggaatttggtggcaaacaactttttactcggtagcaccagtaacaggtacatactaattgtgacatttagttctaattttgctagtgcactatacgaatttagttctaattcttataattttgctattgcactataagaatgcttgctgacaacttaaattttcaatccaaatttgcacagtagactaccttgggggctaaactgcctccaacaagacactccttgtttccgtggatctccaaaatgtacatttctcaatcttcattgaaccaaagacaataatatgagctaaggaattttaatgattgttacaattttgtgatcgtagattattcttttgcggttgactgtggtagtaatacatcaacgagaggatcagataataccatttatgaagcagatcctgcaaatcttggagctgcaacatattatgttactggtcaaacaagatggggtgtcagcagtgtaggacactacttccgggccacagatgcaaagaacattatatatagttcccaaaattttaacaatgtagttgattcaaagttgtttgaaactggaagggtgtcgccatcatctctgaggtattacggccttggacttgaaaatggaaattacacagttctgcttcgatttgcagaaattgcttttccggactcacagacttggctaagcttagggagaagagtttttgacatatatattcaggtaccaatcaagtgcattttatataatgtttttctacttaatcttatcattctttatctgaaactattattgacatttacatagggtgctttgaaagaaaaggattttgatataaggaagacggcaggtggaaagtcttttagcgttgttaataggagtttcatggtaactgtgtctaaaaattttctcgagatccatctattctgggctggtaagggcgggggaatctatgggccaatgatctcagcattgagtgtcactccaagtaagcgaaacattatatatagtatcaggaagtgctacaccagctgccaagaaataatattattcctttgtagattttactcctactgtgcgaaatggcataccaaaaagcgaaagtaaagtaggtataattgccggaatatctattggtgcaatagttttagtattagcagcattatttggagtgtttacgctgttaaagaagcggagggcattggcatatcaaaaagaaggtattatttgttagtacataattcaaacatcaaaattgtcaaatgaataatcttctcatctgtcctaaaaataacatgcagaactgtactatttggttggacaacctgatgttttcaattatgctgagctcaagctagccaccgacaatttcagttctcaaaatatcctaggggaaggtggattcgggccggtgtataaggttcttgtttcccataattaatcatgtacaattggatataaattaatgtgatttggcttttgagtgttgcattttagcaatattttgtccatgctcaaaatatacatgtaacaaatttggcagggtaagctacatgataaaagagttatagctgtgaagcaactttctcagtcatctcatcagggggcaagcgagtttgtgacagaggttgcaacaatttcggccgtgcaacatcggaatcttgtgagattgcatggatgttgtattgacagtaaaacacccttgttggtttatgaataccttgaaaatggaagcttggatcaagcaatctttggtgagttcacatctgcaaaatagcatgcacacctgcagcactaataaaactatatttgtttaattcacaaataaatatttttgtttcatgaataatagttgaggattttgcctttttctgcattttgttataatttgcattcatgatattaatagagctatttcttcttgtaaaggtgacagtagcttaaacctagactgggtaacacgcttcgaaatcattttaggcatagcaagtggtctaacttatcttcatgaggagtcaagtgtgcgcattgtgcacagggacatcaaagccagcaatgtcttacttgacactgacctcaccccaaagatctctgattttggacttgccaaactctatgatgagaagcaaactcatgtgagcactagaattgcaggcacattgtaagaacattttaccactgatcttcttatgattgtaacatcaatatgaatcctactattaacttgtcttatatttttaaggggctatctagctccagagtatgcaatgagaggccatttgtcagaaaaggctgatgtttttgcatttggagtggttatgctggagactgtcgctgggcgaccgaacacgaacaattccctggaggaaaacaagatctatctccttgaatgggtaagctggtttacaaacaacccatataagaaaacatcaattcattgtgtattttcattcgtttactgaaactatgttcaacaaaaggcatggggcatgtatgacaaggatcaggcgctcgaaattgttgacccaactatcaaggattttgataaggatgaagcttttagagtcatcaatgttgcacttctctgcactcagggctcaccgcaccagcgaccaccaatgtcgagggtcgtggcaatgttgactagagatgtcgatgtgcctaaagtggtcacgaagccaagctacatcactgagtggcagctcaggggtggtggcaacaacggtaacacctccaatagctatgcaggatccagctaccagcccgaagttcagtagggaaaagatatcaccaaagtttgtctccattgaaggtgaatttatagtagaaattatccgggctatcgacattgggttcaaatgacaatattgtagatcccttttttaacataattttgtgtccgcgtgagttagagcaaatattggaattacttatcctgaactctttcatggtaataataatttgcttctaataatttgtaaatagtgaataaccgtggtgtatttactacttaaaagaagctagtggataacccttaatatgtaatggccagtgcaacgcttaggtaaaattttgtcctaatatttatgcgcactgttatggtatagttatacaatgcagtaggtgtattgtccactttttaacgggttaagctttgtattcaaatctatggggacccccggttttaaacaccggtaatcccatgtgtcatatagtactattccctggataagtaagtagtacacacatagcacaatataatatcacaactgacatcgtttacaggtatttctacattaataatacatgggtatcccaaacgggtcccaaaatagaccaagcatgctcacatacattacaaaatgccaagtaaaataaatgaaacagcggaagcaaagcggcggcggtccatcgaactccacaggcaacgtctcgtgaacctatggtccctaatccatcgtcttcgacacgtacttgacagcagcgttggatgaatataaccgactccaactcctttctaaaagatttaattaagcaagggtgagtacatacatacccagcaaaccaccacttcaaaatgaatctaatgcacaccggggttcaaggatggcttggtttatttgcataaagctagtttttacaattcatttcacaaacctatgacctagcagttttaactcgaaaacaacgttaacgttgaagttgtaattatccagggttcatccacctctccaagcctcgctcggttcagtttaccctcacattcattttatagcaactctatcataccaaccttcccacgggttgggcaaggttctcatgtctcacaatttctacactaagcaatattaaaatctatgagtctagtcaagggtagtataggtcccggactcattaaccgcgattacggctattcgaatagattggtttactcacactgtattagatgtacgctttttatcccgcactccgcggcttgcacaatacatgagcctaatcccaacacctgaaaactggcccggccgcttttaatcccttttggctttcgggacctccttccagggcctttaacccccatgccccccttccagtcaacctaactactggccgaatgggaagggaagcctggcgctccagggataggagatatttactacatatatacttatagagtgtattttaggttttacgtgtgcttttacctttccgacaccggactcatccacatcgtactcatacagaacctaccatgactggagtgtcgccccacaagagcttcctagtccgtcgtctgcccatacataagaaatgcaatcgtactcggttcatttcccgtataacttcctgactcggtccttaactgtcgaaggtcagcgactaaccgtttccaaaaccactcatattttactcatgccgccctagtcgaaatagttttgttttattaagttttggttttcgcaaacggtttgtgtgtggtaggtggcgctcatgtctccacccgcaaatcataaatcactcacattgagtgatctcacatccatatccatataatctaagtttggagtgtacaaacgtctacaatagcaatactaagcaatgtcaataattgactgcgtataaataaatagacttaggctacaatggatataaaaaagtgtataacggtaacaatatcaagggtaggcgatattcaagtataggtacgcaatttataaatagcatgcaattttatttgcaagcaacacatttataaatataggctcaatatgttcaaggaagggagcgtagtgacttgccatgctataggtccctaatgccttcgagagatctgtatcagttagatgattagaatacccacaatcgaagaataaccagaatattcacgctcgataaacggcccaagaagccacacataatcctaaggaaataaaataaagcaacattcaatacaaactatgtgtgccattaaatatatctcgattttagagagattgtggaaattgaacggagtcaaatgtagttatggttcacaagataaacggagtatcctttcctctcctccttcgatgcagctgaatatttactaaaagttatatttcgctattgcattccagtagttcttgtccagagcatgctgaaagcctttggttgcaatttcagatccattcggcaatttgccctggaaatacttaaattgtcagtgagttcacaattattatttgctacaaactgttccattctacaataagagagcaaattaaattaatctctaaactgaaaatacaggttacacctttctgctcacaatcaaacttcggactatattagtaccttataaacggcgctaaaatcaccttgtcccgcttatatttacttgtaaagttatctatggcaaaactcctggaaggctggaaggaaagcattaggtgagtttttccagttccaaatggaaaagatctagaaattgaat

SEQ ID NO: 13364 - DNA, 5815 bp, Oryza sativa
catttctggcaaggaattatggatgtgaaagaagtgttttataaattctgtactaatgtagtaggcaatggaaggaatactttgttttgggaagataattggataggaggtaaacctttggctgaacagttccgtgatttgtacaatattactttgacaaaaaagattactgtggcagatgtgaaacaggtggggattgactctattaaattcagaagagatgtcctggggaataaactgctgaaaattaagcaatcctggagtgatttggttctggaagatggaaccagagatacacttcggtggaatttgaccaaagatgggaaattcactgttaaatcctttcacacagctctgaagatgcaacaggtgattttcccgcataaaaagatatggggcttgaaagtgcctttgaaaatcaaaatttttatttggatgtttacaaaaaacaagattctcacaaaggacaatcttttcaagaggggctggagaaaagggaaggctaattgtcaattctgtgaccaaacagaaactttacaacctcttttttattgccctttagctagactgttatggaatattgtgaaatgtgcccttaatataaattctgtgttgaatagacaagatctgtttggatcttggatgaacaagattgataaatttacgaaaaaacttgtggtagtgggtcttgcggcaataatatggacaatctggaaatttcgtaataaagcttgttttgagaaaaaactcccagctgatcctactgatctggtgtttatggcttgctctttggtggactcgtgggcaactttgcagaagcaggagggaagtcgaagaaatcttcaactgggggccaggttgctaaaacaagtggtaaatgaagtctacaactcgaagctcggctggagaggaggtgttcgaaggattaggtcataactcaggagaggaaatgtttactgagtattttgtgtggatggaatgagcaaagatagctctgtaatagacaatctagctatggtctttgtttttttcttttgcataagggtcggatgtcctccctcagatgttttagtttttatttttctgttttctgtttagtactctggtagtctgacttgatctcatttctagtaaaagaaatgggggcttcatgccctagctcaaaaaaaaaaatcagtaattaactcttcagggatcaaaataataaagatttttgaaaactgcgaaatacaaaattgcaagtttgatctgaaactgcggtgaataatccattttgcattaacattagtgcagtacatgttatcatagctatgtagtggaatttggtacttctagaagatcttaaactggatgacaattacaacatcaacaatgtatagtctggataaaaaaatggattcaattatgcagttcagcatattcaactctacaactaaaattcactgaaagtatccccttacctttctatatgaacagaaatcaactgcaagggtgagaatagaatgcaggcttgcgctggagcatggcaatgaagataatttgtcgctcagcattgctgtgcgagtgcacagaggaagatatagtggtagacatggggaggggaagtggagcggcggtgggcgcaggggagctgcaagccagcggcatggctggagagggagaggaggatgtgccgatggatggtatcaatttcatagggctcgcagcatcgctgaacatttggtgattgggagcgcactgatgttcgcgggggagaccagacgctgtcagcctggccagatttttttttaatcccccgtggggtgtctttgtattaaagaagaagagaattgacccagtttataaggaaaaccggacccgaaaaccatacagctgcacggttaattatgggaaaccggctgaaacccactgcacagagaagagaaagggacctagctacacaactaacaaaaacggcggagcctaaccacaggatgttgctgccaatctaacacaaaagcaacacaacagcttcgacttcacagaagaggtgttatcattgccgagctaaccacccaagcgatccagcagcgccggcttcacaactgcagcgataatgaagcgaaagttgccaaagcgaaaagcatctccgacatcttacaatggacatcagccaagccaccaaagagccacttcattcacacggctagcaccaactccctggaagagactgcaacatgtcatcgttgccaagcgtcgctgcatccatcagcgagcagctccgacttcataagcagaaacagccgaagagcgtgttgcccaccgcaagaacaaagcgacccaagaaggcgaagggcctcgccaaaccccaagatatgaaagcttttaaacccaaaagaccatcaacagtcgtcgattcataggaacttctctgaagcgacgcccccaaggaggacatgacgtgtaacactgctgccgctcgtccgaaagccggaacaaggttttcacctagagatttgtgggggatataaaagaaacgcccagacaatgcctccaagaaggaaaacggcacccacgggcgtcgtcgttgttaaactggccaaaggcacgacaaggctttcgtcagcgtcttcacatcacccacacaaaacacccccaaatcgacggccataggacagtctataacgtctcgcaagcagtcataccttaattgtagttaacggcaaagatgggctcatggccaccctcgaagcgccatcaagacaagccccattcctgcttcacgccagcacaaaccgtcgtcctgccaactccacatcctcacatcaccgcccacgaaccatgaaatccgccaccggcccctgtcgagcagggggctcgctgccagagtgcaaccccaccggagcccgcctagcgacgccgtgcagccgccgaactcgccgcaacgtgcccgagccgcgggcagccagatctgcctgcggcagtcgcccccctccggcctcatccctccggtcgcatccctcgcgccaccgccgtccggtgggcgagcatcaatgatgcaagaggggaggataggcgccactgccgccgatgagttggtcagccaccaccggtcgtgccgcgcccccgccggtgctaaggccacgatgaccttcgtcctcgcgctgccgacacctctttcgcgtgaccgacgcctccttcttcctcgcgcacagtagcgcaacgccgccactgtggcagcctccaccgttgtcggcctcacctcctcgctcgtgacgcaccgtgctccgtcgttgctggctgcaccgcctagccgtagccgcgccagccagtgccgccgtcgccgcacaagttctaagcatgcctccgtcatccgctgaggccgcgggcttccaccgcgctcctccggcgtcggccaccttcgcctgccggccacagccgttgcatcgcccgcctcaaccagctgtcgtcgcagtggacagtcgctggctagatccgcgctccggagggccagatccaccaccggtgtgctcggatccgttgcggctgacgccccgttgactgtcaccctgtcgcccgccacggccgctgacttccgaccggcacgcaccactctgcctcccacgaggctggccggatttggtgccattgagtttgttgcggctggatctgatgagggatgcagcgtggcctggacagggaggcagcgatgacggagacatggacagtggaggagccaaggaggcaggtgtggtggtgaggggatgcgacgcgacggcggcggcggtgcggcgatgggagaggacggcgaagtaggccatgcgagaggagtcatggaggaaccatggatgggagaggaagggtggaggaaccaaaaaggttcagttctagacatattgtggtgtggaagaatctaggttttattgaagtttcatgaaggatcttcatggtcttttgccatttgagccatccgacggttcatattggctggtgataacatcggacggttcaagttttcttgatgacgtggatacataattttgcgagaagacacccctttcacttatttagattatattgttggattcgttacaactacataacaacatttaagaaggctctattccgacaatttttttttactttttaaatgttgcacatatctttagtgaaatatgcaatgttccaacaagtatctattgatgtttcactatttcatttgcaatgttgcacgttatctttttatatgtctcagcaattacaattcgatgtttcaaaatcaaatatttgcaaatgtattgtattgtatgaattttttagtgtttcactagttgggacataatatttcatgtaataacaattattgttgcagtcaaaactttttatatgttgcatctctataaaacatctgcacaagtgatgaagcaatttttttttgtaaatgctgcaacaaaagtttgatttttctagaacacacatatatacttttataaaaatatatttatgtgagatcttgttataaagatttaagtatgacaaataaaatggtataattaaattatagattggatatatattttagaagaaaactttgtttagagtttgattaaaaatggagagagaaagtaatgatgaatcagtgcaccttggtaaccagccttgctcctctatgcgtgtgacacatagtaaaaaaacaagaccggtggttgacccgttctgatcgtcggttcaccggtcgaaccgccgggtcagacacaactagccttgctcctcactacatgcatgctacagacgtggccctgcatgcgacaaatgcgtagcagcatacaatttgtagctttctccccacatccatgctgggtgccgacccgttactgatgtacatagttgtaacggttgaactcttttgaacaatcagtgatgtggaaaagaaaatcccagccgtttatcgacctagacgtggccgtccttccactctcggtcctcactcattgtcagtgcctccaccaggccaccgcttgatgtgtcatgcccacaggcaacattgtggaagaggcgctgtgaagaggacatggccagatctgttgctgtcatcatgccggccttgtgtcccgtcatcaaagctaagtggaggatcgatctataccaactatagagaggtgaatggttaaaatacccaaaaaccaaaacttttagcagaattaaaagttaccatcaaatcgatgtaaatcggcctgaccgtagatcttgcaccgctccactactgtagaactgatatggattaaagatcatttgtagtcccggttataaagtgcaaccggaccatataatatttacttccgattggtaacacctattgaaattaaagatgatatttagtcctagatcactttatgttaaggggctgtcaggggccatggcatctttagtcaaccggggctaaaaatcatgactttagatctttagttctttagttcggttggtagcaccaaccggggctaaagataaaaacatttataacattcttcttcctcttccaacccgagcaattgctgcaaagatttgtaggaggaagggaggtgctgccaaaattttttgtgtaagtgttttggtgataatatacaaatcagagggatctagaaggttagcaactctcgaatgatgtatgcttagcatattacatttatggaaaaattcgctactatacattaaaaaacgtgtatttagctggtggacatcgcaaaaacacgaatttggtgtcgggcatcacaaaaaatggtaattagctgatgcacacctcgcagccatatcttattatttccgagggaattggaaa

SEQ ID NO: 13365 - DNA, 6127 bp, Oryza sativa
tccaacgacgacaaagacgatggcgaacggcgcccgcaccgccatgctgtccccatgctggcgccacagccgcatctgggcctccacgccactcgtcctcgacgatatagatggccaaaacgcccgaggcccgacggcccagcccacggcacagcgttttggcccggcccaagcacggcacggcccgtcaagggtcgggcccgtgccggcccggcccgactaccgggccgtgcctgggcctctctgccggcacgttgggccggcacggcacggccgggccggcatggcacgatgggccgcatgccaagcccaacacataaacaatagggagtaaaaatagacatattttatgccacagtcgaaagaatagggacgtaaaatagacttattttacctatatatatgtcagcccaaagaggagggacgaaaaatagacttattttcactatatatatgtcacagcccaaagtggagggacgaaaactagacttatttaaaaaaggaacgatgggccacccgcgccttcaggccggcccggcacggcccgacagctggtgggccgtgcctgggcgggaggcgcagcccatgggccggcacggccctgcacgaagtgccaatcgggccgtgcaggcccgatggctggtgggccgtgcctggccgtgtctgggccgggccttttggccatctatactccccgacgacgatgacgacgacgacggtggacggcgcccgcaccgccgtgttgtccccgtgctagcgccgctgccgcatcaggcctctacgctgctcatcctcgatgacaccgacctcctccccaacgatgacgatgacggcgaggaccggacggcacccacatcgtcgtgctgtcccgtgctgtcgccgcatctgggcgctgctaagggcacccatcgtcgtgctggcacccgcatcgtcgtgctgtcgccatgctcagtgttctcgctgccaagggcgtccaggagctcatgctgctcagcgtgctggcgtcgctcctttccttaccagagagcaagttaccaagggcaaatttatctttaaagagtgtttctctctccaattcctccaaaaataataaaataacgcaacgagtgtccatcagctaatttccagttttttttttgcccaacaacaaattcgcgttcttgcgatgtctaccagctaattacatgctatttggatgtcctatagcaaattttgcctacatttatagctatgttttttatatattattgtgtctaaaaaggttgatggaaaatgatgagagagaaaatttgtttagggaaaattaggctacttttaaaatataaacatgtggataaaatgttgtaaaagagataacaaaggaaaaatgtagaaaattaagataaaagaatagaaaactaagttaatttaataaaatagttagaaaaagtacaatgtattaaagatatgcttagaactttaaaaatagttaaaacatgaataatatgtgggagtattgtataattattgtacgattatttatatataattattgtatgattatttaattagtttgactttcgtggattttatttttacgatttttgtgcatttcaggtaagtggatcggcaatgtgtgtacactgtggaccgatggtcgaaagagtttatagaaggcgtgtattattttttgagtgtggccaatattaacaagcataagggttttatgtgttgtccacgcaaaaagtgaaaaaaccagaaggagtattctacatcaagaacatttcatgcccacttgtttcagtcggggttcatgcctagctataattgttggacctcacatggaaagctaggggttgcaatggaataaggtgaactagaagaagagaacatttcggactgtgcgcctcaataaggtggatttcaaaaaaatacaaagggcgaggcgaacggggcttttgaagataacgatagtgtggatgatcttggtcatatgttgcacaatgtaaaggaggactgtgaaagtgaaaaggtggtccagaaattggagcgtatgttagcagaccacaaaacgtcattatgtcctggttatgaacaggggcacaaaacgttgggcaccacgctagaattcttgcaatgaaaagtcaaaaatggtgtgagttacaaggcatttggcgagttattgaaactcgtaaagaacattattccggagggaaacagattgccctaaataacattcgaagctaagaggtagtctgccctctaggactggaagtacagaagatacacgcatgtccaaatgattgtatcctctatctccgtgaggaatacgagaacctagaagaatgcctggtttgtaaagcactacgatacaagattagaggagatgatccagccttcgaagaagagagttcctcctaaggtgatgtggtatttccctataataccacggctcaggcgcttgttcaagaacaaagcgcatgccagaatgatgcgcgggcacgcagaagaacgtcaacaagacgggatgctgagagacaccccgttgatgggttgcagtgatgaaacatcgaatgaacatttcaatacttcggagaggatgaacgaaacgtaaggttaggtttaagtactaatggcatgtatctatttggagagatgagcagcggccatagcgcttggcctgttaccatgtgtatctacaacctcccccttggctatgcatgaagcagaagtacatcatgatgccgattattatttaatgccaagagcaacctggtaacgacattgatgtgtacctaagaccattggatgaacatctgaaactgccggggaagaaagaaggtgtttgttagcattaacgattggcctgcacctagcaacttatccgaacagtcaaacaaggggtataaggcttgcacccactgtatggataaaactgaaaatacgtatatgaaacattgtaggcaggttgtgtacatgggccatcatcgattccttatttcaagccacccattccggaagaaaggcaagcatttcgaacagaatgaagaccgccgtactaagcctaaacatcgcaacggaaaagtcttgtttactctggtgaaagatctagaagccatgtatgaaatgtctatatatggctcttatgaagagatgtaacaatgaatagaattaatcaaatatgttgatttctagcttggaggattcctccaaagttagatgactgcaaccatctgttataatacttacatgtatggctaatgttgggtttttctatgttttctataaattttatattattcttttttttattttagatactaaccccaggcatatctactgaggctaatgttttgatatctctgatcttgtttattttcttccacttcttgtgttgctccatccaaaatactcatcccaggcgtatctattgtggcatgtaattttagacattgcaaatatgcatatttctctaccgaatatggctttagatgactccagttagagcatgcccaacagctaccgaatactgctaccaatctcagattttttaattcctatggaaaaaagtagttccagcatttcccctatatgccaaaaaattggaaaccccatctccatatatctcgctctccacaagttgggtgtcctcctcattccctatccctggatctgagggcaagtgcgagggaacgtcggtaggattgaaaaaatagatttattcgttacatggcccatttttaagttttaggcatctgttggaaagacaaatattttcacccctcaaattccatttagggttctccaaaataaaatttggggatagatttttgaacatctcttggtgatgctcttggtttacgctgatttcaagtaatacatgcaaattaacattgatgtccatttgtcagacacagtaatctccatcatttctgtatgatctgatattggagcaaatccgcaggtttgataattttcagtaatctcaaccatacatcttttctaatctaataaatcatgtttatctatactaattactatctcaactactggtagaagaatagttttctgtgctagcaatagaactcataaatgaatgtttgagatcacttctacttatgataatactggcagtacaaggagagaccaacataaagttactctttctcgtaattgtgcgagaaaaaaggctgatcatttggtttaacaaaattctttcaagggcaattctagttgggatgtattctgtacaatcctgtgaaaggtagctgacattacaaccgcagccttttcattcacaacaaaattgaaatttgtaaaatcaaaggtgtttttgattattattctgtgataaacaattggcatcagagattattggttttgatatttggaatttatttgtgatcgaagtggttttggagatgattagatttcacaggtgattgacagggacttgttgtttgtcgggaccggtcagaccgggccgatgctgccggtcagaccagagctatgtgagcggttagaccggccagcccacggtctgacctgccgacgctgtgtcagtttcggtttcgggttgtttatttggatatccgtgattgtttcatatttatggcttctagatggatattatgcgtatgtaatacagttgtttgctactaatgagttaagttagggatagcttggtctcggaatatggtttctttgtttgtttcatgtgtaggtgacttgatgcctcgggagagtatttgcggtgatggaccgggagttgacttggtggtaaggcgatgtccatgatggtcagatatcacacgggatacttaggctagagttcaatacatgtggttggtgaagattccatatggcatacgatggaggtattgtttgcgtatgggatgtggagtctaatttggaaggagtccaaatttgatatgattggttatgtaaagtttgtttcttgtacgagaaggtttcctagctaaggggattaggatttctagtatgagtttggttcgtggctttaggctgcctacctcatgtataaatagagacgtagcgtgagggttctcggtatcgcttttgacagcaattgagttgctagtttagtgagggtttcgagtttagtcgagatttttgtaagtagtgctgttgatgtactttgtaaacacagaaagaagcaataaagttgtcatccactttaagagttttttgatttgtgttttatcgggttcggcggtctaaccggccacacaccggcggtcagatcggcggcagacctgcggtcagacaggcaacggcgaatggagttggtgattggtctcggcggttcgaccggtgttacaacctcggtcagaccgacgtgtttcaggcggtcaaaccggcgcatctacttcggtcagaccgcgatccgtcgaatttgagggtaacattttattccgcaaaaatattgggtttttgggcataccaaccattcaccctcccctctggttggcttagttcttgtgatacgatcctacaaaatttaaacccaaaacaattctatttaagcccatcaattattcatatgtagtttgggctgtgcaggtgcaaattacaaatgtaccaacaacttgaatttcacttatatgaaacaaataaataactcatctcgagatgtccggtgtgaagccttcacaagaattatagttaataatcattgctttgcacggaattttgcaagatgcaacaacaaaatttgtattttagttcactggtgtgttgctgacaacagagggtgccaactagcacagaccagtggcggatctaaaaaatcgattagttgatgtcataacgtgtctattggtattatagtatgttaattatgcttagctcaaattcttataacatataggtaaacagtttcgttataagttttgccgaaaatcatcggtgtcgcctaacaccggcccttctactgtagatctgcccatggcacaggcaaaatcttcaattccattgaatgtagagcgatcgacatgaggccattaagggcagatgaagttggtaagttaatttgagaggttgcacaaccaaattcgtgaaagctaaactggtcaggaaatcaaatatatagcggtgaatgtgcttggacttgaacaggcttgtccaa

SEQ ID NO: 13366 - DNA, 6959 bp, Oryza sativa
  unsure (1)..(6959): unsure at all n locations
attggaaactaatcttgtatgaggaatatatagcaacgtgcagtaggagggtgaatcaagacagtaatgattaaaccatagaggccggagaataaatcaagacagtataggactgtacagggacacagaaatattgtgaagattcaatcaatgttttcatattttgtttgagttattatcaccaatagtctgtggataatctgtggatatcaacaagtggtcggtgggatcacttattaatgtgaccttagagcgtcatacttaaaattgcatataatgactgacgaagcaattcaatagaggctatggagcaagatatttaaataaaagttgggctttggcccatattgtcgagccaagctgaagctccaattatgtgacttataattagatcactttcaattgccgcacttgtgagtatggacagaattttgagcgttgatgaattcctggaagtgatgaccacttgtttcctaccaagactggatccacaattttgaggcaaaattcacttcactacaaacatgaacttattcttcatttgttttctccaccataccggaaacaatggacaagtagcttaataagcacaaacataacaaaatttatagcataacatattcctccatttcaagcagcaggcaccttgtttacatggtcgcttgaactttgcctgatgtggctatacgattgagctgttgaagatggcaatggtgtactcgccctcaggcagaggctctgagcgtccttaattatattgatgaatagattacttgattacaaacggctctgaccatctcttaaatagacaagccataaagtaactgtcagcaaaaacccctagctcagctctcgatcagtggctaacctacaatctccgaatattttccagacgtgaacagtaactgaagaactgaaacgaaaaacagagtttttggtggtgcgaactgactgcagcttttctgggtttttttctttccttttattcacctccatgagggagtctgttacatgcgcaaccttgccggatcaacgactgaccgtgccaactgaccgtgccatcccacgatccgatcccagctcgatctcatctactctgaaaaaacagagaaactgaataacaaactctgactgaaaaactacattcagccagcgcatgcaactaggaatccaaagctaatatgctattacaaaaaatagtgcaaagactaatttaaacatgcagttaacttgtcacgaccaagattactctgacattttcccccctaatcttggtgtgctggttccaaacccatcttcttgcgaacctccaaaaatcgaactcttccaacaggctttctcaaaatatctgcaagttgatcttcggaccgaacatactccacagcaatttgcttcttttccacacactccctaataaaatgatatcgggtgtcaatgtgtttacttcgttcatggagcaccggattcttgcatagattaattgctgacttattatcaaccttcattacagtttggctaggttcttctccaatcagttcagccaacaatctagtaagccaaatgccttgacaagcagccgtagtagctgcaatatactcagcttcacacgatgacagagccactaccttttgtttttgagattgccagctgatcaagcttttccccaacatgtataacactccagtagtgctctttctatcatccaaatccccagccatatcactgtcactgaacccaatcaaactgagtccttcagttccttttcttgcaaaccaacaaccagtatcctgaaatgtacctcagtacatgcttaactgctgcccagtgttcaatggtaggtttttccatgaacctactcacataaccaacagaataagcaagatcaggcctagtattcaccaaatacctaaggcttcccacagtgcttttgtacatagtaggatcaacagcctttccatcactctccttcctgagctttaacctagcatccatgggactttgagtcgagttgcagccttccattcctgtcttttcaaggatttttgctgcataagcagtctgtgacagaaacactccagtttccttttggacaacttccatccccagatagtaactcagcagtcctagatcactcatgcaaaatttctttttcatctccagtttgaatacttcaatctcacttggttgagccccactgataatcagatcatccacgtacactcctacaatcaacttggagcacccatttcccctcacatacactgcactttcagtttcagattttaggaaattcagagagattaaagtgttgtgcaatttagcatttcaggctcgtggagcctgctttagcccatacaatgattttttgagcttcagtacctggccttcttttcccttctgaacaaaaccaagtggctgcacaacataaacttcttcctcttaactcaccatttaggaaagctgatttgacatccatgtgatgaatctgctagccttcacttgccgccaatgcaatcaagagcctcacagtttccattctagccacaggagcgaaaacttcctcaaaatcaattccttgctgctgcacatatcctttggcaactaacctcgccttgtgcttcactactgcaccagttggatctttcttcaacttgtagacccatttaagcccaatggctttgtgtcctgctggcaaatcagctagagaccatgtctggttttcttcaattgatcttaattcctcctccattgcctttctccagcattcatgctgctctgcttcaacaaaacttgctggttcttcggtggcaagcaaacactgatcactgtagtcgaaatccaaaacaggctcagttgtggatagaatatcttgcacacggcgatacctgacaggaccttcttctgttcctggcgtaactgagcttggcggcgtgcaaaattccaccctaactgctgctccagatggcgagggcgaaacaatagtcgacgccggcgatgcgcctccttgaacagtcgttccagcttgtccaccttgattagcaacaacgggttccatgggacacaaagaaatccaccgtgaattcctcctctccaattccctccgcctcaggatcatgccatgcccaggtggccgcctcatcgaacacaacatcacgcgacacacaaacacgtcgcgccaccggatcatacatccggtatgcttttgaaccctgttcataaccaataaaaaccattctcgtacctcggtcgtcgagcttcctcaagtttggcctcactgatttgacatgaccaacacaaccaaacaccctcaggtgttcgaccgatggacaccgtccatgccaggcttcatagggggtcactccgtctagcgcctttgttggtgaccggttcaagacatataccgccgccgtaacagcctcccccccaaaaacgcgccggcatccggctgatttgagcatacagcgcgccgccgccatgaccgtatggttccgtcgttccacgactccattctgctgtggggaatagggatcagtgagctctcgcctcattccacgatcagcacagtagtctgtaaactcaacggaggtaaattcctccccgcggtccgtccttagagcctgcagctttcgcccagactcaagctcaacgccggcttgaaactgtttgatcgccgccaccgcctcgtgcttgccggagagaagtcggacccacatgtaccgactcatgtcgtccactaggagcaaaaaatactttctcccgcccggtgtcgccggcgagattgtcccgcacagatctccatgtaccagttcgagcgcctcctgcgccctgaacgtggcctcctcaggaaatggaggatgacgttgcttgccggctagacagccatcacacagctgatccatgtgatcaatgtgtggtaaccggcaaaccatgttcgcctgtgccagcctctgtagcgcctggaaattcaagtgcccaaaacgagcatgccaccgccaagccgtctcgccgccactcgccgccaaacaaacagggcttgcaatgttcagttttagcacatacagatagctattatcacggtataccttggtgagcagcaagccttcgggatcacggagcgtgaacacaccgccccatatgagtgcatcgtagccgcgcgcgtcgagtcgcccgacgctcacgatgttcttgcgcagcttcggaatgaagtacaccgcgtcaagtgaccggtgatatccgttcttgcacttaagcaccatgcttctgcgcccctggatgtctatcaccgagccatcgccgaatttgacagtgccgacgactccagtgtcgagctcggcgaaggctgagcgcgcccccgtcatgtgatttgtggccccggtatctaggaaccattatcctgtgttctcttgttcatgcccatcatcatcatccaggaccacctttctttcggtgaggtgcacttcttgcaccctaggtgttcgaccaaacgctgcttcgccggcgagcgatagcccggtcacatgtgccatgagcagagttggctcctcctctgtctgcatcaagtttgcctcgccgcggcgttgacgtcgcggttttcgacattgcctagcaaaatggccatattcttcacagttaaagcacttcacctttgagatgtcacggccgccgctctccccggaagctgcctcttttccctttggtgtaccagcaggtttgccttggcgattcggtgcgccagagctgctgcgaccctttccaccaccaccagatgcatcctactccttctgcttgctccgtgcctgccattgttcctccgtgagatacaacttgcttcttgcttctttttcttcgtcatcgctgtagctgtcgatcgtcgacagccgcccgacgagttcctcaagagccatcgttttcacgtcaagaagctgctcgagggagatcgctactggcttatacttcttggggacaacacacagcagcttcttgttgatgtgttcgtcctccatgactccacccatgtcacgaatgtccgcgacgatggcagtgagccgaatcgcaaattcctcaggcgtctccccatccttgaagcgcatcgcctcgaactgacggcggaatccctgctcattcgcctcacgcacgcggtcgacaccgatcctcatggttttaatggcatcacacgccgccttcgccgtgtcgtgcttcgccagcccgcgcaacatctcgcgcggcacggcctgaagtatcgccgagagagctgcccgatcttcacgaaactccacgtagccgggatcaatcgccttccacagcccctgctcctgcaggttgacgcgcatcaggagcgcccaatccggatagttcgtccttgacagcactgggaggcgggtggtgtgccctgcatctctcccctgaggcacaagnnnnnnnnnnnnnnnnnnnnnnnnnnnccccccactgctgccacttgcgccgccgcggccgctgccacttccaccgctgccaccgccaccacggcgtccaggcggtgtgtatgacatcgtcgccggatcgtgacggtaccgctctgataccaaatgtcagcaaaaacccctagctcagctctcgatcaatggctaacctacaatctctgaatattttccagacgtgaacagtaactgaagaactgaaacgaaaaacagagtttttggtgggcgaactgactgcagcttttctgggtttttttccttgtattcacccccaccatggagtctgttacatgtgcgaccttgccggatcaacgactgaccgtgccatcccacgatccgatcccagctcgatctcatctactccgaaaaaacagagaaactgaataacaaactctgactgaaaaactacattcagccagcgcatgcaactaggaatccaaagctaatatgctattacaaaaaatagtgcaaagactaatttaaacatgcagttaacttgtcacgaccaagattactctgacaataacttacctctaacaaactccaaattatctcaagcctgatttatctttagccaaacaaactcttacacaactttatcttcaccacttgtagacgcctgattcatcttctggcgcctatgatacatcccgccgattagcgtgtctgcaacactgccatactcttgacagcataacaaaggggatgtgcaacgctccacaaagctactagtaatgtgaatacttttgtgtctcattactgtagttagaagaattgtgccccatttctgtaatgctgtacttttgattctgatgcctcccatctcctggtgaactttcttagctggtctatttccaatactggaaatttgtctgatcgagtagaagaggaagcgagaaattaaggttatgttgttcttctagccagatctttcggattaacgtgggagctcatagaaagtgttcgattagtataagtatagatataaatatcgaagctttaggtctaactacagcactgccatttcctatatatacatgccaccatgcatgtattttcccttgatatacataccacaataccagagattatacgttattttttcattcgtccattttatgctagagaaaatgtgataataatgagaggtctcaggaaatagcaaaaccctcatacctatgagcctaaccggctggttgagcccccctgctgcactgatgatggaagaagccatccagctgactagtcgagatctttcgttccaagaacaagcggtcaaagttgtttgattcctgtaaggtactgctatacaacaagtacaaggatatgtaaatgaaaagctacaaccatatgtaagccaaaagagttcaattagcttaataattatcattgtggactattacggttgaagtgatctaaagtcaaattttgctacaggatatcggtgacttcgtgtttttagttataggatattgtggaagtgacttttggtgggagaca

SEQ ID NO: 13367 - DNA, 5583 bp, Oryza sativa
cacatgttagatctgtaatctctcaatctctatccctttctcaagcacatggggcccacatgtaagcctctatcattgttttccccttctttctctgctcgcagcaggaacaggtgaggtgaggcgtggcaagcttgatggcggccggccgtggacggcggcaacaggggaaggagatgcagaggccagccgtgggtgaacgggaagcggtgagcacggagcagtgttcttggccagcagggagcagtgggtcggtgagcccgggcccaccagtgaggcgacacaggagacaggccggtgaggtcgacggaggcagaggggtcaccaggtagtggggttcatggggaagagccggctggcggcgcagtcgcaggaaaagccaccggtagcgaagccggtgtcaacgaggtccgcggggaaggcggtggatccaagaggagaaggtgggggaagaggtgagcgatgccacacggaggtggtggccgccgctgatgcagctagcggagattggacgaggttattataaaagttagtcgatatagtggaacgacgactaaccttcccgatcgctttagacatttatcacctaagacacgccagaagacgacataggaacacatgatatttgttaacgagattcagccgaagcctacatccctagggctctgattatgaacgctcctccccaaccaacatagcacctagcagctacaagtccatggccacaccgccatcatctccctgcatgtctacgctatattgtagtcgccatggttacattgtggtgcccccctctctacataagagagatgccgggttacagagtccgactataactctaccccctaacacctatcacaactccgagtccaactgtaaccaaataagactggtatgttcgacacctattctgacagaggttgaggacaatggggccagcagcgcgacaacagagtggagggcgtccgacattccagtcagagaagccgatgggaatgaagggcgctggccatggcagtgtggaaggaggggatagagagataagagagtgcagatctgacatgtgggtccaatggcatttcagaactttcacgtgatttctctcgtcttatttaaacaaaattattattttaataggtgcggtgtccaccagcaaaaatccaactttgagagtgtattccctcataagtcgcttcgcgcggtatcctacaactaaaatcatgatgtcacgatgttatgtagcaaaatttgccaattttaaattactgtcagttagttcttagagaaacagtctacactgactttattattccctttattattccctttttgcagtgaaacagtctacgctagctagcttgttcaaggttatcaacagcgtcttctctttcatctcctgtacggatattttatacaagactgcttccatctccttcttccctttctgaactgtggttgcggcacttgtgattgctacattgagtcttcaagggatcgtggtaggctgctgtttattgttgatctcttcgattcaataaaaacaaacaaagaaactcctccttcatggacattatattcacaaccataggtgtgtcctcttattaggcttgtattgttttccacctctatatcactgaaataaggcatagtttcatggatatttagaattcctttgtagccgttccggtagttttttttatcaaaaaatttaatacttgcaatggccaatgggcttgggagacattggcaaatagtgtatcatattctgttgtagttctagcactagttgcaaacacgtctcgcaatgccaattgtagtttcagcactaattgcaaataggagaatgctctcatggtacacaagtacacaacgtgtatgttctatgcggtgcaagtcaattgttttgtccaatggatgtttagatcaggagaagaatggatctcccagcagcaccaagagaacaggttggctgttaacatgaacgtcagctgccggtgatcagcttgccaaaatttcagtgaaaatatctggtattttaaaccatgcatccagatcgatcacatgacctacatgttgggatacgggtaggctacgatagcataaatcaaaattttctatcgcgtaaaccaagaaccatgcaagtattagatcatagatcgttaccactcgatgcgctgcgcagcggaagaaaacgctgagaagtcgaaggaactctcgcgaagtagcgcgcgtcgatgcagaggaagtagtcgatcgcaccggctcgacttctcctcctcgtgcgttcacctcgccgtactcccacgccgatcagcaccacaaaccagcggcgcctctaccggtatccacacgtaaaaggacggaacaccacgtgcagatgtactagcacccgcgcgcggtaggattttgctcggggagggaagtgacggctagggtttctcacgtgatgcaatgcctccgccggtcacacccctcatgaatatatagaattcatcactcgggcctccaaggcccgtaggacttctatccgatccctatccgaattaagctcatattggatctctatccaatccccttattccgacccattaagcgtgcgaccctgtaggttcatatatactcggctttaacccgaaaactccttttcggtccacgcgtcaacagcggcccctagcaaaacgtattgacccaccgggcatacataaagatcatatcggctgaacctctagtatatacttatatggacctatttgcctcacgatatcgattaagctcaaggctagatatgtgccatcctctaattgctcaatcattcactcgaacctgttgatagattatataacttgcgattgactcctcaatcacctttggcatggccaagcacttccataatctacaacatcgaggggcccagggatatctctccataggaggggcaaatcccatcttgattattcatatcccactacatgtttcatagcatactcgaaaactacttttataactacccaattacggagtagcgtttagcagtccctaagtaagctactacacatgttgggaaccatcacaatctcaggtctaaggattcaacaccaacactaaataagatcactgatgacacaatacatatggctattgcagtgtcttatgttgggtctatccaacaacatgttcactaacatgtgtccacatcattaatttgttatctctataccatgatccatgagacatgatcatcaattaatacatgtgctgatcatctaaacatatttgttccacatatgatatttgatcagggatcctttagaaatagcaacacataatataaagagtctcatgaaagaatcacatattcattaaccaataatgagtttatctatttcaaggaacaaagtcggataaatatgtaaacatagtgtgtaatacaatcatctctatgattgcctctagggcatatcactaacagtctcccacttgcactagagccaatcatgaacgtatcttatacccattgccctagtgtgtgcctcatgcttaggctgagggagtggctttgtcaacggatctgcaacattcaaatccgtatgaatttttcatatcttcacatctcctctacccactatctcgcgaatgaggtgataccgccgtaaaatgtgtttggacttttgatgcgatctaggctccttggcttgcgcaatggcaccactattatcgcaatagaggtccataggtctagaagcacttgtcatcacacctagttgagaaacaaatttctttatccaaacagcctcctttgctgcttcagaagcggcaatgtattcggcttctgttgtagaattagccactgtatcttgcttggaactcttccaactcacaacgcctccattcaggtagaacacaaatctagactgcaatctaaaatcatctttgttggtttggaagcttgcgtcagtgtaactatttacaacgagctcttcctgtcctccatagactagagacatatccttagttcttctcaagtatttaaggatattctttacagctatccagtgactcacctggatctaattggtatcggcttgttgcactaagtgcatatgaaacatctggacgtgtacatagcatagcatacataatggatccgattgccgaggcatatggaatcacactcttcttgttttgctcatcaatcgtttgaggacactgattcttgccaagattaatgccatgtgacatcgataagaaacctttcttagaatcttgcatgttgaacctcttcaacatcttgttaatgtatgtactctggcttaatccaattagcctctttgatctatctctatagatccttatgcccagaatatatgttgcttcccctaagtccttcattgaaaaactatttttcaacgatgtcttaacggatttaagcataggaatatcattcccaatcaataatatgtcatctacatataggattagaaacaccagtgcgctcctattaatcttcttgtatacacaaggctcttcttcgtttttgacaaagcccaacgccttgactacttcgtcaaaacgaatattccaactccgagatgcttgcttcaacccataaatggatttctgcaatttgcatatctttttagctgattgtggatcaacaaatcccttaggttgtgtcatgtacacatcctcatcgagatttccgttgaggaaagctgttttgacatccatttgccatatctcataatcgaaataggcagcaatcgctaaaacaatccgaatagattttagcatagtgactggcgagaaagtttcatcataatcaacaccttgaatttgtctgaaacctttcgccaccaatcgtgccttgtagatgtgaacatttccatctacatctgtctttttcttaaagactcatttgtactcaatggcttttacaccatcaggtggatcaaccaagttccaaacttgattgacatgcatggattctatttcggatttcatggctccaagccatttctcagagtctggtcccaccattgtttcctcatacgtagtaggttcatcgttgtctaacaacaatatatcatgttgtcctgtagttaacaacgcatacctcgcaggtgtacgccgtatcctttcgaacctttgtgaagccaatgcttccacaactggttcaacaacaacttgttcaacctgttgagcaacatcttgctcagcttgttgtggttgtgtggaccttgaaacattttccggtgtttcctgaatttcttcaagtcccaccatgctcccactatcctttcttgaaataaactcttttcccaagaaaacaccgtgtcgggcgataaacactttgccctcttcccgattataaaaataatatccttttttttccttaggataccccacaaagaagcatttatctgatttaggtgtgagtttgtccgattgcaaacgttttacatagacctcatagccccaaatctttaggaaagacaaaccgggacgcttccctgtccatatctcatatggtgtcttatgcactgattttgatggaaccctgtttagtatgagggctgcaggaat

SEQ ID NO: 13368 - DNA, 480 bp, Oryza sativa
cagggcacaccacccgcctcccagtgctgtcaaggacgaactatccggattgggcgctcctgatgcgcgtcaacctgcaggagcaggggctgtggaaggcgattgatcccggctacgtggagtttcgtgaagatcgggcagctctctcggcgatacttcaggccgtgccgcgcgagatgttgcgcgggctggcgaagcacgacacggcgaaggcggcgtgtgatgccattaaaaccatgaggatcggtgtcgaccgcgtgcgtgaggcgaatgagcagggattccgccgtcagttcgaggcgatgcgcttcaaggatggggagacgcctgaggaatttgcgattcggctcactgccatcgtcgcggacattcgtgacatgggtggagtcatggaggacgaacacatcaacaagaagctgctgtgtgttgtccccaagaagtataagccagtagcgatctccctcgagcagcttcttgacg

SEQ ID NO: 13369 - DNA, 3195 bp, Oryza sativa
  unsure (1)..(3195): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgtatgatgatagtacattgctttgttacctttttgctcgctgcctagtgctgcaatacatcgattcagtttcttgcttctatatgcttgtttatattaaatgcatgggaggaattaggaaattacggaggaaatcaattaaaggaaaaaaaatatttcactgcattttatatcttttatttggtcggtcggccacatgtgcttaataagttatgaaaatcttattgcttctacgtatgtgtatgttgtgtggatgtgataataaggttgtgatacgtgtactagcgaatcatcgtgcctaaactcttcggatattccggaattccatccctaggtcccgacattaattttattttctcctcttttattactatatctttgcgaggcaactacgaatcgggcgtcggatttttgagagaaaaatcgggtccccctcctgtgcgctcccctctacacattcattgcatgaatgctgcatgccagctacttgcttcctatgcctacatctcagctacatgcaatatccaatactaccctcactttcccctatcgatgcatatctagcttttcttaacatgtttaaattattttttctcttaaattattaatcccatatacaaataatgcaatatgattgcatagttgtatttttttaattaaatctttacaacaagatctaacataactatattttaatgaaaataattaattgatgctttatcacttataaaaaattgtttcaatttgcttcataagatgttccagagagatgcaacattcaaaatataataactgcaagaccgtcaaccattgcatatgaaagctattcacactttcacagtcggtgtagcataactcccctagtaaaaaaccatgagttaaaagtacaaattaaaagccaaaggactcacaaaacggcagccattaattaataagaacccccgctatatatatacaatcgcgagttcaccacaacttcaccccgaaaccaccatgtctccactctactgctgtctcgtcgccgtcctgtgcctcccgcgggcctccgcatcgccggtggcggcggcatccatctccgtctccgccgtgcagacccccgtcgagccgacgccggtgcagttcctgcgggtgcacaacgaggcacgcgcggcggtgggcgtgccgccgctgtcgtggaacgggacgctgcagctggatgcggcgcggtacgccggcgagctccggacggaatgcagcctgcggccgccgccgcccaccgcggcgcggggcaccggcgaccgcgccgccgtctacggccggaacctgttcaaggcgtacggccggcgccacaccggcgcggaggtggcggcgttctgggcggacggccggcggtggtacgaccgcgacgccggccggtgcgcggcgccgcccggccggacctgcggcgcgtacacgcaggtggtgtggcgcgccacgacgcagctcggctgcgcgcgccgcacctgccgcaacggcgtcgacaccgtcgccgtctgcgactactacccgccgggcaacatcgtcggccagcggccatattgacaatgatctcatctgtttctgcgacacacgacacgcaatgaaatgtagtacatacgatcgatggttctggtgagtgattgagtttttggaacaaatgtttggagaaatatatgaaacatgctccaaagaaaattaaagggatactctaagataattaaatatggagatttaatgatggcagctgcgatgaggattcaaatatgtattgtcatcggagctagatttgttcgacctctccatttcccataatcttgccgaacaactctactctctcccaagtccgacccaaacacggataaatgaactttttttacaaggttatattttacctggcctctacatccaatcggatgcatgtgagcctttttaaattggaaacttaacccctcaaaacaactcaatctgaaatttactcatatggagatttgaattcagataacatttttacattaggaacttagcctatcaaacaacccaatataaaattcgctcatataaagatttgaactcagagccttgaggtgctactcaggtcacatgcccttccgcccgataaaagaacctggtgatcggtgttgcagacaccttatcactgttgcttgaataagtaggaacaacaatcttgacaaaattaaaaaaatacattttttaaaaaattggcctttttttcttttgtttggcacaaatgcaaggtagttgtgtggtttgtagcgaatccagaaattttcttatgatgtagaaggagcagctggaccagacttggcatgggccagttttcacattgaacactcatttttcacgaaaataaaacaaaacaaaatgaaattctgatggtcggtgatggctgagttaaaaatacagttatggtaatacatcattctacacattttaagggggcaaatcacacgaattccctaccttccattatgcttctagattcattgtacgtcctctatctgttgagctccgacgagtgatgaacttggcaaattttgtacatattcctcaatcttaaataaatttggttggtctatcttgaccggcccgacaaaaaaatgaacttggaagaggaagtaggaggtgttcccgacttagagggataagaggtgaggatgagagtaagggatggtgggctggtggccatggtggagtggcaaggcggtggtaccagtagcctcgacagtgggagagaaggtcggtggacttgtgttggcggggacgtgggatctagagtggttagggcgaatcgttaaggacggggaagaaggtgcaggggcactctactactgttcggaggaaagtgaagctaggggaagaggaagagaagggtggtgggtcagtggcatgctagggctggaaggcagaggaggtggggtgatcc

SEQ ID NO: 13370 - DNA, 4644 bp, Oryza sativa
ggggtgctgcacgaatcttaaaatttgtgcgatgtgaagaggggaaataagcgatgtatagatagtatcataaatctaaaccagggacagttaactatttcccactgttcacttaattattacatctgcaaccatggaaccattgaaagaaatgtagccattatatatatcaaagctatatttggtagcttcttccttcgttacttttccctggatggcagaataggcaagcacacccagtgttaatacaggtcccatgcctgcgaaaaattctgtagcaatccacctcacacgtctgcggatcacacgccgtacccggagatatgaccaccgttgtgcagttctgcgcttggtccgctgccaacttgcttgccggcacttctgtggccaaaaaatgcaacaaatttatgtgaaaaagtactcttgaaggatatgcttgttcagcaaatcagtgttggagttgggtgcaaattaaagttacctgaactcatcgccaggatggcaagggccataagcatcagatgcccaatcctcatgaaactctgttggtcgcaccgttgagaatgggagatgttgcgcaaggtgacctgggtcccttggcttgtggatagttcatatatagtgaaatggcaaggctttggtttaatttgctctggaagttgatatttttttcttttcgggatcagttttggaatatatgatgatctttaatgtgcataattaatatggatatattcttgtatctagaaacaacagatacagttaataaataggtcatgggccactacaaattggagatatgcacatccagcttggcatttatagcatatattcatcagtgcagtcatggggccaggccactaattgtttgttggggcattttctacttcaaggttataatgaaacagcctcaaagatttaaggggctttttcgaccttttcattttcaaatcccaactaaaacagctttcattccccctggaagagctcgtaggaacaaattgtatccttatcacctaattgtaggaaaggttaatcatgaatgaattttaacatgtttcatcttacatatatcaattgctttgctccatatctttctctgtaaatattaacatcttgcattatatcaaaatatgaacatattgcacaattacttgaggaaaggtttgcaaacataagaacaagaagaggtagagatgaagacaaaaaggtctttattggtatatgggaattttgtgctattattgttgtttgctacacatcccttggaaaagctgaccatatttgtcaccttgtgatgacacatgaagcacttgctacgatgaaaaagctcttgcataccaaaaccaccttgcacagaaaaaaatggaatgtccaatatagaaatccttaccaacaatcgtttgaaaattggaaattgttatagggaaataacttgaatatatcttgagaaaatatatttaaagatcattgattcaatccaacaatgctaatatattaattgaaaatgttagcacacgaagacatatgtttcatgggaaccaaaagcgtaaatatgcttaagtggaatatatttttcataaatgactagtttaaaacattttgatgaccacggacccaaacatgagcaattcaacatttaaataatttttttggggggaatattagcaattccagccgggcttggtctggaggacacgacaacagtagtgatggaggcggctgtgctgcacacggagcaacgatggatgtggcggtggagggctagccctctagcttgggcttctgtggtgccgccaaccggccagacatatgccaccgtcactgtcatttgtcgctcaagcacagatatcggtgacgctagtaggcaccacacaccatcatggaggtgatatgtgaaatatcgatagtgacattcccaatgtcgtagcctgctacaaggcgtctcattagaggttccctattggtgcggcatccttatggcgatgtctgtgttggttgggtttgatggcaatggtggcatttggatgaatgactgatttatataactcaattactctccgagttatcttccgctttgaacgtcagtcacctatagttatgggaccgaaatttgatcggcaggagtcggccgctgatttctgggtttttgcttttctggttttaggaaaataaggactacatacatacatctgattaagttgtcgatagaaataatggttatgcatgaacaactatatatagaaatcttgatctctttaaggtggtaaactaagtagttttcttatactatgtaggtaataactgactacgagtgggctccaccggcctgtcggtgaaccaaagcaagacatgcatggtggcttgtccgtttgtgctagccattggcaaacaacagtgtggctagggtgtagtccacctgggaagggccatgagttcattgaactcatgtacacgtctacatagcagatctaggggtggtcctcattgtccccgtgctcccaggaccacctaaaaaaatcctagctcaatgcatatatatgtatatatatatgtgaaaataaaattttgaaaaaagaaaaaaaagcttctttattaatgtattatgatgcatatttgatcaatttatacttctaacttggaccatccatatatagatacgccggcctttgcatatctactagaggttgcggtgtgcaagaggaggcgagagagcgagaggggtgcagcaattggctcgatgtgggtctatggccccaggcatcattgacaagggtggatataagaagtgactgaaatattagatgtgaaatggatgaaaacatatggcaggttcttccactcatgcgctacctgtacatacattgctgttaattttactataagggcaggaggtcacagtgaacacacatggtgaacacatgataaaaattgcatagccgtgtatggttgtattctacatttaaccttactaacaaatttaaataggcaccaatgtatttgacaaaattatataatttgtgcagatggctatatggatgctacttcatactccctctatccaaaattcttaagcatattttattttttggttttttttccaattgagatggtcagatttgtagttttcatgtgcatagttaaattgttgactagaacccaagcaactatctgcaaatacttcattagtttgttacgtggaggatgagttaattcctccatgattttggtgacaaaagaaatatgacttttgggtggatggagtatttattagaatgtttatgaaattttgcattgtgctgaaatgataaatatttttttcaagtcttagctatttacatgcaaataaatttattaatgcaaaaaaaatagaaaccaggctaggataaattcataaaaggaagccattaatactcacatcgtccaaccatatcataattagacaataggctatattagattcttataaggaagcaattaatactcacatcggccaaccatatcataattagaaaataggctaggataaattcatataaggaagcaattaatactcacatcggccaaccatatcataattagaaaatagactaggataaattcatataaggaagcaattaatactcacatcgtccaactatatcataattagaaaataggctaggataaattcatataaggaaacaattaattctcacatcgtccaaccatttcacatttgtgaaccatgaatgaaaaatctttaaaaatagaggcaattaatgcatagcaaaaacagaggcaattaatgtagagccaactagtcccagtgaagaataaataaatgcaaaattttgtcacttacccccttcttttatattaaaattgaagataaaacctattggcttatatgtcagtgaccttatatgactcatatatcgatgatataggagggtatgtccaagaattataaattaagggagggtgtatgaccaaatctttcataataaattagatgtatccgaggcatgttgaacatgtttgcctttcttgaaagcataaaaccaccccccctcccctttcccacctcacatgtcccacctcttccccaccccatccccttctcctctcacttcagatcgacaaagagttctatatagtagagagagatagagagaaagctagggatattgagagtctgacatctgaaaattagctatttgaaatctagagagttgagaagttcaggagagtagagggggagagaaccgcgtaatcagatggcttcgtcatcaaatccatcaaatcttccctgctctagtgatggtgtatgcatgttatgcaaggtgcttacaacagaggtagagcagctgcgttgtagcacctgtgctacgccatggcatactccctgcctctccagcataccgccccttacagatgtggcccactgggtctgtccagattgctccggtgatgtcacagccagctacccgccatctgatgttgttcgtccggagagcagcctcatcgctgcgattcgtgtgattgaggctgatccggtgctgtccatccaagagaaggctcgtcgtcgccaggaacttcttggccatgccggtgatgcaggggctgcaataactgaagctgttggggaaaacgtagaggaca

SEQ ID NO: 13371 - DNA, 2697 bp, Oryza sativa
ttatattatttcctatgggttgcttccgggaccatcacaaaaaatcaaagccatcacagaaggacgttcttctggtaatgcacggagaatatatgtagacctctatatgttgcaagatattatttgttccattattgttatgtaattatgatacgttgcgaataactgtactcacacaaggttattgtcttttaaggctttcagtgttacgtttagtatgtttccactacatctaatacgaacaatcttgtttcatttctttggaaaaagtaatcccaatttttgtttttgtatatgttgttctgtttgtttattaaaaggtcttttaaagagaagcgctcaccatatgctccagagtctggtgttaggtatgatggaatctataggattgagaaatgctggaggaaaactggagttcaggtatttatagttttcatgaaacattacagatattttttgtgtaggctgcaatgattttttttttagatttacaaaactgaatgtatccaaaattatagtttatcaacttatcaatataagtgatgattgttggagtttttgttttttggcctcagggtacattcaaagtgtgcaggtatctctttgtgcggtgcgacaacgagccagcaccatggactaggtttcttatacatcccttatctcatgtatacattgctattgttattctatttatttacttttccatttaattttctatatttacttgaagtgatgaacatggagaccatccaaggccattaccagatatcgaagagctgaaaaatgcaattgatattactgagaggaaaggaaacccagcatgggattttgatgtaagttgttgtattatgttctcagaaaaaatattagcttgcacatattgtgacatctcctttttcttgttataggcaacagatggatggaagtggatgattactccacccatcagcaggaaggctgtcgtaactggagatcctagaggcaagaaaatgcaaggagcagcaaggcatacaaataacttgtcaatgagagaaaggctgttgaaaggttttttttttttttgtctatgaattgcagttcatagtagtggctgcttggcattgcatttccactgatttcagtcatatattttctttattatagaattcagatgctccatatgtaggaacgtgatggaagagccagtgacaacaccgtgtgctcacaacttctgcaagaaatgcctgcttgggtcatatgataatctttcccttacagaggagagaagccgtggtggtcggaccctccgggcacgaaagattgttaaaaagtgcccttcttgtccaagtgatatcgctgatttcgtacagaatcctcaggtacagtaaaatagtagcaaaaattaattttgtatagattttagtcatttttttgcgagggatttcagtcatctttcccattcttagatgatgtattctttgttgtaaggtaaaccgtgacattatgaacgttattgaatcactccaaaaagaagctgagaaggaagatcatgctagggtgagtggagaaggcagcagtgcagcacttgtagattctgatgatgaaaatgacactgcttgggagaaccaagatgatggtaatctggatgagggaggttgcaacaatcctgaggacatgataactgaatctgttgatttgaattctgttactaatgttgataatactgaaaacaaggtggaagttcagcagcctcacaagcgtaccgccggtgccgggaaggggaaaggtggcaaatgggctaggacaagctctgcaccaggtgatgcagatgccaggaatgttgtgacttcaactgaaacattggatggaatagctgctgagaatgtggctgatttagtacaaattgaggattgcactttcactggtgtggaaagagccgaccccaatgcgttagaagttgatggcaagaatatgattccagacttttcagaagctgagaaagttaaccctaaacaggatcaagaagttcttccatgatgtgtttccttgcatacttgggatgtttaaaagtttttaagaagtagtattatcttattatctttggtgacattcagattgggatgatatcatttaatttgggaataattgaactcatagtgggggtgcaactttcacttcctcaggttcagacattaagctgctgcattattgaaacttgaaacatatgcaaattgcttgtgaagttttttttgtattcttcctcttttgttatccctttttctttgattatatttttttttgcttgccctgtttactttgcaaaaactagcttggactgaaatgattcatgggtcgtgaaatggaagaaatagtggtgatatatattgttgttgcattgattcccagtttctttcacggtataatgcagtggtggatttaccacccggcttgggcaggcagttgtccaggctatatgaacgcaaactatcaaactggactgatttctctacggtaaaatccatggatttaattacttcctgcacaaaccaagtagattagatttaactactctagttgggctgtacaagcagcaagccttataggcttacagccctgtagcatgcaattgagccctatcacaatgaataacatatggcatgctcaagcttatacgaatcatcttgtctttcaactattgaaaattttggctgcaggaat

SEQ ID NO: 13372 - DNA, 9341 bp, Oryza sativa
  unsure (1)..(9341): unsure at all n locations
agtttcctcaaggctgtagtgctccaaagtgagtacaaaaattactgtgtgatggataccatgatgattgatgagcttatgataaaaaaaatatcgaaattttacagtgcatggtttattggttttgggtgcagaaatttggctgctattttattcgaatttctattgagcttgattgttttgactgaattaattggggtaccaactcaagtgataaaatcatcaatcttttattgcaggctattcatgccacctagtatttgtgttggtgtttccataattttttcaaacattagatggcatttaatttatttttccaagttaaaataatgcatgcaaatgcaattaggaatgcgagaaaaaaaaacagccaaaaccaactaaaagaacatatattcaaaggcaagcatccacagctcatcatactgttttgaggactttgtttcggtttcttacattaagagtgaatttaaactggatttgaaatgtaacatggaattggatggttttggtgatattccagctcaatctatttaatattaggatagtggaccatgttatgatgtactccataaaatattcacatttcattccattggtggttttgctacggaataacgaaaaaaatcattggtttaaatcttaattgaaaattctaccgttgactgagctaaccctatcttgaataaaataatatttcttctgaaaactgttgattttcgtttcgtacgacaagtttagctttatctatgatcaaattttcctagtccgatatgttttatagtgtatcccgcacatgaaggtcagtaaaggatgtttgctttttaaatgttgttggtatattttgatagctctagaagagttagaaaatctatttgtaattaattttattacttgtaatcatgacaataaaccttgatataacaaatatgagttttatattccctcttattttggttgcatttaatgcggttacttggttgaattatttgtgactgacgtttgatttatctcttcttgtatgtactattttgaaactcttttatgcaccggaatcataaaggaaagcttatataatatatttcaacactataagagtaatttaacatcaagagctaaaacttgggtaagttataatgctcaccttcattgagtgaaaccattgccgctataaagatagccaattttgcttcacgacattcaaagtttatataatttactggtgaacattgaaaaaaatatccacggttagaggagacgtcaaaactaataatttgatggaaaacatgcaatcaatattttattattttttcaccaaaaggatagagaaacccattataatgataaatttgtccctcgggccaacatatgttactatgattggtttggtcgaactagaccaaaccaaaccaggcctgagtatattttgcaacctttcccccttttttaaaaaaaataggttttcattttttaccctaaatatattgctaccatatatcatattccttcttcattctagagatagcttagaagcttctagcccgaggggcaatatcgtccttttgaaatatatctcgccgattggactggaaataacaaaataatggatgtggtgtcgacctttggcaaattaccagtttttgaaggtgttctcccaccttttgctatgtttaccaacaaacaagctatgtttaagtgacctgtgtcaatattttaccaaatgataatgacaatacctataactttcacttatacatgtaacttgatctatcacctatgtctgacagttgagaagatggttaggagatatgttccatagaataatatactgatccttctcttcatgggccaatcggcctagagtatatatgtgccatcatctacttaacaccgtcatcaaactcaagatgagagcagaggatctgaaacattgaatttgagcaagtgaagttaatgttatttctcaagtctatgcattaggatgctcatcagaataagcggttctcaagatctttataaaaaagcatcaacatctacaataacaaataaatgcactatcaagacataatattgtggattgaatgaaactaaattgatgtatatattgatgcacttatttataaactcagttaatgttagaaaacaaaatgcagatcacctagcatgatgaggtctactgcatcctcatcaatgcccccttttgtgactaagaagacgagaccattcaacatcccctttttatcttatgtgtgtctagacagatgtggttctcccttttgcatcaagttgtcccttgggctcttgaaccacaacctgtggttgtgaactttgatgaatggtggaaccgaatcaatggtatggtttgtgcaagtaccaggaagggtataaacaggttgatcatgcaaggagcttggtctatatgaacgattgcgtcttcaatggagtacctccaagattatcagccacttgtggagtttggcagggactaaggggctttctgtaattatagaccttagctagggccttttatttttaagttccttttggtcgtgtaacaagttcgtgtacttcttagtgcttggtgtgtttggacgccttatttcttctcctattgacgcaatgatacgcttcttgcgtcttcaagaaaataaacttagaacaaaactatatgacttatattataaaactgagggagtactagttaaatagattctattccaccatgaatacaaattgccatgcatagcatgacgaggtctactgcatcctcatcaatgcccccttttgtgactaagaagacgagaccattcaacatcccctttttatcttatgtgtgtttagacagatgtggttctcccttttgcatcaagttgtcccttgggctctttaaccacaacctatggttgtgaactttgatgaatggtggaaccaaatcaatggtatggtttgtgcaagtaccaggaagggtataaataggttgattatgcaaggagcttggtctatatgaacgattgcgtcttcaatggagtacctccaagattatcaaccatttgtggagtttggcagggactaaggggctctttgtaattatagacctcagctagggccttttatttttaagttccttttggtcgtgtaacgagttcgtgtacttcttagtgcttggtgtgtttggacgccttatttcttctcctattgacgcaatgatacgcttcttgcgtcttcaagaaaataaacttagaacaaaactatatgacttatattataaaactgagggagtactagttaaatagattctattccaccatgaatacaaattgccatgcatagtttccttgtttttgttgagaatataggcatataatgatttaatatattccataaataaatcatgacattacagatgtatactagcattaacgcatcattagatctacacatgtaaactaagcaataaaacatgaacagatcaaatatgcgcaacatatcgaacacgtaccgagatggcggaaagaccggttgctcggcaggaactactcgcggtagcgagcgtcgacgaaggcgcgcaggacgcgagcggagaggaaggcgagccgttgcggacgaaaagggagcagtcgcgcgaagcgcttcccaaaaaccttattgctgccttctcccggtgcaggacgtcgaaggcagaggttccggagacctgctctcccgatcgccggtgcacgctggcaagcgggatggagtagtccacaagcgacggcgcaacacagagtaggaggcaaaccctagattgatttcgtgtattttgcgtgaatgcggcggctcggtttatatagagataggtcgcttgatcagggcgcccggacgatctccattccgcgtaaccgaaccggataagtcgcgcgtaacttatccggatttttcggaatgtttccaaaacaaaacaaatccgaattttcgccaagggtgatgagccaattttgtggatcattcgacgcgtaacatcgtgcacgcgcgccgcaaggtaggcacgcgcgccgcctgccctaccttgccaggcgagcgagcgcgcgtgtgttccccctcttctctccaccacacatgcttcaagtggctaggagggcatcctcccttttaaggaggtccccctctcctagaataagcaaggtggtactaaactccacatgcatgccatcccatgaggtgggcttttgtgattttccaaagaattaatcttcgaatgggtcttagcccatctattaattccaacagttttcaccatagttgacagtaacatttttccatggacatgctcccctaccaccatcactgttgaggcagcattgccaatcaaatctgatttcgcattgaaatcaacattagccattgatattaatttatttacactaatcagtgtggttttatggtgtattgttaattgcacatcagttcacaagctagaagtcattaaggaaacactctacactatttaaaatttatgtgaaaaattcttcatagtgtgtgaatattctctacttcacagtggtgtacattgcaaccaaggagtttctatattgggccgacatcagtttattaatcatcatacatagttttcacaagtatcttcatattttagtactttctagctagcgttgggttggaatccattaggaacccacctctcgaactcaaataatagcaggtatcagtacacaaagtaattgagggttggaagaaccaaagtactttatgtacagtagtggagttggtgttagaagatggaaggagtacaaggccaaaagtttgttcaattcctttgaaaaagcagttgttgttgcctttgttctcttccttgtgcttgcttgggccagccatagtgagttaatacaacaactcaacttgtattgacctgttgctagccaccggtcctagcaatcccctttgctttaaattcaggttgttcccaagccaataagttgaaacctcctagatctaatgactgaacatgaagtgtcatggcataaaaagttaccttcacatttaacaaatcactttcatcattccggccgggtgatttgcttccaggcatggtttcattcatgatattatcataaaaatggttcttatagtccatgtctccactctgcttcgtgctaggaagtaggaacatgatagaagtgttgggatattgatttgtctttgcagttacaacccattttttatagcgcaatatccgtgagcatattttcagcaaagcatcacaattgcatttaggatatgggcatagtgttgacttcatttctcctgtgatgtccctttgcttgtattactcccttccttccatttggacagcacctgaacaacggccccaaaaattcagtggatggtaactgcgaagcaaaatcaagatccaaacacttttgcatttcctgctcaaagctagcatcaattgcaatactcctattttcgtccactcatttcaaatctatatccttgaaattttagccgattccttctatgcccctgaattttcttcactcctttatatacctctgaattttgatttggatccctttcgtacccttgccatcaattgaccattagttgaccgtttaataggtatagaaaagttagttttacccttcaatatgtgagaaataagtagaaatttgtaaactgtattgttggaagtataaaatttgttgtgtgattatcatatgcataagtttgttgtacataaaaaataatatatattaaaaagtatgtgtagcactttttaaaatgataaatatagttttggaaaacattcctatataatatatacaactggagaaaatatgttgaactatcataaaaaaaagctacatatactgttttaataagtaaataaatattagttttatgtcattatataaaattaaactttttcataaaaaatacctggtataataaagtcataaatataatagtcttatattatatagatactatactacatatgaggtgtaggcgttaaaacacaccccccgcagcaacccccccccccccctcctcgtatagtaatcgtcaactgtggccccaccccagaaaccgcccctgcttcttccccgcgctctccattattttcggatctagccctcccgtacaccgcagttagccaagccgctccgcctcgtttccatcgccgccaccaccgcctccccgtccgcctgccgccgccgccgtgtgggaggggataccagacttgggaggtgacggcgacgaagcagagaaggcgcccaccctctcccctgcggctgtggcttgtgctcggggatggatgcggcgacgggcgacggcgacgcactgcggcaatggcgagcgacgggctcggcggggctgtcccccgctcgaatccggtgacgacggtcgtcctccgcccggatccagtggcggcgggcgtccctcgcctgacctcgcacggatccaccggcggcggtgggaggagagcagcgtgcggcaggccaccttgcagtcctctcctcctcttcctcctcccgcttcttcctgcccgctgccgtcatcgtggttgtcctccaccagcttgccgcgtggccgccgccgtctgccgatggacgtcgactctgacccggccgccaagggcaagcccacccagatggacctcgaggaccaggtacgccgcagccgctcgactcgtccccacgggaattcttccttcagttttttattgtgactgcctaagcttggagagcatctcaatttctgttgaaacacttcagggaagcatttagctctcagagcattcatgagacttccatctataatcctactaaacttctggctggttcgttagttctatgtgatctggatttggtttgtgtaacactagcatccattgatattctgaatttttcaggcttctatacatctacaggtttctgtaattgataggttaagggcccctttgaatcacagggtagaaaaaacattggaataggaaaaacacaggattctgacaggaattaaagtgtaaaacagaggattgcaaaacacaggaaaaacacaggaatggtcgtttgattggagcgcaggaaaaacgcaggaatcggatgagagagatagactcaaaggaaattttccaagaggttggagctcttgctaaatttcctccaaaatccacatgtaatgtgccattccataagaatttcataggatttgaaaagcttcaatcctttgaatcaaagggccaaataggaaaatttcctataggatttaaatcctatgaaattcctatataaattctttgattcaaaggggccctaacaagcttttctaatttatttattttttggtgattgctgcttttgctggatcaagcatcatgagtgaatagtcctgatagccgagttttttttttttttgcaacgcatgaagaaccatatgctctcattttaattttcatttgttcagtcatgaattgttattgcaatatattcagaaaagtgctcccatctgaatttcatttgttcagtgatatatttgtgtgtgcaatatttggaaaactgccaatagcatcatcatcaggttctctgatattttttataaataaaaactctagaagcttgattcaatagcagttcactgaaattttgtggttcaacagagcatatcaattgattttctctgaactgctctctacatatgatcctttcgatcatagtttttcgctgaatattttggttgaacaaagcagttgtagtcccctatgagcttctttctgctgtagatgtagttcatgttctgatttttttttttttgttgatgaacagatttctcaattttggtctacttgatttttcatctatagactacaggaatgctctgaatttgtggagttttctgcacctcagctgacgatcatgggggaggctgcaactccagagaggcaggaggatgttgtccaggtggcgggtcacgcctcgtcgacagcatagatcacacatgggcagaggaagctgtggatagcatgatgggtctgctagctgcaaggttcgttgggttgcagctgagctatgcatttttttagctccttttatttttctcaagcaattatctttgtggttcaacaaagcagatcgatacatgttttcctcaactgctcaatgcatatggtcccgttgattaggctcttgattttcttgtaaaaatgcgtacaacctgtcaatccattgaattttctgcaattttatggttcaacagagcatatggattcatttttctgaagcactcactgcatatagtcatgttgatcagggtcttgatttgttctacaattgtgtagaatctgtcgatccatcgaattcttttttatactgctcttgattttgtacagttcattgggtggagctttctcttggggggtgcttttgcctgccatggcaaggccagcaagatgggatgaggcttcagctggctagtgaggatggagatgaaatcagaaatttactacctgtgagctgaactcaggatttactgccttttgtagttaataatcagcgtcgtcggccctgatctacgttgctatattagtgctggcatcgatcggtattggcatatgtattagcgggtggtgttgatttgattttgtttattagttttgtgtttttctgccgatgtatcattgcgtgcattatcagattgttgatgtaacaccgacactggatcaaacaattcatgtttgtaaagaaattattaaattgtggttaggttaataatatgaatcataattttttaccttcatttgttttgtcactaaatactccagcggccttgtgcaatctgcaatatatttactcctgtatcaggactaacttattttactaagagaagtccaatgacgtgcaaatattaatttatttactaagagaagatttgcaaaccaattgggagtactaatgaagagctgagaacgatctgagagtaatttatttacttaaaggagtaaccaaattgggaagggctgaaaataacctaggagtaattcatttactaagagaagaaatcaatttggaagtgcggaagtgttagtaactcatttactcttagaccgaaagacacaataatattgttactaatgggccaatcaccaaaaaaggtgcgggaggaaggaaaaaaaaggtgcggggaatattttgatagtaacttgtttacttatcgaacaaaaacaactgatagtaattgatttactgaacgacagaatttgtcggagagagagggatgagggagtttgtgcaggatggatgtgggtggggtgatgcgggggtgggggggtggggggtggnggaggg

SEQ ID NO: 13373 - DNA, 24626 bp, Oryza sativa
tggggcggaggggtacggtgcgtcgagcgttttagttataacgcaccctgggtgcagtttagcgcgtcccagtcttatataacaaaattatacacttccaagagtatagctagtctacaatttccagatttccttcatgtctaagggcaaaaaggtccttttcattgaaattaaacattcaactaatggaatgagtatgaaagggatcaaaatcaaaattcaggggcatacaagggagtggacaaaactcgagggcatagatgggattggctaagctttcaggggtatagaagaaattttctccaacactcccttttatagcttgaaagggaaccaattagaaacttgcttgttgtggtggagggtatggtcaaatcggttgtggccatggtggcaccaattgttctgtggcccaacatgagttgaatctggccatggcgcatgccacaacacccatcctcgaaccacaccacctaagtaaggaggtggccatggatttctcttggttactccatcaacaacttcttgtcgtctttggtgcatttcatcgagcacttgtcagacatctcattttccacactgatgacggtgtcaagcttcagcccatgaactccatcaaatctgtgattaccccccagaggcctagccatgagaaggaatgaacctactacaagcgacggtgttgacttcaaggcccattattaaacacggcataagtgtgttctggtttatgttagcaattgatatcggtgccaagttactcacggattggatgaacacaacaatgtctttggacacacatgccttgttttagaacaaaaccacgacttcacacacatgccttgttttataacaaaaccacgacttcatcggtaccacccttgacgtcgaggcccaacatcaaacacttggcatccgtctccttggaacaatcaggggtttcaaggtcagggttagtgtcgaggctggtgcatttcatcgaacacttccaaggtatgactttgggaaggtgcttggtgacaatgtaggtaacgtgatccttgtccttaccatcctcaagctccaaggtgacaattagaacggtatcctcgttgatgggcttgaactcgccgtctcctatgtgacgttgttattggggcaagccgagcacatggtgggttctataggaggcgatgccatgggtggttgagatgatgccaccttgaagatggccgtggtcgggtggtaatatcctccatgattgttgttcttcaccgcatggactttctccaacaatttggttatcttctccccacggctaatcatggtgaacatggggtggttttggcagagaatttgtttagcaaagaagaggttgtgataccaatttgttatgaacccactttgccaacaaaaatattaataggtatcagtacaatgaacaagtgcttgagggttgaaagaagcagttagtggggttggagtaggtcagtcaaaaaagcttgagactcatgagctgctcgagctcggctcatctcagacttgactcaagctcggctcggctcagctcaagcttctcacaagcctagatgtatgtttattttttcttttatataacaaggtagtaggttaagaataaattagtgtatatttatgtaaaagtaagttttttttggtattatatattaatcttatgttcttctaacatttttctttagtattgttaacttaaaattattgcttttctaaaatattaacatcaaaatatgcattgacatatatactcagccaaactcatgagcctaaccgagctcaagttgaacctacttaaaagctcgtaggaggattaggctcggctcgagctccagcctagacaggcaggatgactcgagctcagctcgttgacagccctaggttggaggtagaagatatatgggcacaagactagaaggttctggaaacttttagaccatgtagaggaaggagggtagggaagtagatcagcacactagtagaggaacgatttttccgtgcggtcaaaaatgatttttgtgtgcggatcttcaaaccgtctggaatgaagtgtccctaaaaatcgctatttttgcatgcgggtgacgcacccgcacgcgaaaaatctgtttttcatgtgcggggtggttatgtcgcccgcacacaaaaataaaaaaccgtgaaaaaaataaaatccaaaaaaacaaaaccctaaccctaaagctgacaccgccgccctcctcgcggtcgctatcatcgtcgtcgtcaccgtcgcggtcaccgtcgtcgccattgccatcgccgtccgagcccgcctgctgccaccaccaccgtaggatccgggcgggggacggctgccgtcgccagatccgggtggggggcagccgccaccaccggatccgggcggggggcggtcatccaccgctgcgcgcatgcagccgagcccgccactcccggtcaccagctgccgcgcgcacgccgctgagccacgcggtgctgctggccacgcccgacgttgtgcgtgcggaccatgcctaggagtgagagtgagagagaggtgagagagtgagagaggatagagaggtgagagagtgagagaggatagaaaggataaggatgaggatgggtggacgagatgaaatttttaagtgttgaggagtgaaaagaggaggaaggatagatttgtaggcaggtctttattaagaggccagtacgtgaaaattgattttcgcgtgcgggcatcttaagggtccgcacgcgaaaatgggaggccaatttttgcgtgcggacatgaaaacgatccgtctgtaaactaaatagctcctcgtccaggaaaatcgtttctctactagtggcaatgagccaagcctagcctctaggtcgccaccactgcaattgccggattttgctatttgtttgatacctccaagagcatgtattgttgcctttgttctcttccttgagcttagttgggatagcttcactaagctgccgtatcggcccgttgaaagcccactcgatcctatcataatcttgtgatttgcattccaaaatatcagttattgcacttcaaagatttctagttagtgttttgggatgtatgtgcaaattggatctagaacaaagtgagatatgcaggtaggcacattgaactgttgggttttgagaaagtaaaaccatcattccaccactttcttatattcaccaccacaagaaacttcatcctgtaccttgcctggacagtagacactaaagctacaaatgttactagccatccgtcttcaccaatttccgtcactacttcaaaatataaattaacaatttgaaacataatggtcacaggataacattcaggagtttctttatttaaaaaaccatgacattcctgtcagacaataccgccacatagtttttaaagttcctcatagctccatctacgacattgtgcaaaaactcgctcgacgcaatgaagagcctctctacacatgtgccacacacactttaccaggcaatcaaaaagtatgtggtcactagtttctgggaatccacaaatgagagagctgacactttcatgaccttgctgacctctttttttttaaaaaaaaaaaagttaagttgagcacattatgtcttcattggtatagaaaattcactacaaggcactaatgaggcacttttgaaaataccactatagtattgtaaagacatttgaaaaatgcttctgtagtattagaaaaatatttctacaagatatttttgttgtagtaatattctacagacaccacgtggtgacatcttctgcttgaaatgttttctaagtggaattgagaatcccaaagagtaaagtctatcaccggtccctaaacttataccgttgtgtcatcctggtccctaaactcgcaaatcgaccgttcaggtcctcaaacttgttcaattgtgtcatcccagtccctaaactttcatatcactcatctaggtcctccaacttgtttagttgtgtcaccctggtccctaaacaggacggtctaaaaattttgtattaaaaaataattcataacttttttatgtgaactctaatgaagacaaactttatattaaaattgtagcccgcgacacgacctataaatttctagttgaaaagtttttgaattaaaactgtttagggtcccaaaatattgttgcatgtttatagattttgaaatttaaattttaaaattacattttgggacaaaaaatgacttaaaataaaaaaaaatcaactttataagttgtagatcgtgtcgagggctacaagtttgatataaagtttgtcttcattagtgtgaggacgacccaaagcctaggtggtgcaacgctccaaggcatgtcagcgcgaaatatctggatggatggggtctcaaataaagcccaaataaatacggtaaccatccaacctcatcgcagaccctaacatgtcttgaagagtgcactacataggctctaagccatcggatatgaaatagaagacacaaccgttggaatagccacaccagtcgtctacgtcatacgcccgtcaaccactcgatggtggcgaccaaaagcataccccaaagactcgatctcaacaaaggcatattccccggttatctcaaccatttcaaacccatcctcatgtgggactagtcgcctaggaatgcaacatagtctcacataaatcatctcaagcatgatatccaaataataagtggttctaagcaataagcataattagtcttaataaggttctaagtagtacttggcgacaagccataaatattggttcatgcggtaagcgtgctacccaaaagcacataggcaaaccgactaggttaaatccctagttagaaccatcctggaaatctgcaacatcacaagctgcatcaaactcctcatccaaacagtcattacctgcataggggtctgagcaaaaacaagtaaaagaaagcaagaaatcagtacattaatcaaattaatgtactagcaagtcggaaacaatcctagcatactacatgttggccatattcaaggataagctgtgtataggttaatttgcataaataccaattttagttcacaacattttccgcaacggaattttataacaatagtatagagtaagtaaaacttaaatgtaaatggataaataacacacatctacccctcaaggtagatcatcaccactcgccatcatctcatcaccattcaccgaactttacccaagttcacaaacaaaacattccaaccattttccaagttcacaagagtttatcaaaatcaccaactatactcatgacacttcaccatgccgctcatgaccgtgagcacggctaatcgattagttttagactctgcatagtttgtacaacttttaagcccacatgatatgaatcgctctagtttgtccgatacccgtcggtatcaccacactctacacattgagtgtgatctagaggtcataacgaaaccgttacattgtttattgtctagcattgcaccagcacgatgtgtgttttacccacgctactagcaaggtagcgccactaagtagcgggcccacgctttaacctagcgccgtaaggaacccagcccggaatccctcacgaggcacgacaccgttgtattggacagactacccgctcaaatcatcacataccacttgtcattaatcaatttcatcatatcaccaaccataggaagttccgataagttaccaaaacccggtaacccatacccttcggcctaccaagatgcaaggctaaactctaaacaacttaataggttgaggccagcccatacttagcacatgtgatttgtactgttttcattagttggtgacatagagtggggtccttaatcgacccgggcgaatgctccccctatcggtgtacaactaccaccatatgtacaccactcgccgcccaagtctaaaaacaagttatctccattttcagttcacaatactcacacatttaaatttctgtccagcaacatcaaaataaccattttcatatataacatttatcaaaacgagtaatttacaaggcggtaaccgaatataagcatataacggcaatataagcatagtataatcccaaagaacacaataattttattcaaaagcactctatggttacaaccagcaaggattcaatatttcaaggtggattatgcagcaattaggtcatatctaccattcccacatttatattttttttttaccaaaagtaatactagctaacatatgcatgtttgcaatagaatcatttagcccaataaaacataggatcaatgtggtcaaaggaggggcaaacttgccttcgtttgcaaactcctgaacctggtcgtcaacaaactcaccctcttctccttcgacgtattcttcctctatacaaaatatgcgtatacgataaatacaaaaatgcataaaaaccaaaatgcatgaaacttatgcagtgagtgtgtgctggtctcaggtggtctctggtgaaggaatttttattttgtcactttttatttacagagatatgcattttacaattaaaaaggtttaaaaagggctatgttttattaagcaacttttttgtacagaagtgaacaaaattcctttttacaaagttacagagcatgactttagaaagttaacagaagtggtttcacaatttttagagctatattcaatttgttatggatttaacaagttctaggcaacatttatggcaaaacaaaaataaaggaaaagtttgtatagaaagtacccagttttattttttaaaaaaaatatttcacagctttatggatctaataaaactggtttcacaatttttgaagttaaaatgaattttctacaaattttagaagttctgctcattctctgcttgaaaccaaaatagaaatcaattttcgaaattgaattccagcagggtccacaggtcagtgaaaggagatttgcagagaggccctcggaagttgggggaatcaacccgcactccttctaccacctggacagcaaactttcttaagagtccctattcttttgtttatttccatcaaggttctactaatatgattcatggcagttttcagattggaccctagtgtcgatcagattcaagaaatgaagtccccagctagctcacatcgggaacagcaatggctgagctcggtctacggctcacctgcggcgatcggtggatcgaatcggttcgagaacaaaagagaaaatgtagagaacgttcttgcgcatccgtgagtggtggtggtgagggaaatggtggtctgtagcccatggaacatgagctacagcggcggtgtgtcttggtatgcccatgtatgtgcatgcagaggcttggatagtgcaaaagggttagtgcatgtgctctcatatggtaccagggtgctcaccaagcagagaaacggaggcagcgaggtccagggagcggtggagacggtggttgttggccaacggcagcaaaactccggcgtcgacgtcgccggatcgactcaaggcgcgaactgcaacttcgagagtacaggggtgttacggatgagccacagagggtgcatgcgcgaggaatccggcggaaactcaccggagcttggtgttgcttcggtggtgaggaacggcggccggagcggcgtcagcggttcgggtggccggcggcgaggacggtgacgcccaccacgtgctcgacagattggcctagggcaaaacgggtacgggtgagctcggcgtgatgcgtaggtcatgttccataggagggaagagagagggactcactggggatgcacagcgacgatgactaagtcgccggagccggggaagatgaccgagctctgggcattctgggcgtggggtgtgttttcttggacttggaacgcgatgtggggagtgtgctgttgcttctggtgctttgtcttgggaaataagagcaggtacaatagcaggctataagccagctgcaaatatattttaagcagataaatgaggagagagaagggcagcgggccacagatttgtagtcagctgtagcacggactccaaaacgcagtgtgtgtatgacaggtgggaccatatattaatagtgtagtatgtaactattgtatgaataagctattagattggctatagataaattagagctagcagtgggctatactattgaacttgctctaaggaagagtggagtgggggagtgagagagagagaggtggctggtgctctcattgtgttccttgggcatccattgggcatgggggatggtggatgctgtgaggggagagtgggaggctgtcatgtgggtcccagggggtgtggggcccaccgtcagtgaaagaaattcgaaaatagccttggaggcaaagtcaaagagggttgcctgccaaggatctttggaggggattcaaggtggattttgtgcagcaagaagcctgggctagagatcctcttggtcgagggtgatgtggagagtaaatgtgctgaagtggattgggttagaagtctctggtttaggtttgatggagggatgaacatgggttgacagtgttggttagcagcagttgatagtgcagttgatagctgattggatttttggagggagggaagaaagggttagagagtgatccagggtgttccactccttagggtgttagaagaatgttagtagaagacctgaaaccaaacttcaaaaagagattttgaaataaattttacagagagagcaagtttgaatctgctaagcagtttttcaggattttggagagattaaagtagatcaacgagttagcaaaccttactgaaaaactctgaaaatttgtgggttgatttctgacatatcaaggtatttttgagaatttttgtagaatttttggatgcatataattaccagattaattatttttgtgactctaggcctatcattgcatatgatgatgagatgattaagatccaaaaacaattaaaatcactccacaaccacatgatgcatttaaattaaatttagttcttaggtttacaggcttgggtatgttacaattagagttcacatgaaaaagttatgaattatttttaaatataaagtcattagaccgtcatatttaacccagataatattcaaatccaagtttagagaccggggtgacacaactgaacaagttggaggacctaaacgagtgatctacaagttttgggaccgggatgacacagtcaaacaagtttaaggatctgaacagtcgatttgtgagtttagggaccgggaagacacagcggtacaagtttagggaccggtgatggactttactcaatggcaaaataacatgtgccatttactgagcacctatcacactaatattcatgctacttattatttttgtggatgctgagaaatgagttagtggggatgaactatatagtctatatagattcgaatttatgttggcatcatttattattttccatgatacatttccattgaaaaactagacaactgagacttattataataactcggggttatctatttgtaaccattaaccctgttagttcaacacatttaacagtaatttagctgcagtgtgatttattttttgtttcgctttatattttcatgtaactaaattgtcccatgaagataaggtggcttaacaaaatgcataggaatatgaacaccatttatgcttgtgttttagaattttgtactttcttgaacataaaattccattattacctgcaaaaaaataaaattccattattacagtatccaggtccatcaaataatattttggtttgcttacatgtattctacagacaccatgtgtccacaacttctgcttgaaatgtttccaatggtggactcagaatggtaaaagagcttgtgtcaattgctgagcacctactacactaaaagtggcacaagaactaagaattgactcagcactagtccaagctatccgtatggccaagggtgtaaacagtgcaagttcagctggtgaaaaatcagtttatcgttataaacaaaacaaagataagtctgataaaactttctctactgaatgggataagagggctggaatggcaatgcttctagtggacaaatatttgtgactattgcacctgatcattttggtccaattctcgaagaccatgacccaaaaaggaacctctgtgtttgagtggggaaccattggaagaatgtagatagtggggtgaccattttcctcataacactaggaccgccatccaatctacacatgcatggtgctcaattagtaaccttataatacaatgcagaaagtgaggtgcccattttcctcatgttgccaggtgccaggactaaggacagatctacacatgattctcaatcagttgccctatcaagagattatttggatgattaatatcatgtagagtggttcctatatactggaaggtttagtgcatgcctgacgttttgtccctgtggtcagtaaccttaatgatataaacattttaagcaaatagatatgaagaggatatatctgtagaaggaaaaagttgtgtgaaaaaatgatcatgtgtgtaccacacaaatatatattgatatttctatctttttaaataaaaaaagatattttgcttggtgaagtcccacaaaacacttctttaaaataaaaacgtaatgaacaaaaaaacatcttaattaatttcgcatagcccatcagaaacaaaataaataaaggcatgtttatgcaagattcttttgaaagtataaaagcacactagtgaccccatcttccacatcatacacaccctgatatctcccacctcaaatagacgtatatatatagagagatcattaagaaacaagtaagaagagaagtaacaaatacttcctccatcaaataaaaaaccaatccagattcattcctaaaagttgattctttttagtacaaagggtgtagctccctgaaaccgttcacgccatttatttcagaacttatgtcgcactttggtgcacgctgctacctctctagtctaccaccatcacttactgatgtgtggccgatatgatgatctggccatgcattgctctagggacattgcaaattcatctgattttgctagcgctgagagcagctttgtcactgccatccatgtgattagggttaatcagacattgtccatgttggagatcaaagccgtcaattgctgaggcttcttggtgatgccagtggttcagaatatagctaaagctcatgggacgatgggagcaccagagaggacagggacaacaacaatcctgcttgcttgctaacaagaacatcaatgggttcctctacatgctgcaatcggaacaacccatcactgccctttatatccggccgttatatatcctccactttagcaaaaactcgctcgacgcgatgaacaacctctctacacatatgtccatcacactataccaggcaatcaaaaaagtttatggtcactagtttcagggaatccacatatgagagctgacattttcatcaccttgctgacctctttttttttaaaaaaaaaagttgagttgagcacatgtatacactacaacaaaaaccttatatattgacacttttcaagatacaatttacaatttgcctttaacatttagagctatatagtctagagacactttaaaatttgcatcttccagcggcattgtatatttgtataggcaattaagaatttgctgttgggaatagtcccacattgcttatctagggggagttgaaccaacttaaaagtgaggggagcccctcatctcttgagctagcttttggggtgtagcaaggctttctcccagttgggccaacgtctcccggttttgggccaacaagtggtatcagagccaaacccacaatctctagtgcttgtgcactatcagggtggtgtaaacccaaagcccagtggaccgcgggtgtgaggcctgtatgtgcccgtgtgtggggtcggtcagtggaccgcgggtgtgaggcccgtatgtgcccgtgtgtgaggccggtcagggctaaggggcaccaatgtaacccgtatgtgcctgtgtgtgaggccggtcagggctaaggggcaccaacgtgtgacgggagagattgttgggaatagtcccacattacttatctagggggagttgaaccaacttaaaagtggggggagcccctcacctcttgagctagcttttggggtgtagcaagggtgtagcaaggctttctcccggttgggtcaatgtctcccggttttgggccaacatttgcctcaaatgtaaagtcattttcttgtgagattctaacatatgtagaggcactttttaggacattaatatgtgaaaaacatctagatataagcaacacacattaatatgtgcaaaacatctagatataagcaacacaaggcatatattaaacatgtagccacatgaggttgagatggttagtgcattgaagataagaatgaacttctcaagaggtttcgagttctaggatttaaagtagcaaggaatcataaagttttcacttattttttcacagtggtttgctatgtttgtcacacaatctaatgcccctagaaaatatctatactctctttgagaaaaaaagtttctataaaaaatgctgcaatacataaatgccagtttctataaaaaatgctgcaatacataaatgtcttcatttgtataacaaactcactagatggcactaatgaggcatttttgaaaataccaccatagtattgtaaagacatttgaaaaatgcttctgtagtatttgaaaaatgtttctacaagatatttttgcacaatctaatgcccctagaaaatgtctctactctcttagagaaaacaaagtttctataaaaaatgctgcaataaataaatgtcttcatttttatatcaaattgactagaagggactaatgaggcatttttgaaaataccactacatttgaaaaatgtttctgaagtattagaaaaatgtttctacaagatatttttgttgtagtaatattctgcagacaccatgtggtgacatcttctgcttgaaatgttttcaaagtggaattgagaatggcaaaataacatgcgccatttgctgatcacctatcacactaatattcatgctacttattatttttgtggatgctgagaaatgagttagtggggatatactatatagtctatatagattcaaatttatgttggcatcatttattgttttccatgatacatttccatggaaaaattagtcaactgatcatactcattataataacacggggttatctatttgtaactgtcgatgggggatacccgtagaccggataaatagagtggtggggtacgttggtacgaggatctacacgatacgacatcaaagcaaacaaaagacaaggattatacttcttcaggcccctcttgaggtaatagccctaatccagtttatatgagattgatatgaaaaatcacagagtacaaagggaatagatgaatccgatgataccggcaagatccttgtcgagattgatcgacgagatctcccgacggcttcggcttgaatccttcggcttcgtaaactgtggtggatgtattggctctaggattcgatgatcctaaacccctccgagggtgtgccctttataccgcgagttgccttagtctccaagtagaactcggagacaacgaaacatgcacgacacagaatagtcccaagcctttccgagtaggactctgatagtctctagcccgtaaggatatttttcataatatcttgtatatttccttctcgcttacggaaacatacctagaatatgagatacaccaatctagtatacttggttaatcgtaggataggaggtatggttatccataaccctgacagtaaccgttaacccagttagttcaacacatttaacactaatttagctgcagtgatttatttttgtttcgctttatattttcatgtacctacattgtcctatgaagataaggtggcttaatagaatgcatgggaatgtgaacaccatttatgcttgtgtttcagaattttgtactttcttgaacatgaaactccattattatagtatccatgtccatcaaataatattttggtttgcttagatgtatttgacaaataccataaggccacacactacaccagatcctcacacctttgacgacatatctgtgacggactttagcactcgtcagtgatgagggtcatctttgacggttcttataggatgtcgtcatcagtgaggcatccttctgcaacccgtcacaggtaactagtcacctgtgacggtcccgtaatgaaaaccgtcacctctgacggcttccacttctggcccgtcacaggtgactagttacctatgacgggttgcatgattataaaccgtcaaaggtgaggttaactcacctcaaacggtccggtcactaggcccgtcacaggtgtgggtggggacttgactaggtcagactaatatgtatatcttctctctccctcacactctctctctcccttatccacacattttctccaccgcgaaaaaaaatgccttgggcgacgccgctcttgcgacggcggcggaggacccgacgccctcgggcgaggcggcgctggacggcggctcagcaatacgtggcggcggcggtggtgcggaggcgaagcggcgaggtggtgcggcggcgcgtggcggcgacggctcagcggtgcgtggcagcggcggcggcggtgcggaggtgaagcggcgaggtggtgcggcggcgcgtggctgcgagcggcggcggcagtacccccatcctcctcccccttctttctcccctcctctcccttctcttatttctcaatccggtttttcttgaagtggcagcggcgtggagttctcaacggcgcgcggcggtgctgcggtgcggcggctcgacgcagcggtgaggaggcgaggaggaggtgaacggcggcgccgcggcctccatccccgaccgccgggggccacctccatcccccaactgacgggtgccacctccgaccgcctggcgctagatccatcctccacaaggtcaggggacgcggatccggccaccggggcgtcgtctcctccgtccgccggctgcgtccccaactgacgagtgcagaactgcagattcccccgtcggctgcttccgggtgcagaaggcgaagagggcggcgtcgaggagcagtaatagggacgaggtcatccgcaaggaggaggagcaaggtcgcctccaggccgagctcaagaaggtctagcgcgccaaggagttcaagcccaccgtggtatgaagaagccctgcccggcaaaacccacaaccatttattcccttcgtttttgttgctcgtcaggtgattgacgaattgcttgcttgccatggctgttttatgtgtgatgaaatgttcgtgaagacttttctgtgtgatgaaatgttgtgtgtgatgaatgcgatggcaactacccagaagcactttttttttgtttttttttatcaaaatctacatcagtgacgggtgttgagctgtggttgtggctcttttttcctttttttttgggtgatttttctcatctgtgacgggtcacatgatacaacccgtcaaaggtgtctgtcacctctgacggagctacacccgtcaaaggtgagttaagtcatcagtgaccattgatctgtgacgagggggtctatccgtcacagaagagggtttgagcccgtcactgctagcttgttctgctgtagtgacaacttctgcttgaaatgtttccataggttgattcaaaatggtaaaagaactttccatcaattgctgagcacctactgcactaaaagtggcacaagaactaagaattggctgagcactagtccaagctatccgtatggccaaggctacaaacagtgctagctcagctggtgaaacatcagtttatcattagaaacaaaacaaagattagcctaataaaacattctctactgaaagggataagagggctggaatggcaatgcttccaatagacaaatatttgtgactattgcacctaatcattttcgtctaattctctcaaagtccatgacccaaaaggaacgtcggtgttcgagtagggaaccattgggtagaatgtagatagcagggtgactattttcctcataacactaggactgtcatccaatctacagatgcatggtgctcaaccttataatacaatgcagaaagtggggtgcccattttcctcatgttgccaggactgtggacagatctacgcatgattctcaatcagtttccctatcaagaggttatttggatgattaatatcatgtagagtggttcctatatactggaaggtttagtacatgcctgacattttgttcctgtggtcagtaaccttataagatataaacattttaagaagatagatacgaagaggatatacctgtagagggaaaaaaatgtgtgaaaaaatgatcatgtgtgtaccacacaaatagatattaacatttctatcttttcaaataaaaaagatattttgcttggtgatgtcccacaaaacacttctttaaaataaaaacgttgggaccgccgttcaatctacacatgcatggtgctcaattagtaaccctataatacaatgcagaaagtggggtgcccattttcctcatattgctaggactgtggacaaaactacagatgattctcaatcagttgccctgtcaagaggttatatggatgattaagaccatgtagagtggttcctatatatatatggaagttttggtacatacctaacattttgtttctgtggttagtaaccttataatatataaacatcataagcaaatagatatgaagaggatatatgtgtagaaggaaaaaattgtgtgaaaaaatgattatgtgtgtaccacacaaatagatattaacatttctatatttttaaatagaaaagatattttgcttggtgatgtcccacaacaaaacatttctttaaaataaaaacgtaatgaacaaaaaaatcatcttaactaattttgcatagctcatcagaaacaaaataaataagggttaattgcatacatgacattataaattttatggtttgctaatatgccattattattcatatatttggtaccatgtcatttcaatttcacaaatattagagatatgccactacataccacttcacagtattatctactttctccgtttcatattataagactttctagcattgcccacattcatatttgtgttaataaatctagacatatatgtgctagattcattaacatctatataaatgtgggtaatgctagagcagtggtggaggactcgccatacctcgccgcccgctcgtaccaacaccctctacctccaactccggcaagccgctgacggcagtcaggtgcagaggcgaggtgcggcgtcaggcgatgggcgaagacagggcactcgctgctgggccactctccactcaatcgtaggcccattgggctcgtttcgtgttaatgtgggcatatgtggatgattcactagacttaaccctagctcagaaattccccatctccgccgccgcggcggacgatgaggcgacgacggcgcggccgtttggaactgcgggaggcatccgcatccagctccccgcatgagatcaacaagcggcgactgggcgccagagctggtgtgcggtggcgcggctacgcggctaggacagcagacagcaggagcgatgtggtaggcgtaaggcaagcagcagcaggtaagctgaagcaagtggccttcctcccgattcaatcgtccctaatcaatccttgctctccttttttcagattctatgcatatctatcctctcccttgttccagtgattattgccatgctgaatattgatacaatgttgtgccgtacagtatagtgcgattaggtatgtgtccatgagttatacctcttttttttccgtcctccgctactgtgctattagaaaatgttatagtctgaaacggagggagtattttttaggaccaaattacccttttcttcttcctttctacttcccctctcttctctctttttagaatttgatgtggctagtggcatgcagccgtgagatcagttgcttgcttgcacccattttagctaggattcaggaatatacagcatgcattggcctatgtatgtgtataactgtgtagatgtagagacgtacagtgactgaaccacgccatgtatgagcgtaagtgtacaggctagttccgtatagttcgtacatgctgggcagcacctcggctccaacaatgtggcgggcgctcctgccgtccacgccaccgaccagcctgtgaacggaccaaccaccaccgacggcatcttcgaactttgccgagaccacgtcggatgcgccagtggagggcactgatgcagcgttgctcgcggaggtgttttgggagatcggcggtgccaagctgtagtcctcaccgtgcagtccaccactacaggatgcagccggctacataaacctcgtcggatggtcagagtttgttggttggatgacatgagagaggagaaagaaagggatgaagcagaagaagggtaatttggtcctaaaaagttagatataactgtgaaaggatatgtagtggtatatctccaatgctcgtcaaattgtaatgacatggtatcaaatagataaatattaatggcatatttccaaactataaaatttataatggcatgaatctaatgaacccaataaataaagacatgtttaagcaagattcttttgaaagtataaagggacaattatatctgtgcccccactttgaaagccaattgttgttttgcccctactttttagggtttgtatttttatcctcactttttgaatctcaagcagccgtctacaatcacttgtgacagccgtttggtggcggcagtgggcccgcagtgcgcgacagagcgaggcggccgagggcgtgcgccggcgcccactcccaggatggcagttgccgcgtcgagggcggtcgggcggccgcgtcgagggccggccggcgcccgctcctaggaggtccacaaccggcggccgcgactcttctacgcaaagccccgtgagatctccggccgccgccatggacgccgtcgactcagtcgtcgaccctctacgcgagttcgccaaggacagcgtctgccttgtcaagcgctaccacaagcctgaccgcaatttcaccgcaatttcagttgaacactttgtagtttgaagtttaactcaattttattccacaaccgtgttaagtcaattttatttgactgctatcgtttactcagtctttggtagtttttcttaactgcagaagtttgtcactttgtcaggtgctccatcaaatccaatattaactgatttttattttactgttgagaaaatttcaattgaatatacctctattcaatctagttccagaatcttcatggtttgtttgcttttggacatctatctatatgttgtgcacttttgtgcatatatagacttagtaatatgatctggactgtaatatgtggtaatttaccctctatgttgtggatatgtgatgtgtgcaattatgtttgtggacactcaatgtttgtggttgatgacttatatgtaccatggctaatttgtatgggacactttgtaatgcttgctttatatgtgacttgtgctagttgtgtcaaaattctatcgaaatgctgtccaaattttatttaaatttcggtcaaattttgtaattgtctagttttttgtgagtttttttgttaaaaatacaaaaacatcatagcagattctcacatttgaattattcacataagctgaagtcacaaagtaggggcaaaatcacacaaagctgaaaaaaatggggcaaaattgcaataacaaccaagggtataaatatccttttctctacaactaacactgttaaaaccggctgctagaagtgggggtacatggcttcttcagatttaaaaagtaagggtaaaactgcaaaccctaaaaatttggggtaaaacagcaattggcttcgaaaatgggggcactgatgcaattgccccaagtataaaaacacactagtaatcccatcttccacatcctaggtacccttgatcctcccacctcagatagacgtatatgtagatagagcattaagaaacaagtgataaaagaagtaacagctacttctataggatcgaataccaataactaagctaaccagaggagggtgaatggttggtatacccaaaaaccaaaacttttagtggaaataaaagttaccctcgaattcgtcggatcgcggtctaaccgaagtagatgcgccggtctgaccgcctgaatgttgttggtctgaccgagattgcatctccggtctgaccggcgagattagctatcgtcgcctgaagtcgccaccagtctgaccgccacgatgccgctggtctgactgatggtatttcgccggttagaccgccgaaaccgagcaaacacaaatcaaagaactcttgatgtatatgacaactttattacttctttttgtgtttacaaagtgcaacaacaacactcctcgaaaatttcgactaaactcgaaaccctaactcaactctcaattcaatgctctcaaaagcgatatcgggaggccacaccctccctctatttatacatgaggtatgcagtctaaagccacaaactaaactcatagaagaagtcctaatccacctaggaaacctttccgtacaagaaaccaactttacaaactccaatcataccaaatttggactccttccaaattcgactccgcatcacatactccttccatcgtatgccatatggaatcttcaccaaccacgtgcattgatctttagcctaagtatcccgcatgatatctgaccgtccggacgtcaccttatctccaagttgaattccgatccatcactggcaatactctccggaggcattaagacacctacacatgaatcaaacaaagaaaccatattctaagaccaagctatctccaatttgactcattgttagcaaataacagtattacatacgtatagtatctatctagaagccataaacatgaaacatccacggatatccaaacaaacaacccgaaaccgaaaccgacacagagtcggccggtcagaccacgggctggccggtctgaccgctcgcatagcatcggtctgaccggcctcaccagcccggtctgaccagacccgacaaaatagcaaaccctgttcatcacatgaaaatcaatcatatccaaaactacttcgccaataatctccaaatatcaaaaccaataaactcaaatgccaattgttcatcacagaataataatcaaacacgctttgattttacaacttcctccatcccatataaacgaacatctagggatgaatcttgacaagttcataactagaagttgattcttttcaagacagagggtgtagctccttgaaacctttcacgccattttagaatatatgtcgcactttggcagacgctcttacctcttcagtctaccaccatcacttgctgatgtgtggccaatatgatgatctgcccacattgctatgtggacattgcaattttatactctatatttgattttgttggcgctgagagcagccttgtcactgccatccatgtgattagggttaatcatgcattgtccatgctggagatcaaagccgtcaattaattcctgtagcttctttgtgatgtcagtgattcagactgtagctaaatctaaagaatcaaattaagacatatcgattaaaacatttcggtgaatcacgattaaaacatttgggtctcacacaaaacataccgattcaactgatgaaaactaacacattcagaaacaatcaaagacaaaaatataaaacatacaccggaaaaaagtccagtgcaacattatattgatccaacaccagaaacataaacatgaaagatctatggcctaaaacatagaaaatccgccaaatgtacacgtcgggatctaacttcttcctcacttgcgtctctggatcagactttttctatttatcacatctaattaattctacagaaacctcacagttactcaaataaaacgtgaatcacttacaacagttcactcggttactaaaacaatcaatttgagacataaagtttcaacttaatttcaagatcagtttcgcatgcagaagatctttccagtatatatcgccacatcaccctagtgtactgtgtgagaaccacaagaaatcaaccatgtcgtcttctttgccctgcctcgccgtcgccgtcgccgtcgccgtcgccgtcctatcgctgctagctctagctaattccaaccacctgccagctgcctccgtctccgccgccgccggcctcggccgctctgcgatcccgcgcggccacatcgcggccatgaagttcctgtacgcggtgaacgacgtgcggcatcaggccggggcgccgccgctggagtggagcggcgcggcggcgcggcactccaaggagcgcgccacctggctccgcggccccggcgggtgcgacctgcaggcgcagaagggcggggacccggcgccggcccacggcggcgccgtgacctacttcctcagcgacggtggtagccgggcctcgccggaggacgcggtccggctgtgggcggacgagcggcggtggtacgacgccggcgccagggcgtgcgccgccggcaagcagtgcggggactacgagatcatggtgcagccggcgtcgaagcagctcgggtgcgccgtcgccgtgtgcgcgtcacgcaagacgatcatggtctgcgagtactacggtgggcaggcattgatctgagcctatctatgctagtactacaatcatgtactaattaagctccatttttacaaaatactactaataagatagcatatgctgggcatattaattttcttcttcgcggcttgtcttgaatataatgttccgttggaatttgagaccctgtaaactccattttgacatgattatttcactttcggagtacaacgttcaataaagattactacaccccactattctcaaggatgactcaaatttatgcgtgcagtatcttgaataattaatatattaaaaatattacgatttaatatgtcaaaataacaatatatttgtaaatggcacttttatattaattagaaaaatataatggtagaacctatgcattcaagattgtgtcgatatcgaagacaagtaaaaaaagaacaaaaaataatatgacttaagagagtacttcactacttcagtctggaactaaatgccaaccctgtatataattgcacgaatattatatcataatagaatttgtttcgtagataatcggtttcactttatcttcgaaattaagataaaatttattatttgcacctttgatcaactatcaaattgctataaataattttggatgatttggttttattaattagagaagagaaaactgagaacttcaaaagataaaaaaatagacaatttgcatcttaaaccaatggtccaatggttaaaaatagttaatataatgagagcatcaattacatttagtagggtgaagacactaatataggagataagttagattagctctaatatgtttacatgcaagatttgtctcttatcaatattgtaaaagtaagttcataaagttctgttgcactatttttcttatgggtacaaactcttacatccgcactatagtgaaaaagcacgtattccctccgtcccactaactaaggcgcacacatattgtaagatttaactctttaaatatttgatcgataaatagtttattaatgaaattatatttgattaaaatagtatcattggattatcatttaaatttactttcatatgtttatgattttgttactattatagtatatgagaaatttaaaaatagtatcattggattatcatttaaatttactttcatatgtttatgattttgttactattatagtatatgagaaatttaaagtcaacgattagtcttgaaaactgtaccaagtttgaccacgtcgtagtgagtgggacaaagagagtaacaaagaaattaaacattaaatgtgtctttggtaccactacatattatgggagtggtaaataattactaccaagcataaggattttatggataatcccaccttattttttattatggcagagatctaaaacggaaaatgtttcaatccggttgtccgatctcgagaaaaaaatcggacgcctctcgctatgactttgatgcatgcagcctactcctttgtaggctttttgccagatcctctctttgcacacatgctacatatgcttccttactgagcattagtatgcatgaaggagagaggacatgaggttatttgcatgtacataacacccttttagcaaacttgaaaatgatttttcttctagattacttatccaatctatgatccgattacaccaatgtattcgttacaattaaatctttacaacaagatttcacatgactatattataagaaaaaatatacatatgttttaaccaattaaatttaatgtttcacatatagaagggctgcagga

SEQ ID NO: 13374 - DNA, 1362 bp, Oryza sativa
attcctgcagcccgtacatatttaattagtgtcgcactgtatatatcttttcttagtgtatcacatggtgctatttctatgtttcagtaaatagtttattatgtttcactggtttatttgtaaatgttgcatatgtgttggttgagtgtttaaataagtattcactagttaattaaaaatgttgtacacggtatcatccatacatttcagcaaatattaaaaatgttgcaaatattatataattggattatactatcatatttgttgtaattaaattttacaacaagatctcacatgactaaatcctgatgaattttaaatttagcttaattttatgttgcagttaatctttttctgaatgttgcacactgatttatttggatgttcctataaatatttttccgatgtttgtttagtttattttgcaaatgttgcatgtcatattatgagtatgttttagcaagggttgctttatgtttcaatagttacaactcgatgtttcatgtacatgtgctataaaaatatttcaataaaatcaagtatttgtaaatctatagtatgtaccgtactatttactattttcttttgtgtttcatttgttaagattcaatgtttcatgtagtaatttctagtgttgcgatgatattaaatattatatctctttgaaacataatttgaaacataattaaagacgagttgaaacatttgacctcaagtgctgaaacatttttttataaccgatgaaacatcttttttgcaattattttttatcaaaataaaatcatgttggatcttattgtaaagatctaattgtaacgaatataacagtgtaatcgaattatagattggacaaataattgagaagaaaaaatcatttaaagttttctaacaaagttagtttgtgctattatttaatgggagagatgagagagagtagttaattcaccatgtacagaaataataaagtaagaatgaaatagtgcatagctacatgcatgtagcagagccatgtgagtagcgtacaccagcccatagtagcatccgatttttgtattccatcagacgtccgatcgctagtactctcactctaaagtatagatgttggatttttttagatgatctcacttatttctccatcttcgcatgcacgtatacgtattatggtgtctctctaacatgctaatgtcacttgacacgggcagcccacttattgtcgagttggacaataaacattgaggaacctagctggtgattagaaagtattttaaacataaaccaaaacatcatatttggcattcacatgtatattttttatcattacattttctaatcatggtattaatatgaaatacgaaaattggt

SEQ ID NO: 13375 - DNA, 669 bp, Oryza sativa
ttctacctgatatattaaaataacaataaatttgagacataaatttcgagggtttcatacaaatctttagttactatataaacaaatcttcatcatacaaaagaaaaagcacaattaaccatgtcgtcttcctcctcctgcctcgccatcctgtcgctgctggcgctagcctcccacctgccggacgccgcctccgcgcctcgcggcatcgggccgctcagccccgccgcggccgcgaagctcgtgtccgccgtcaatgacgcgcggcggcaggccggggcgccgccggtggcgtggagcgcgacggtggcccagcgcgccaagctgagggccgaatggctgagcgacccgaccaaaggccggtgcgacgtggcgaacgccggcctcgatccggggctgacccgagtcctgctcaagccgatcgtggccctgacgtacttcgtcaccggcggcggccccgggcggcggcgcgcggctgacgcggtgggggcctgggcggaggggcggcggtggtacgacgccggcgccaaccagtgcgtggccggcggcggcgaggagtgcgcgagctacaaggacatggtgcagccggcgtggaagaccgtcggctgcgccgtcgccccgtgcgcgtccggccagacgctcacgatctgcgccttctcccctgcgtaa

SEQ ID NO: 13376 - DNA, 9172 bp, Oryza sativa
aatgggaccccccacgaacagggattgcacctcaaagagtacactgctagcaatattgtactatgaaagtttttaatttttgagatgaaagttttcaatttgagttgaatgtttttgaatctgagatgaaagtttttaaatctaagttgaaatttttcaaatcttgacttgaatttttttaaatctgacttgaaagttttcaaatcaagatttttgaaactttcaaaatctgagttgaatttttttaaaatctaagtggatagtatttaaatcttgacttgaaatttttaaatctgagttcaaatccgtatttgaaagtttgtttcagtcaactaaaaaaaggaagaaacagaaacgtgatgaatttttatctagaaaaaataaagaaaaaaagttagcgctaagcgctgttagttagcactaagcgctcttagcgccaaaaaaacgcgcgccgtgtctcctccaagcgctaactttggtgattttcagtcataaaactatcaaataaatccaccgaaaagttctccgatgcttggcaactaggaggaacaaaagtgggagctgacaagttgtagtagtgtttgcagttttggttcaaaatttccgagcttcacccctcggcatgaaaatatttcatttgaaagtttcatcaatttttatgattttatcaaaatttattcgaactcgatcaaaatttcaaaattattcattctgaaatattttaatccccccagtagatttgtactcatcgaaactgtaaaccctaactggaccttcggcgcaaagcaaatagtgggagagagagagaaggggggggtgaggattggaggacaaattgaggatgatagaagaatgaaccaaaagtaaattatattatagggcttagtttggaacatgttaagttgttgagatgtgttgtttaatgcatcgacatgtgtcagaagtctgtctaccaatattattgaaaaactatagattctatatgataggatataatccagaacattcttccattcacctaataatgttactcatctttttggtagttggtttttttaaatggtgttcaacctaggctaaaatattaaatctttgttggtatagtggcattgtgttgggcggtatggttaaacagaaaatggtgcagtctttaatggctcgaaaacgaactcatttttataggtgattttcaagggggacatcttgggcgcaacattggtcgctgctgcttaaagagaatcatggcaataggctgaaagaatgctgcaagccattggaatctagagattggagttcttttctaagtttggttggaatgtgagaaagagaatagatgtgtagtttcttttctccttgagtttgttgtttaaatgattttatctagatggttgtgtaccctcttgtaaaggggagtgggtctatgtgctcatatttagacttttggccgtgtacatccttgattccttgttggtgtagagaccaggttttaatccattatgtaaaaattcagaacattctttcatggtttcagagcaattcttgtattatctcagttacgacctacagatggggttgtcaattgtttgatgccctaatataatgacatgtcattgagataccgatggcatatctcaaactttgaaaaattataatggtatggttccaaattaccctataaaataagaccaactaagacaagaattcctgtatgaaattaggaggtacttctttttgcaaggaaattagtaggctagatgaaaggatttaccaaccaattaaggatgatcaaaacatccccaattaagcttgagaatggtagttccagagctgtcagacattccatacacagtatgcatggtcctctgaacgtcgttgcatactatttccagaaatccattaaaaaaatttctgttcttccccattcttggaagcaggttgtccatctgattactccatgaattctccatactttcattaagatatctgtgagaaatctcctgaaatctgcattgttttctcttccataggctaccttggagccccatacgtttccattctcagctaagagctaaacatcttatacctgaattttatgcttctagattcatcagagacgagtgatcggaacagatcatgctgctacatctagattataccacgttgacattcccatacacatgccattttttcctgataacatgtcattagcaaagccattaggcacataatgacttgtgaaactgcaaatggaagcctgtggatcgtacatctgtcagggttcagttttcatgtaagcttaattagtgttagtggttctcaagagtgcagcactaacgaaatgtgtaggattatatttgagctgattatctgtacccatgagtgctccaagtgtccttgattttgctttcttagtgctgaactgtccataggaggattagctaagttggaagctattactgattagccatacaagtagaccacatagtgaagcaacaagagtgaggattcaggcacatttgtctcagttcccaacttcccatgctgacagaatctagtggtactaggctccaaatatctgaaccaacctagctgatcaacaacaagcaacctgagttgagaagatccaaagatttctaaccgctttcggcgcgtataaatagaccccctgattgaatccttggtctccatcgatcgccacattcagcaacacatctcacaagaccgaaactgcaaactttgcaagcatctctgcatagtggtttcgtctgaattgtagtacacattttacacctggaaagatggcttgcaatgtgctccttttctctgcatttgtcgttgtcatgtccttcttcttgtgtagtgttcatgccaaggtcaacatgaatgcatcctctttgactaatggagatgatagtctgagaggaaagtcgtctctcgagtcgaagaaggctgtgttcgatgtgcgcaaacatggctcttacggagatggacaacatgatgatacaaaggtacaatgcgacaccgtataatgtctttgttttattaacaggcgactgacgaatagcaaaactgaactactaccattgttgcaggcattgtcaaaggcatgggctgcggcttgctcctctttgcaaccttctattgttcttgttccaaagggcaagagatacctcaccaagcacattacactatctggcccatgcaaatccagcatcacgttcatggtgagaaagatgcacccgtgcacttacatttactttcatgtgaaattcaattactcgaaaatcttatgttcctgaaaattttcagatagagggtactttggtggctcctccaaagaggtcagattggagcaaggaaactattaggcactggattatgttcaatggtgtaattggtcttactgtcgctggcggtgggacggtcgatggaaatggcaagatttggtggcaaaattcttgcaaaacgaatgcgaaacttgtaagtgctctgaatttatgtagctttacagtcttccattttatttttggaactatctgatgtgaaactttttttcttttgttttctttcaggcatgcactgaatctccaacggtgagtttgatttctaatcttctagcacatcccaatgcaggaaccttgggtattttgttctgacaaaatctgaattaattttatctgacaggccttgacattctactcctgttcaaatctgaaagtggagaacttgaagctactaaacagccaacaaatccacatgtcagtggaggattgcacaaatgttaggatctctggcctgacaatcacagcaccaggcactagcccaaacaccgatggcatccatatcaccagaagtaaaaatgtacaagtgacaggctgcacaatcaagaccggggacgattgcatgtcgatcgaggatggaactgagaacctccatgtcaagaacatggtgtgcggaccaggacacggcatcagcatcgggagcctaggcgatcacaactctgaagctcatgtcaacaatgtcaccatcggcactgtcaggctatatggcacaaccaacggagctcgcatcaagacatggcagggtggtcgggggtacgcgaagtacattgttttccagaacatgatcatggaaaatgtttggaaccccgtcattatcgatcaaaactactgtgactctgcaacaccatgcaagaaacaggtacagttcttagtgatagcttttgtgttattcagttgtccatttgtgtgaataatatggaagcttataatttagtgtttttgtctcagacatctgcagttcagattagcaatgtggtcttcaagaacatcaggggcacaagtgcttccaaggaggctatcaagctggactgcagcagaaatgtaccttgccaaggcataaccttgaatgatgtcaagctcactgtcaagggaggtggtggtgatgcgaagagcacttgccgaaacgcaaaatggaagaaatcagggacagttgttccacagccttgtgcttccacaacaactgtatgaccagccaatccagccaacacgctaattctactagcacaaggaaaaaaataaattagagtgggctttgatacaatatcacttcagataccttacttcaaaatggcatttgcatatttgtatatttagctcattttttccccattaggtggttttaagcccactattatttctctaccactctttaaattccatagctatctattacgcacacaggaaatgaaccaaactaccccatccccagttcaattaaaacggctagatccaaccacacacctaaactcgtgtagcgtagccactgctgtattgtgaaagctcgaactgccgcggtcttttttttgttaccacaaaggatgacttcctttgacgtgccaattattactaatcataaacaaatgacttttgtacgaattcaaatatcaacgctctccttagaatatggtatttgtcaggttgctttgcaacaactacctgcttctttacagaacaatttcactcatgtgttcgtctaggaggcattagcatgatgcaataattttacacaagcatacgtgtgaggcaagaggacataagagactgagttggaaacatgatctaagcgttctaaaataggggaaattattttctatatatctattcctgcacccattgcatatacagaacttgactgttcatcactacaacctggatatattgatcttcccattacttgttgcatgacacacagaaatggtgctttaatttgccaccaacatgcattttctccctcgttatgcttatctgggaactgatgataagatgcatgcctgcagtcatgcatgtggcataccatctccccaacaaaggctatatattcagatccttgttggataatgccagttaaaaatatcggtttgcaaaagctagttgtgccaaaagatttgctttttgaaatatggttgatcagtttacctatttggtgaatacataggctataaatattgcatgggattgtggagaaaaccaataatatacaaaatattattattccgatacaatacaagattgttaaacaattaaatttgaatatgttggttgactatttctaacaggtaggagatggagttagaactacaaaatgggtgtaatgtatattgtattttgttgcaacagttgtaccttatatatttttgtcaatgtggcatgagaaacaataaaaacggtaagaattagtcacatatatctaattaaggacctaacttatgcatggttgttagttgaatcttgcatatagatccaaatcacttcatatagatcaaccatccaaacaaacatacccattcataacagagtttaaaggcctttagctccattttttaaaagtttcactgttacgcgattactcatttgtttattttagctacaacgggattattttatttggctccaacgggattattttattcggctccaacaattgttctatggtaattatagctacctcaaagagctatggctcatgataatgatagaacgtgcgttccaagtattaaatattccatttttctatttggtaaaatctaaatcactatatcaggatatagatagagtgccgctgctaatttattcttttgtttattgacatttgctaaataaagggccttaatttctgttttgcacctaggcctgaaattcttgtggtactgcgacacatcatccaatccgaggttagtattcacaattaatattagaaatccactataatatcatccaaaaaactagattgtaaacttaaaggtgaacatggaactgatatgtttctgaataggtgggaatgaagccattagaaataaaataaggtataatgtataatgcataatgtgttgtgttgtagcgattataacttagtatatattttgtcaatatagcaacaagcacaataagaaacaataaaattgtgttgtttttctttttcttttcaaatattttttatttattttgaggactatccacctgttgaatcagtcactgaaaataacattagtccttttaatcactcatcattaatcagccaaaaatcgctctaggatataggtattggatacacacagtggagtagcttgttgtcctacatggcgaaatagagcaaattaaattgaaaatataatgttgatttgttttttcttagaaatatatgtgatatatttttttaaacagaaatataccgtcggtctcgcacaaacaatatgtgaaaataacgtgacgtgacgacacgggcagactcacatggcgacgaaactgcgagaccgtgtggcaggccgattcaaattgcttaattaccctctctaatcaaggtaattactcactaattattattaattaatcgctaattggtgattagtcactaattaagcgagagctcaccagagaagccgttcgctctcgctcattcctcgtcggtctcgctgttttctcgcgcgagaccgcgctctgtttcagcgatatcgcccggtctcacgccttcctcgtgcatgcttcccgtatcgtcacgcccgcgccattctcgtgtaacggttgtgcaagaccgataatatatttctgccaaaaaatatcccgaatattttaaaaaaccaaatcaacagtatatttttaaatttatttcaaatacagctgcccgcgaaaacaccattaccattagcttgctagtgccatcaagccactgaaggggtggccctcccacagttaaatcactgaagctagcatgaggcagcagtatgctgacctgccaattgaaccgacatgcaaaattcaactggtacaagagataatacaatttatttgcaaatcctaaatagtcatgacattgcacgttttaaattaagttccattttctcctgtttgggggtttcaataagcccattttgatttctttaccactatcttttccacagccagtgccctccaagtgaaccaaattaaactacctacttctcccttgttagagtagactggctggatccaaggaagatgaccgagaccgcctccgacctcatgcagcagctgcagtatcgctgagctcgagtcaccaccactgccttcttcaactagcatgactttcttttagttaccactgtgatatgagttgcatatgtgccatttttcaatttctcaaggcgctatatcgttactatataaagtacttcttttgtttcatattataagattttttaggattgcccatatttatatatatgctaataaattcagacatatatatgtgcctaattcattaacatctatataaatatgggcaatactaaaaagtcttataacctgaaacagagatagcataaatattagttcaaatatcaacaccattactagaaatgacatttctcaggtttattttaagaatatggtacctcctggtaccttctaatttataaccattacttgcttcataaggaatagtttcactcgcatgtgcatcaaggagccacattttgcatgatgcaatatttttagatatacgtacatatgtattagagagaagtgcgtaaatgaccaagatggaaacaggacgatgaaaatgttctataatagttgttgtatatctattcttgcacccacaagatatcatttcttcctatataattagtacccactaaaagtttttttttttctgtagagctcaaattctctgaggccacaccatcaagatcatcttgacctttggatcatcatgcatctatgcaaatcaaccattagatcaagttcttctcgttcatatatcaggcctaaaacaactgagcaagtcatggccggcccagcccaactcacatcgcgcacactcagctaggctcttccccatcatctcatcgtcacctcatcttcttcgcgtttcccaagcacaaatttttttgcctgtattcctttgtcctggcacaataaaaagaaacaaccgtaatctatactttctatgtagttagtaccgacttacaattattaagagctaaagcacaacatgcaagtataccgcctcatcacctactagtaattagcatcttaaatttcatacaagcatgacacatcatcttctcccacataacatttttgcattctcatttgtacaatattccatccatcaattccgcagcaaagcgcttgatatcacctagtttctactatcggtcagctcagcaactgctgatggcatccaccaatgccttttgtcttcctcttaattaccccatgcacatatagatatccctttatcactaacccctaagagcatctccaatagatgactaaaattaaactcccaaaaatcctgtattggggacagccaaaaacatatttagcctaaaatacaccctcttctccaatagatgactaaaatttggttcccaaaaatttaaaatttttccacatcatcattagtgggcccttcccaactaattttctacctgctcgttaaaatcacaggcgagagcggagggggagatcgcgtcgcgcgtgagaggcgaggaggagatcgcggcgtgcggatgcggaggggaatgggcatggtcgacgcgacgcacgcggacggaaagaaaagggctgctcatcctagttcgcgcgcgagatcgcaactgataccgttggcgaggttatatatcagacgc

SEQ ID NO: 13377 - DNA, 708 bp, Oryza sativa
aaattttgctagcaaccatgttttttactatgatctatatcccatttttatgtttctgatctaacaatgtcttgatggaaaaaaaaacttaatttgatatgatgaataaatatttggaaaaacggaaggccaatcacattttttttaatttgatctgacaacgtcgcaaggggaaaaacttaatttattgtgatgaataatggtttggtagttgatttgatccaagatgagtcgacctcgctcctcgtttcaacagctcgtggatgaatcatcgtctgacgatgacgatgattttttttttgccacggcacaaatcgtccatagctattggcactctgtcaatgcaccaagacatggtgggtcagtcatgggacatgaagtgattgatcgcaacagagaagcacggcacttgagattataccaagactacttttccgataatcctacctatggcccagttttattcaggcgcaggtttgtataagtaaattttatataatttatttttgttatatgcatagatatgcatgtctcattagttatgattcgcaggaatagaatgagcaggcctctgtttctccgcataatgaatgcagtagaggatcacgatgactattttgtgcagaagagaaatgcagctggtttaattgggttcagttgtcaccaaaaggtcactgcagcaatgcgtcagttggcttatggtatagc

SEQ ID NO: 13378 - DNA, 627 bp, Oryza sativa
gccataacacgatcaaaaacaacaagcgatcgaatgatacgggggagtcgagtacgcaccaccacctcctgatcgggcttctccttgtcaaacttggagcacgaggacttgttgatgatgtcgctggccatcttgtcgtgcggagaggagagtttatcaccatctgcgccgtgctcggccgccgccgaggacgacgccgaggtcgcggaggcgcagtccatggccgtgggcacccccacctgcggtgccccagacagcgtcgtgccgtgggtggtcatcatctcgacgcccccggaggactcggcgggacggggcgacgacgccggggtggaggaggaagccgccgcggcgtccatggcgcccttgggctcttccgcttcagtagttaagtcccgcttgccctgcaatcgagagagacatcaggaacacacacccgtgagtcgtgagcgtagttggtgccggagaaggagaaacgagggacggcgtacgaggtcgtggcggggaggcattgggcggcggcgccgccgcggcggaggagcagcccgacacggcggattctggaaggttcggcgtggggaggaagacggcttcgcggggaaatgaccagccgctccgcttttttttttt

SEQ ID NO: 13379 - DNA, 1461 bp, Oryza sativa
agattgagggcttcctctctcagtttggtcgacactagagctggggttcaccgccgacggcgacgacgcacgagggctcagccatggtggagttcggcggcggcgcaatgagaaagagacgaacagagagagaggaagaagaagaacagagagagagagattgacaagtgggcccatgggcaaacttgtctttaaccaaagtttctctctccattttgatcggaaataataaaataatagaaggagtgtccagcagctaattaccacttcttgcagtgtccaccagcaaatacacgatcttggggtgtctcacagcaaaggccgtaatctttcggtgtcctgtagcaaattttgccaaaattatagggtccacatcttttttcccttctcttttcttttttcttttattctcttctcttctccttcagccgaacggcggtggcaggtggcgacgggcgacgtacgagagcggcggcggcgacagatgcctctttccccctcccgccgacgcggccgacatcctcaccccctctcctgtcggcctcatctcccctcactcggtcggcctccactccccctctcccgtcggtcgcttggcgaaggtggctcgtgggcctcttccgaggctcggcgggtaggcggctgtagacccccgattttagaaatcggaaatcttctgtgtttatccgtaccaatccctggatcagtagttggtacacacatatatagttggatcacaacatatcacgaatgaatttaggctaaaagagttaaatacttacattagggccaggtaggccaacaactatcagagaacaacagcggaagacaaaataatataagggcccggttaacatgccacaggcagtcgactagggaacgagacctagaacaagaccgcactccgatcatcttgttggatacgcaagcgtaccgacaagggcttctcttcaacactctcctaaaagatatatgaatagcaagggtgagtaccaaccgtactcagcaagccaccacaacaacaatgcatatgatagagggtatttcaaggaatggcttcaggttcttttgcataaagctaattttacaattcttttcacaagcctaaaacctagcatagactgatcaaattttagtaccagtgttcactttaaacaacgacggttctgtccaccatccattgtgatcccaaggatagcttcccgccattgaatcgtcatggttttctgaggatgtccaccttccctcctatcgggaagtggctccatcagcataaaattcatcatgcaataacccatcccccacaagttaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaa

SEQ ID NO: 13380 - DNA, 1376 bp, Oryza sativa
agagtgcaatgaacagtgacttttcctatttatcccgattttagtgtattttccatataaatttgattccacaattcctagttttacatatatgcattttactcaatatttgtgttatcttaactaatgaattcaccctagattaatattatccatatttatttatttatcgcacaaatgaattctttttagattaatttgagttattggccctaaggtgaacttatatatttttgaagactttggggtactattaaatttaatataacgacttgtcatgattaatacattagcagattggtcaagtttagttgtatagcaatatattttacacggataggtttaatctatttattctataaatagtaaattaagactcggtacaacattaatctaattttaaacactcacatattcttgtttatatataaggattaatttatttatatgaccattattttatatgagtgattttcatgtcatgagtaactcggcgacatgttgcaagtatcaatctatatattccggtgaattacttatttataaacacgatcactataatggtgatcatcatttcatgtgttcttatatttcatgtgagattcgattcaaatgaattagatttaatcttactatttctttagctaattgtgacatcaagctatcaatcatggttcgaatatttaatacctgatttgtaatttgtaatagaaattaatatttgacttaactatcttgtgcataattatttgtaggattaacaatattatattctcgtaaatttacctattacttaaatttttagatccttactttactttctttgtgatcatttacggtttggcaagcaattgcaatcataacaaccagcatgatgaaaaagttttgaaaagttcgaaattttagtgatttttattgttgggaattttcaggatgttacagcggcgcaggaggggtggagccgcgtcgtgaccctcttgcgagcgtctccactactgtgtcgccgtactctacgagtttgttctaggcgcggcggtgtccctcatgacgccgagcgtgcgatgccgacaggtggttctcggggcgtggcgcacccttgtcggcttcttccttgccgagcacgaccgcgagctcgaagcggtcgtgcgtgatctcgcacgccgtctcccgcgtgtgcgccttagatctccgccacgctcatctgtcgccgccctcgctccgctccgtcgggcgcttcgcccctactccgctccgctgccacctcctcaccgcctagccgccgacgctgcctcctcactggccctagtcggcattgtttcctcgccggcccaagctatcgaccatcattagctcgtcgttgccgtgagccttagccg

SEQ ID NO: 13381 - DNA, 6390 bp, Oryza sativa
accaagagtagggtagagagagtgggagagagcaggagaagagataaggtggagaataaggatgacaggtgggtcctacattttttttcccacataagcgtctagtcagcatgagtggaccgggtcaaattgccacgtcagcaaaaccaggtgtctattctgctataggacctagactggacggttttgtatagtttaggggtaaagatatctggtattgagaataagggatgtcaaggtataaaattgagggacgacagtgaatgtatagttaattaagtactagcttcatttcatattattcgtttgactttttttctttagttaaacttctttaggtttgactaaattttataagaaaaaaatagtaacatctacatcaccaaattagtttcattaaatctaacatttgatatattttgataatatgcttattttgtattgaaaatgttagtatatttttctataaacttggttaaatttaaagaagtttggttgagaaaaaagtcaaacgacttataatatgaaacaaagggagtattaggcttaaaaaaacttgaaaatttgattaatatgattttcacgacaacttttctatagaaattttttataaaaaaataccgtttagtagttttcgaagcgtacgcgcggtaaacgagggagtaaggttgggaacctcaaattgagagcacagcatcatcatttttggatgggcttggtgcgcatggttggatgaactacgaatgagtttacttggaaattttttcatctcgacgtcgagtttgaatcgtgttgacaaaccgtaataccatatacaatagattcttaacttgtaatactggagtacttgagatcctatagcagtattgtgcttggtttcaactaatgtggcgagttgaatgtggtcaacctggccgagttttgcgtgggatccacatgggccccacttgttagggcccattctctctctacctatctctattttttttctctttcgctcttcatttgtaggctggcgccgcccaacatcatgtggtcgagctagaggagttgctttggcaggtggccacagcggcagtggcactccccctctctctttcgccctttgctcgatgatggttgcgtagggcagcggtggtgcttccccttccccgactaggtcgggcttgcaacgacgacaaccttctccccgtcgagctcctcacccatcactgtagttggtgagctatagggtaagatagacttaaacctagggccttatcactttacagttaaaattaaccgtacaaagttttggttttctcaaaatttggggaggtaacaatccaaacattgccaaaaattgctccactatcaaagtttggcaattttagaatcttcctctcacaaaaaatttaaaaaaaaacaaactaaacatagcctacacttgttaactttaccaaatattgataaatttggtactgtcaaaatttggcaatgttgatatttaggcatcaaaaagtgaacaacccgttccgatgccacaagcccacaacccacctcaccctgccgaccatgtcaaaccaagcagaagcttccagagcaaggtgcccgcggcccacgtagcccacgccgccgaacagcacacagccgcaactcgcacgaacccccgggcatgcctgaccttgtgcggcggcgaccatggctgccccctcgccggagcggagccctcgtcgccggggaccgactccccggtgctctgcgtgcgaatcgtatccctcgactaccacatggcgccgcccctccccggccggattcgacttctcctacagccacttccacggtgcgtttccctccccgccccctttctccacccgcctctctcgagcccccgtttcgccccccttgtgctatgcctctgcaccgcgcccacgtcacgtcaagcggttgatgagtttgatgtgtggtggatttaggtgaaggaggtgatcaggctccactccttacttgcctccacatccatctggtgcgtagcagcttctctgatgagtgcttttttttttctctctgttgatattacggatgagctagttttggtcgtcatgtttggttgcagcttcaagctttcaaccgagtgcgtcgcgtcctttcaagtgttttgagtgtgagttacgctgtgagggtataatacatttgtgtttgctgttaggtagccatgcgcagcaactaatcctcctcatgtattacacggtatctatgcccaacaattgatgcccatggagggaatgtggcaatgtgctctttgttgatactgtacgcgcaccaaattcgaagtttggagatccaacttcactttcgaagttcactaaatttgaagccctcttatcctgcatgggcttaacattattttctatacacttggtgtttgcttgtaatatatgcaatatttacttctgtgtgcacttgatttttgttttttttttgttttggttgagtttggacatgcatatgatgattagctctattatattttgaattcatgtttttgaatgaatacagatatacttcaattttttttatatcgcttctctatggaaagttgctcacactattccattcatcattagttgtgccaactagtttgtaaacgtttgctgttttttgtatctccttcaatttctgtctgtgccttgcacagaggaccttctcataacattgaaaaaggtaattcattatttgtagttatgcaaccctgatgtatcatgtatatgctattactgttacttttgcaatttggtacatggattgttctattttgaattgtactgctgattttctatctacattacctgaaaactttttgctgatgattttcatatctacatcacctgaaacttgaaattgattgttatttattcatattctaactgagccttactgctatctcacaaactttttagacactaattcctcttgtatatggcagttgcacaccgctgttgcaattttattgacttaattaattaattcgtgatttgaaaggtcacttcttcatctgtcgaaagcttgccttgtatgcatctgcaacacatttagataacttaaacagtaggctgaaccctttgtatgtgcatgtggctcggtaagcatctcttagattttgtactggtgaaaagggcacctgtgtctagaaataagtggccgttactttttcttaaccaaatagcctaaatgtgttattctctgcaaatggtagaactgaatactgatgctccctgattaactgttgcttgtaatgtcaagaacatcgcttgatgacaaggagaaattgatatgtctctttcctgccctttctctaggtaattcatatataattggggtctatcaagtgaccttgagaaagctttgcaggtatttgtgatgtccagttatgtatccataactttattgttttctaaaaagtattttggctgctatggatgtttgaaccagttctagattacctgttctttccttcacacctagtgtttccatgaacatattccatatgattaattataaatcaaaaccaaacaaagtatttactgaaatcttcacaaaagatatactgagttgtggaacacagtaactgcatcctcgctgtttcctttgctgtgcaatttctgcctatcagtgttcatcctgaaagattatattaggttctcctttaattaattaattttgatttatttctgtatttttttccttcagaactaattcttgatttcttagcattaactcctattttatatttattgtctagcttctccttgtcaatattgaaactgttgtactcactatatgtttctgtttcagtgtcctaatagtttatcagtaaatatactgaccatttattactggctcaatgcttggtgtgagtatctaagttctgatgtcttatgattgttgcttccacctagagtttgcaaccatgatatattattccaattctggacttcaaggtagtctatgtaaaatggtaaaaatgcaaaacttccttcatttgttctgtgttggagttatcatgagaaaaatctactgatttgttttgtagctaattggctatacataatgcctatgcatatattcttgacaagcattaaataagtcagtgggaattttattggtgttccgtgatatccttaatatttgttgatattgaatccaactattgaataccatgttgcttgtttaaaccacaatttcatgagaaatcatctactgcacaagtgcacattctgctgcagcccagctattggtctgttgaccccttctgcttaatttatgaccttggtattttccaaatttccagtagctaaacatgtctgacaggaggaatatagctgttatacttctagatttttttttctttcactattttttggcaatggtactttgttttattatcccctctatttcttcttaattgttactagtattgtttatatttcactgtctcggagttacaatttggaccttctctgctatagtttaacatccaggtatatccattaaactattatattacagccggaaggtcagccagggatttaatgaaaaaaaatttaaaaaagccttcatttagtgttgacatattaatggtcaaaccttgcagaattttaagggtagttctgacactgaaaggagtatttattgaaagagagagtggtaatagatatttcaatattattattggcttttgttcattgcgtatgtttcctttcagctttacattaataatgactacacttgtctgctgtaggaaactagtatttttacgtgaaagatttgatttcaaacgccttctgttgcatgccatttcacttgaaaaatgtgcattgtgtctcagtgttgcatgtgtatgttgctttattttcatgatgtgaagctgtggattcattctcctagcaacatgaaacttggcctctagacagttatgccatctaggatcgagtctgttctctgtacagactatcatatgttatagtaatttgaaattgttcagtttatcttgtgatcttccttgtaaatacactttactcttctcgaatgggagtattttaaactatttcctgtggttcctgattttgagatgcttggtttcaggatggtgctgttcttaatagagtattccaaccttatgagtctcacattccctatcttcttcactttttggtaagagcaacacttagtttcttttcatagttgttgtgaactgcaagaacagtatttcattttgtctcttatgcagtcttaacataataaataccacagtctagcttttatgatatatagtatattgatatttgagcggctggagtgccaggatattaatgattgaattgaacctgtgaatggagaagaacaaccaaatgatcaaatatcttaccgcagttctgtaaggctcgatgagagtagttcgctgagcaataatattcctcagcttgatgggtcatctgatgaaaaccaggaagttccacaagaagatggtaagtataaaatcaacaggaaaagtgcaggattgcctagttactcatctcctcaaagtagttgaacttctctggtgctctttgccacctcccattaaaaagaggtcagatgtaaatgttgatggtcatgttaaaacctctccagacggtgcgatgccaactgagaaggaaccaagtgtttctttcatgagtagaactggaaagaactcccatgctaccacagataagactggcagggaatcttttagtcgatcaggtgaacatgacccattgtgtgattctgtgagggtctgagagacttgatgatgaggaggaggatatcttttcagtctgaacaatcagaagttggcaagtctggagatgcaatatacatcatttgtaaagagaatgaaattgtgaattccgagggactagaatggcctgattcatccagtggcctttcaattcataaatgtgtttttctggcagtgaatattagcagatgacctttgcacagaagcctccaatgaagaatgaagtattatgttgtttggagggctcttcagcaggtagtgagctgcctcagtttaagttaaagtggtatttatttatcatggtcaatgtaagttccacaagtgatctttattttatcatggtgaatgcaattcatttgatgtatactgtagttgttgctcatgtaaattttgtagtagttttgatgttgttgttaacgatctaatatataaataattgtattagtgcctacgtatgattatgtaacagatgttcattgttttctttcagtttttctagcattaggcttttaggtcctttgccatttacatagcttagcatgtatgcaaaaatagtactccctccgtttcacaatgtaagactttctagc

SEQ ID NO: 13382 - DNA, 10823 bp, Oryza sativa
  unsure (1)..(10823): unsure at all n locations
catgtatgcaaaaatagtactccctccgtttcacaatgtaagactttctagcattgcccacatatatatagatgttaatgaatctaaacacattcatttagatgctaatgaatctagacatatgtatgtggttagattcattaacatctatatatatatatatatgggcaatgctaaaaagtcttacattgtgaaacggagaaagcattatttatttgtttgttatcatttgccatttacacagcttatcattatttattattgttttccctctagaacagtttggactatcaaccaaatgaaatagtataccactataacttactataagtacagtgctattctgttaaaacttaatctttcttgaattttccggtatcatcattcacttcatatcatttaaaacacattatattttctctgttaatccacattcgctcttctgctatttttcaacttctaaactgggatttatcgatatccctctgtttttcaatcagaatgctgaagcgaataagcagaatgaatcatttcaacacatggaaagtagcgagttttcattggatacatggggtgttccaactcatttccaaaatgattggtcagccctatatttgctaacacatgcatttttgccaccccgtgggccagtggctaacctaacaatcttgttccattagtgtctccggtatagattatttcctgcacagtcaatttaatgaccatgtatcgatgttgtcacacactgttatcttaggccatttcaactgtagtgagagagtgtctgttgatcaggaacgagcaaacaattctactctttcaccatactagcaaattacccatgccatgctatgccatgggataaaaaatgaaactgctttgctgtgttattactacgcagcatttgggtgtttttcccccttttttttgttttttcctaattggcggttttctggagaaactgtttggttttttctagagggggtggagcacagaattggttgggtggagaggaggaggacgatgactcccttttagtgtagtagagatatgggaggtcctactttgatggacgattctcttgcatccaaattggctttggagcatagccctacaacctttcctaatggtacagttatgatggaaccagatctttccaaccaagtaatgaaaaatctactccctccgtttcaaattataagtcgttttgactttggtcaaagtcaatctactttaagtttgaccaagttttagaaaaaaggtagtaacattttcaatccaagataaatatattatgaaaatgtattcaattatcgattaaatgaaactaattttgtgctgtaaatattactatatttgtctacaaacttaatcaaacttgaattagtttgactttgatcaaagtcaaaacgactaataatctgaaacggaaggagtagctgattggcatgagttttcccagatcttaggaagagatgagaaggataaactaacacctctcagtcaaattggattccgtggtcctactagcactggtagtggattacaattgactataagtagcatagtggttgtaccacattcttttttcttttgttcctgacgtacatatgtttctttttgttaattcttcatacaatgtaggtgctaatttactgttcgtggaaaaatctatgtctgcaaccagcagttcttttttgttattattaatcatgtcagtttgacttgctctatccagtgaaaagaaaatgcaaagttgaattaccagtttatcacatgacatttatttcattaatacatgtattaacagaaagcagaggagagctgcatcctgatccacgatttcgtgtcatcaacgctgtatcgctggctgttgaggatgatgctgacaacactactgaaatcatgtgctttatacgtggaaacaatgacagttcacacaggaggaggttgtgtgaaatcactcaaatcttggaattgtttgttgttttacttttccgtttcttcttgttttggcactaaccagtcatcttttcctttttaatcaaaattccattctgtttaattttgtttttctcaagcaacatatatcttaatgagtctacagaatctcaaggaattgaactgtcctaatcagaagagttgtgtgcttgtgttaaatgtgaaatttagtacattagtatgtgagtcataatcctagttcaacaagagaagtctgcatggacatcgagtgactatggtggtgactgctacagtgcagtagcaactgatgtcatttgacgagagtactttggatcattacttttatttatgggtctgttaaggatttgatatggtaccatcaaaaacacatttgttgcttccatgtgatgggcctttcatatgtgctgaacatatcctatgcttctggacttgaagaacaccatataacttcgggttcttttatttagaatttgttggatcataaaccacagttttactgttttagagttacactctcatgtagccataattgtttgttttcagctaaggaacttgtttgattcttttttaagggctgtaagagttcaacctgttgtattgagatgtctttattgtcctttttcttgtaactgcagaaacctggatagagttgccggttgcgacataaacgtatttccttgagagacagaaacttttaaaccatcttattaatgaaatatgttcaatcgatccagatattatagttggatgggagattcagttgggatctttaggattttttgctgaaggagctggtataggcttactgaaaagaatttcaaggacaccaccaaatcagatgaaacatccacctatgaacccagtggaggaatcttgtcaggagtttcctggagcatcttcagctgatgatgttattgatgatgctagtgagagcaattggagtcatactcatgctagtggtatacatgttgatggaagaatcattctgaacttatggcgtctcatgcgtgcagaaattaagcttaataattactcccttgaggctgtagctgatgaagtcttgaggaaggtaccattagtaccaaccaagatattgaatcgatggtttgcaacaggtcctggacgaggaagataccggtgcatagaatatgttaacaattgatcttctctcaaccttgaaatattaaatatacttgacctggtaaatggaatcccccacatttatcgtgctggtacatcatcaagatattgctatttgagatttcctttgtatttctagttgaaaacttttatcaattttgcatcttctccttaacaatctcctagccacgatttatcacacagaaatgcagttggttttgttgacatttcttgcacaagctacttctaaatgttgttcttctatagccatttttttccgacaaatattacctgaccatgcaggtaaagaggacatctgtacttgcctgtgtatttagtattgatttcttctctgttctttcacgaagttctctgtatcgtgttgaatctatctatgctcttgagattggcccatacacaaaactaccttgcaatttccccaggaaattaacaggtgaaatcactccctaacatattaagatctcttcagatatatagtttctcgttcacatttaccacaaattctggaacatgtcctagagatgatgttatggattctactggcaggtaacaggcttgtattgtatacatgatttctttgtgccaaagatggccttttgcccatttggtcagcagggatccaaaagaagttactacctccgttttatattataagtcattttgacttttttactaatcaaaccttttaagtttgattaagtttatagaaaaatatagcaacgtctttaacacaaaacaagcatgttattaaaatgtaatcaatattatattcaataaaactaaattggtgttatcgatgttgctaaatttttatataaatttgttcaaacctaaagaagctttactaagaaaaaaaagtcaaagtgcaaggaaaaaaaatatttaggacacttttcaagattttgatgggagtgctattttaagcaccatgaaaacttaactttacctgtgcatagaaacaaaaaaaaaaagggactccccctgcgtcgctctcgcgcgggcggctcggggggcgaaaaaccctagccgcccgcgcctcctctcaatcccctacctcgccactgctggagcttgtcggcgcgaagccggtagctagcagggaaggtggcagcgaggacttctcttcgtggcgcgaagtggacgggacgaagacgacgaagctccccgccggcgcggtccgaggaggccacgacagcaaggtggggtgaggcggcggatcggcctttccctcgcctagatttgtccgncggcagcgggaagaagctttgggcaaggttgcggcggggttgttcgggttggccgggcttggttcgcaagttgcggggggaaggcccaggcaagcccacgggaagggggggaaaagccaagcttgccaaggggggttcattggttgccttggcggccaagcgaagcccaagacgcagcgcccgccccttgggcgcggtgggtctcctcggcgtccaggcctcggtggcggctcggcgtggtgaccggacagtcgggatgccgccgcgatggccaggtgagatgcggcggccgaagaacaggggcaccggcgggtggcgccgatccggagcggctgcgccactagcggccagatggcagtgcaaagggagctggcagtggtgggtcgtcttcctcattgccggtcggcaccctcgcccttcccggagctcctcctcttctttgcagggagtttctaggttggattgaggtggccgctcgtcaacgggggaagctcatgctgccgaagcaatgtcacctagtcccgggttctcctaaagccaaaactgacgaggcggccggtgggtggtggaatagaggggtcctgggccaactctcaggggtggtggttagctgaagtcggccgacggaggggcgttggtgcggtgtggtggatgctatgtactgccatttgtctgtgtggtagttctgagttggtggatggcgatctgcagtcaaggttatagggtaccaggcgaaagcctagttcggtggttcaccgggccagcagcggctacgtcttcgggcgtcgtaacctccttgggcgttgtcaagggttaccatcttcctttctcgacgagcttctttaggtgaaaactgttagaataggtgtcgaatatacttcctatttggttacagttggacttagagttgtaataggtgttaggggatggagttagagtcagactctgtaacccatcatctctcttaaatagagagggaggcaccacaatgtaaccatggcgactgcaatgtagcgtagacacgcagggagatgatgacggcgtggccatgaactcgtagcggctaggagctatattggttggggaggagcgcccataatcagagccccggggatgtaggctttgggtgaacctcgttaacaaatatcgtgtgttcttgtgtcatcatctggcatgtcttgggtgatcaatgactgaagcgatcgggaaggttagtcgtcgttccgctatatcgactaacttttataacaaaaaccacatctttttagatgggtgatggcggcatcctgtatgtcgtgaccaccgtggtggcatcgttttcggagcgtcatctatgtggtacaaaaaccacatctttttagatgggtgatggcggcatcctgtatgtcgtgacaccgtggtggcatcgttttcggagcgtcatctatgtggtgttaccataagcctagcggtgttcggccatacttagcgggggtcgtttagtgctaggtttcaccctcagcagtttgtgcttgggtgttagtgcgtggtgtgtggcaatgcaccttggtacattttaatgttttttcttataacttttactccttaatatactcggttagcctccttcggtccttccggcgaaaaaaaaaactttcatgccgggcatcattttatccatctgtctatcttctggtttgttactcacataaagttagaaaattggatctgttctttgctacaatttaattaaatatgaatgcctaaaaatatagattccagtattttaagtgttctgtgcaacttcgcaggttgcttctcagccagtcatggaatgcttgccactatggaaccagagtcaggtttctgctctgacccattgaatccttttatccctccatgataataagcatatacttgggtaaagttttttccgtcatagtcaagggtacttggtgtcagctcatattcagccagatccacacggaagattgctgactccaaaatggttcctttacgtgcaacctgaggtaatgcttttcttgggtgagctaaattgttttcaaacattacagttactagataaaaccacgcgcattgctacaggaatttaaacaataaaaaaataacatgtaagataggtagataacattatattaagtaaattgatatggtttatgataatttaaatttaaatagtacgtagaatgatgattcaaatgtaaaaagtaagatgatatgattttatggaagaaaaaaagtagggagataatttgaactgtagattaatcttctaagggctaaaaacaattgatgtgatatgacttaattaaagggaaaaagaagaaagataatttagaccatagattaatcatttaagcactacctaagtgaggatgaactatataaatatataggatatcataaaatataacaaagatatacattgaaacattatgtgaattatgttggataataatttaacatgtttgtatatgaaaagctcctaatttataaaactataaagatatagcatgtttgcatgatgtttaaatgtgatgattattagtggatgatgatgtggcatcttgttaattagtatatgaagatgtgacatcttgttagtggatgatgatgtgtcatctttgcatgtttaggttaaggagtttgttagaggaaaaaaaggagaaagataatttggaccatagattaatcatttaagcactaagtgaggatgaactatataagtatgtaggatatcataaaacataaagatatacattgaaacattatataaattatgcggaatgataatttaacatgcttgtattttaaaagctcttaaattataaaaactataaaattataggtaatataacatgtttgcatgatgtttaaatgtgataattagtggatgatgatgtggcatctttgcatgttaaatttaaggagttagtgggggataactttatagtaagatactaggttaggattacatggttttttatttactttgttatagggcatgcctagcatcatatctgtagactgtagctcatattcagcggtgggtgaagtgaccgaaaatcttgggaaaaagtacattgaaggtccctcaacttgtcatcgagttacaaaatcgtcccccaaccacatttatttgatcatttgatttgatgtcgattcttctccactttatggttattctctgcaaaagattagtaatcctaatactagtgaaaagttattattctaacttaaatatgcattgcaagtataactagttttcctctattttggtaatattaacggtcgaaactgattgcgaacgatcgtcaataaggtcgaacacccgagcggtggagtggccgttgccggaggtgcgagcggagtcggcaacttgacccaatggctcgtcttgtggccgccgagcgcttggtagaagctaaaggacttgccgtatacggagcacttgaactccgcacctaccggtgctggccccgtcgtcgagagaggaggcggcgcctggacacggtggtggcccccgcgggcgagcatgagaaggcagagcgcgaggttctcctccgatcgctggcggcgcgacctcttccgcttcacccacccctgcggcaggtgcccgccctcctccccgcttgtggcgctgctgcttgtcacgaccgctgcctcctccatctcgtgctgctgctcctcctccttaagcaccgcggcgtggagcgcttccgtctcgccattcgagacaggccgccgccgtcgcctcctcctttcctgccttgccttgatggcctccgccccagctgccgcccgacttgccgagaagagtgagagagagaggaggaagagagagggtgctgacgtggccacgcggacatacgtgggtcccacgctgactcagccatcacataggacgaaaccgggttcgaaaccatcaaagaacataaagtgaatggtttttgtaagttgagggaaggctctatatctgggtttgtggttggatgatgattttgtaactcagatgacaagttgaggggccttcggtgtaccttttccaaaatcttgtgctagtaaatgggccaaaagggtattcgtaacaggacggcccggcccatatgcaggaagaggaatcgtcttgatgtctcctcagtcctcaacctaaggatacatttccccgtctcctcgagaccttcgactgcggccccaagcgccgccgatccccatcccatcccatccatcccgccttcgccgcgccggaggccgctggtgttcgtccacctattcccgccgtatcgcatccatttctggtgagcgtccaatcctctttctcatctctatttctctctcacacgcacatttgctcgcgttaacccttgtttctctcttctagtagagcattgcctgtgggggacaaaagtttcttttttgtttaaggtattcggaatcaaatcagtctccggttcgtaaacggattagcggtgcgtattccgattcgattccgattcttagacggagtttttttagtttaggctttatatatccagcaaattggatgtaggctttccccagctcatgttaaaccttgaggttgtcgctgtgcagatacaaaaagagtgaagggagggaggggcagatccagatcgagaggaagcaaatgtcatcagaaataataatgtcgtccaagaggctatgcagagagtcagatgacgaagacgaacgccattgcagcagcagcacgaacacgaagaagagggcgtgcagagagtcagaggaggaagacgaacgccattgcagcagcaacagcagtacgaagaagaagagcctgaagctgggtttggttcccttcagctctcacaaccacaaccacaagcagcggcacctgtacctggtgctggacgactgggaggcaggatacagcatccacaaggttgtcgacgacgacttcggcgcccgccctgccgccgccgccgccaagcacaacccgctcatccgcatccaggcgcagcacgcctactcaaggttcttcgctgcccacggcaccaagatcattgccatgcatcccgccagcttcagccctggcatccctgtgttcgacacccggaccctcgagatggcggtgtaccctccccctaagagcagatccatcatctgtccacccgtgtatgcctccgtcggcgacaggctcgtcacattcgtccaccaatatctcgaggtgctggggccccatccaccacgctccgccgccgtcgacgacgacgatgagccagagccgccaccgtggtcctggaccaccgtggagccactcccgcaattccactccggcctcgtcaccggctacgccttgcacccggatgggcgcaccatcttcatttccatcgaggattgcgttacgtttggcacgcgtaaatccaccttcagcttcgacgcggggcgcctcgagtggacccgcgtcggcgactggatgctgccgttcgagggccaagctcactacgaccgtgagctggacgcctgggtcgggatctgccgctacggtgaaggaaccgggcatctctgttgatgcgacgtccctccttcgcccgccgccgatgctgcttgtaccaccaccttgcctgcctggaagttttgcaaggaggtgatgttcaagaagggcttcaccgggtactggggggctacgctcgtgtacatgggcgacagcaggttctgcctggtggattgccgggtgcctgatgactgtgacgtccgcaccaccctccgtgtgctcaccatcacctcctttggtctcaagtatgataaggccggtgaactggtcaccactcggtaccgtgcttacgcatcgatctcataccagattgctggcaaatttaagagactcgaggatcctatagcattctggatgtaatttatttatgatcatgcaaaactagttagtagtatcaggtgttattgtcctactcagttttattatatatatatgtgagcatgcaattttggcataacctgttttatatatggtcgccttgtcaatttggtccatctttgtcagcactgtgttttgctgtaaactgcttttccctcttgtagcacaatgcttaaaaaactgggggaaatgaatccctataactttacaaagtgagttatgtctgatgcctaatcagtacattttgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13383 - DNA, 706 bp, Oryza sativa
tcccatctcctcttgattgatgtaccacagcccattacgcctgactccagtccaaatcctcctccaaggcagtagccaaaaaaccagccaaaacaagagacgtaccacctccttcttagttcctgcagcaaacaatcctcctatgtcaccaagtctgcagccaagccaccatcctccttttcccttagctgagctcctcacatttcctgcgtgagcagcaggttacaacacacgcgctgcgcccgcgcggccgcgcgcagcgcgcgctcaccagcccctcaacgtggctgtgtgtagaggctggtcaggccggatgagagcaggggcgacgtgcgacgacggcagcggcgacggcggcggcgatggacggcggcggcggcgacagcaagctagggttagggctctgataccataaagttcagttttggggattttttctggtgtgttgttcacagccacacacacactatttcacttagctacatatgcaagaaggtccccaatacaagagcatattacatcaacatgcaaaacatccatcaagtcaaataatctgaaattacttctgcaattataatgctgacaacatgctaacgcatccaacagttaaaagtgtgcaggaactaataccactcaatttagtaattcattacagccacgcttgatggaaacaaagagaaattaaacaatggtttattggaaatta

SEQ ID NO: 13384 - DNA, 1740 bp, Oryza sativa
gagagtttgagtaagctgtatcctgacctctttaccaaagtggacaagagtagacttgtttgtgatgcttgtgagtttggcaaacatacacggtctacatatgctggaattggtcttcgtagttgtgaaccttttatattaatacattctgatgtttggggaccatgcccagttacttctgtgagtggattcaaatggtttgttacctttattgattgttatactcgtatgacttggatttacatgcttagacataagaatgaggtccttcgttgctttcaagacttccacaaattggttaccaatcagtttgatgcaagggttcggattattcgaactgacaatgggacggagtatattaatagtgagtttgtgtcatatgtctcagatcatggaattattcatcaaaccacttgtcctggagccccccctcaaaatggtgtagctgagaggaagaatcggcatttgctagaggtggctcggtcattaatgtttcaaatgaacgtacctaagtatctgtggagtgaggcagtgatgacagccgcataccttatcaaccgcatgccatccaggatacttggtatgaaatcaccagctgaacttttacttgggaagcgagaatttaaagttcccccaaaggtatttggttgtgtttgttttgtgagagatcatcgaccttttgttggcaagttggatcctcatgcagtaaaatgtgtctttgttggctatgcatctaaccagaaaggttataagtgttgggaccctattgggaagaggttatttgttagtatggatgtaacatttcgagagtttgaaccttattacaggagtcgaggagaccttgatcaatttctagaggagttctcaactgtcatcgagatcgacagtcgagagggggagatagttgaggttgatgcacataagcaaggtgatgaggatgtggttattgggtcaattccgagttttgttggtgatactattgagaaggttgtggacattggtgagaaggtagtagacattagttgtgacaaggatgagggggtagttgtcgggacaatcccatgtcctctggagcgtgtggaagtacaacaaactgaaatgagagtatatcaaagaaggaacaagaaccaagttgataaggtgacagggaaggagcaagtgcaccagaggagccaaattcagaatcagggggagagaagtggtgagcctatgcaagagcaagacaaggagtcacaacagctgcaacagtttgagtacgcagtcccagattcctcctctagcctctctccaacaagttcctccctccttgagacaagtggtaacatttctcctacctttgaacaagtagagttacctcttgcacaacgtagagaaactagatctaatgctggaagacctcctatacgccttggttttgaacaccttagttctagacatgacattgcaaactatatctcatactctcatatttcacctgcatataaagcattcattgcatcattgcaaatagtgcctattccaaaggactagagatgtgcaaaacaagatccaagatggaaggatgcaatgaaggaggagttgcgtgcccttgaaaagaataagacatgggaacttgtgaaactaccaatggggaaaagagcagtgggatgtaaatgggtatttacagtgaagcaaacccctgaagggaaagtggatagatataaagcaagattagttgcaaaaggttatagtcaaacatat

SEQ ID NO: 13385 - DNA, 2504 bp, Oryza sativa
  unsure (1)..(2504): unsure at all n locations
taggatcttgaggtacttgaaaggaactcctggtaaggggttgtggtttaaaaaaaaccaccacttggatgtggaaggatattgtgatgctgattgggcaagcagtgtggatgatagaagatctacatcaggatattgtgtatttgtgggtggcaatgttgtctgttggcgaagcaagaagcaggcggtagtggctcgatctaccgcggaagctgagtatagagccatggcattgagtttaagtgagatgttgtgggtgaagaatctattgttggagctacggttgttcagaaataatactgtggtgcttcattgtgacaacaaatctgctatcaacattgcaaacaatccagttcaacatgaccgcaccaaacatatcgaaattgataggttcttcatcaaagagaagatcgatagtggggctcttagactacaatacattaaatcttctgagcagctagctgattgtttaaccaagggattaggtcctagtgagagtgagtcaatgtgtaacaagatgggcatgattgatatcttttgcccatcttgaggggggggtgttgatgtaatatgctcttgtattggggacctgcttgcatatgtagctaagtgaaatagtgtgtgtgtggctgtgaacaacacaccagaaaaaatccccagaactgaactttattgcatctcacctttctcttttgacacattgaatttgcgtactgttcttttttagttattacttattagctcttaatgtgttttatattacctcatttagttgctcttacaaagatatgtttaatgaactgattataaagtaaatgcttgtaacaatggagcactcttaatgaactgattataaagtaaatgcttgtaacaatggagcactcttgttaatatggatttccattcaataaattcaatttaattttagaatttaagcaacgtgtcaatctcacattcatgatagaagactagaaccagatgattgatatgtgatttttggattttagttgcaggaaacaaaatgactaattcttttgatggtttattttgtttttctgctaagacacttttgtttctccaggaccagcaatcaggatctctgctcatctatcctggctacaaaacaaatgagtgttcccagaacagctttggaaagatgtatgttgtgattattgtgttgaatttttcttaatctgtagatgctataactgaaggcttagtttctgccagaagctacaccctatagagtatagataattgtctctttgaagttactttttgttcattttattacagtctgctaaactcctatccatcagaaattttttgttgggtctgattataacaccggtatactttttgtttaatattttattagggaatcaacctcatcattttttgctgcttatgatgacagatgtgaagaggaaatccgtactgtgtgccatgaaaaagtagaagaaagctnnnnnnnnnnnnnnnnnnnnnnattagtccgaggtaaaccactatgataaattttgatatgttttctcttttttatcagagcaaataagctatttcagtttacattaaaatgatcttaaccagtgtacatataaatatttagtagggatgagagcggactgggggtcaatctggtacccatcgacctattccagtccaattaagtgaacttagtacccaatatgaactagaaaaggctttgtggtgcatggagtcgccaaccacctcaaccttgagaaaccccctggtcaagacgggtttagagatcaaaaccaattagcggagccgatttagacgaatagggagaaaaacccatatcatgggtggagcggaacgttttcaggactaacctacaaagagtacttgcactcttgcggcgaagacgaataaatgaaaactttcaaaagtgtcggtgccccgggccctatttggataagggcccaggtccccattcctcgccaactgttgtcctccacttccgtggtttctgacctggcaacgaattatagatacatatatgtatgtggtagaaagtgatttttgtgggcccctgtgtctcatgatcctggggaaaaggggaccctggttcccgtttctccaacaagcacaaaccaacgaagatagacaaactaggctaaaagctaggcaaaaagtagatgctttattgaaagaacgattcaattagcaaattgcgttgttgtacattgtgtatctcaattgaaccagccatgacccttataaaggggttggtcaggccctccacaggaccctctccacgtcccactaggtgtagaaaccaattaggactcgaaaaacctcaacccaagcaaaaaaatcccgagaaccgatgaaactagactcagaactggaccctgccggtcttatcggctacataccgccagtcaaactggccccacaccgttggtctgatcggccctatggcggcggtcagaccggcttcgcgcagcaagccgggtcctctacaaatttgaccatat

SEQ ID NO: 13386 - DNA, 1459 bp, Oryza sativa
tagcttatatagcagttgcaagaaaaaaaaacgattccatgttttctggtgtatggtacaaagttgaaagcattttttttctggtatatggtctatattaacctccataagctgccattgtctcattgacctgtaatttgccaccttttatattcactcaaatttcgcacacttttattctggtcctttggctgatatatctgttttgctgtatcattttgttatatagtatgtacaatatgcatataatcagtggaacacctttatgagacaattagaccaaaacatgagagggatactggataagtataaatatcacttcagaaatattggactagctccaacatgaagatcaacttcaactgatctttgctcagttgcatgccatgtaaggaccaagtggaagtgttatggtgcctccaagctgcttcgtattttacccctaagatgcttcagattttttttttatttgcatgtttaaaagggaatacaagtgctgctttcctattggttatgtttgtgttctcctgtactgttggccaaaaaaacttttagcattatgtagtcatgtcctgagtggtggagtacattccaaatcacttcatgctttgttattattggcacacatatttctttcagtgccgatgacatcatgatgaattctagacttgcagcttctgaacatggagcgataatttactagcctgattctcttgggtattccatggatcgatgaactggatatatgtgccatatatagactaggacactaggtattgacatctatagctcttgatacacatgtgtacatcccaattgttaatacacgtatgctaatgatttctaaatgtgtttgctcataattaagttcattgtatacaaaactgtcgatataaatttggttctttagtaaacaactcctatttgttactctaaaagcactattcttgcataaaccaataaaatgcgatttttttcttatcgccgttcagtgggtgctgatacttcatggtaccattttgttcgcaccatccaatgtgtctttgtattttagggctaactaataatatggccctttttttttacatgaccaatgtttccaagcattggtttttgatacctctgtttccagcagttcaaacttcaaagtccctggaagcacatgaaaatagttgcaagtgtacagattaacttgtagattacccagtggtgttgtgaacaagcttgggctggacagcaccaggttcagtccttgcttctttaggcatggtccaactaacacatcaagctgctacttgtaccatgtttgtctttgcaactcatgaatggctctctcctgacatttgaactccagattctgcacaacctcgccgccgccggtgaccgttcccagccaccggcggcggcaccaccaccctaccccagtgacctccccccatcttctttcttctattcccct

SEQ ID NO: 13387 - DNA, 7690 bp, Oryza sativa
aatccaaaaatgcattttgagtcattcgtacaagtttaaggaccgcacgtgtgcttcactcaaaagaaaactaattaggatttctccacagtatccacgaaacaatattcagcacgacacataattcacaattcgatagaatgatggaaagctttttctgatgtgtctctaatttccgatgtgtctctaacatgtgggttccatcataattccattttttttattgacggtaagtaccacgttgtcgacattttaggtcatgactatggtatttgcatggtatggagatcgttggtaccaggatatatgtgatattgaggtaaaagagataaaatgatttttgtacaggttcgggccccttatctgacaggtaatagccctactcttgttgggcgtagccggtgttgctctttattcatctgaatcacataagtataataattgggataacctatctagctgtcatcgatatggcgacacggacaccaacatgtagtcgacgatagggtagtcttcctcctcgaatatgaactcgtcgagatcagagattgcgctagatccctcttgtcggcctccgcaggaacctgattgggtctgtctaggctaatatctgatttcggtgtctagcttgtctttcttgtgtgtctgtatctccctctccctagggggtattgtatttatacccataaatatcccttttccaagtagaactagggagataagtatgggtacaacccgagtagtcctggtcatttccatatggaactctactcattctttcttatttggaactcctttttatatacgagatatgatttcgcataagactcggtatatgttgggccttgccaagtttagtcgactactattgggtatgtttatccatacccctgacacacgtagcatagtagaaaaaattggaccagtcaagcggtttcacccgaaaaaaatgggaacccagttcggtttccttcaaaggatcatttcacgcaattcgacccggttgtacccggggcggttttgcggcaaaccggcagctccttgaccggttcagttccttccaatagttcacgcaatcaacccggtgtgagccggttgaaccggatggttttaccgcggaccgccaaaccgggtgaccctgaaccggctagctcaagctagctagccacttgatagcatatttttatgggccatgtaagacctgagggctcaagctagctgggccacttgatagtatctttcttatgggccatgtaagacctgaggcacaacttaattttatgtgagaaaaaatagtgcaaggggtgggattaggatatatacaaaccttgccaaccaccaggctaagttaactgctctgactttgaagaaacacaaaatatacttaggcaataaaacgcggttccggtgacccaatggttgaaccgatagaccgatagacaggtgaacagagcacttcaccaggtcaaggatcggtctgattttttttactatgccacgtagatggcatgcttacctaaaatcggccttaataaaaactgccttatgattatatttatatcggttattaagatgagagatgccgctttcacggttgacggatatgattgaaactcagaacccttagatgagggacatgaaatggacttcatccttcgcctgaacccatgatgatctacatgggctgtgcgcctgtgccgagttacccaggtccaccaatttgtcattcttacatgcctagtcagcaaatcggatggaaaatgtcctaggctgcgtgcgttcgggagtcctagttcccaacctcttttcctcattttccgcacgtatgtttttcaaactgctaaacgatgtatttttttaaaaaaaatgtatacgaaagttgctttaaaaaatcatattaaactattttttaaaaaaatagcaaatacttaataaatcatgtgataatagatgcttcgttttgcgtgttgaggaggaagggttcctcccgaacacagccaggctagcgcctaaccatgctgagggagagcgagcgtacgacatcggcgctagacatgttccttagcacggcacgatggagggacaaggcggccagtgcgagagagaaaggagctgcgaatggcaacgtcaaggactcaacctggtaggagctagagagaaaactccaatgacggattgatgtggggtgggaaaaaagaagggaataacggggggaatgggttcactggagtcagtggcggagccagaaattatacaagactacggataaggtagggctcgactaatggagtttcagttttctgaaaaatttacatggtgaatcaacaaaatttaagcaagtttttggagcctagctgccctaggcctgtctctgcccctgactggagtggaggagaggtggtggtggaggaggagatcagcaggcggttggcagcggctcgacaaagctcgaacttgaagcttcatcctgaggagggaagaagatatcgatatatagtaatggatggaagggggtggtggctggcttttatagctagaggaagacaagggaagtgagaggtagccgggcagatggcaacaacgcaatggccgaccaagacacgactaggccgcaggtacaaaatcaagtgttggagatcagacttagaaatgggtcgagctagtctggttggggatgacgattggcggcattaattggtgggcttcaaacagaggcggaatggtgtgctccacactgagcctatgttcgggcatccttgttctcaactggaacagcaatcacacaaaacggagcggtctattagaacgtgattaattaagtattagctaatttttctttaaaaaatatattaatttgattttttaagtaactttcatatagatttttttaaaaaaacgcaccgtttagcagtttgaaaagcgtgcgcgtgaaaaacgagtgagaggaattgggaaaaaaggtgccgaacacagcatgagtctatcttcaaatgccatgccagcaaccaggtgccgcagatcgtgctcggattcgacacatccgcgtgtgggccagggttcctgtgagttcaccgtaggattctaaggcacaacttctctattttatattagtatagatatatctatttggtaattagcattccatgccagcatgcatgcagcattagtgcattatgatagtgatatcatataaaaaaaaaggacttccggtggaaagacaagcatcaaagttttgagtctttgagagctactataatatttcttcccaggtagtggtttttgatgttaaattaactttctgcgcttacaatcaaagtgatgaccattttgtatgtgttgtaaaggtagaactaaaaggtgtaacctaaagtgggatgacaaggtatctgcctgtctaaccgcacttaagtgaacttgtgagtgtgcatgagtcagctgcaagaggtcaacatgcaagttaagatcagcacacaaagtaaataatggcttctccaaaaggttagataaaccgtatcggtggttctgatatggtcagggaatttgtgtagacacatgacattttcattacttttaaggtcttcaagataaaattttgaccaaattttaatcagatatagtttataaaatttgtttatgtgattatgaaagtatatttccaaactaactattttaaaacttattaataacaagagtttgaaaggtaaataaaaagaacaatatattttcataggagaaatcacatacttcctccgtttcacaatgtaagtcattctaacatttcccacattcatattgatgttcatgaatctagacatatacatcaatataaatgtgggaaatactagaatgacttacattgtgaaacggagggagtagcaattatctctatccagactaaagatgcctccaacgttaatttaaaaagaaaatatctttatctaagttaaatatgtggagtagatcagatatggtaatgcgcgtgggatacaattaatggttagatcgtaaagacttgtaataagctggttctcacctaacctaacttttgaaggttactaaactatcaagtacaaccctttaagaaacagttggtaagtactcgactttcgagaaaatatggagaccacggtaggtatatactccctccgtctcgaaataagtgtagttttgcactattcacgtttaacgtttgaccgttcgtcttatttgaaaaaaattttatgattagtatttttattgctattagatgataaaacatgaatagtactttatgtgtgactaaatatttttaattttttcacaaaattttcaaataagacagacggttaaacgttgggcacggatatctacggctgcacttattttgggacggaggtagtatgtttggttttctgaaaattttgtaagcagatacagcctacggctaccacccggtccacaggcccacaaacagggcccagggctaggcccaaatcatggtgacatcatcggagctacagaccgtacacctgtccggtgaataaacttatatgtactttggaaatcttttccagcaaacacaaacttcttgtagtatagcgacggctgaaactgtccaaactgaacgaaactttaatttcactggtcctgcctctttcctggcttggttctcgaagcatcgtcgtcctgatcttctccagaaattaaccatctgcattcttagttgattactacattggatcgtctaaaagaatcgtagatgaaaaagaaagtactcgatccgctcctaatcagcaatgtaatagtgtatgcatgtgtgattatatatcgcaatgcagacaaatcaaagttgggtttaagagatttgatagatgtatgatgtatgcaggagatttttgtgtatgatgacgccaaaagtacgtacacctggggccataaactagagcaattcatgacacgtgtcatcaccgccaaattatttggcctgtcattgtacaggcgacaagatcaactgatcgagttgtatgtgtagaataaacgggtaaccctagcatgggatgcttgaagttatttgtagccctagtccaatttacacctgatggatagagtcatgcactacgattccatcataatgattttgtagtacctattagtacataagcctttaaatatacgagtatataatgaaacaggaccaaacgatgaaacattttcaactttggccactaaggtaatttttttttcagaggttgataggtaaattcaacgaaatgttagtacgtttttgtaagggtcttcggttacttccatgcatatactagctcagttcccaaaaatttgttgttgttgaccagtattatttcagttttaaccactaccaattccaaaatgaatggttaaattacgatgtaggaaaattttaatattaatttgtattcatgatatatgcaaccgataccatggctttaattttgagtatttagatttcttttttagaaaaatagaacaagttttcaatgtttaaatatggctggtgcatatatatggtgataaagtaattggaagcggaagaaatgattatgaatgtactccctccatttcatattataaggctttttaatattgtccatattcgtatagatgttaatgaatctagacaaatatttttttataatataaatatggatattactaaaaagtttataatataaaacagaggaagtattatttattataatgaacaaattaacataagctatatcgcgatgacctaaacatcaagtaaaatggacgaaccttggcgcctttacacgcaaaagtttgtaccggctaggttgtaaagtagtgcacgtatatactacagatgagagctagacgtgccaggaccaatgagcagtgcgtgacgtgttccaagaaaaaaaaaagagaaaaggtctggcttgacacctgtccctgcaccggcaccaggcgggctgcttatgcatggatcatacttgtggttaagtatcccttcatatttttgttatttataaattttttgttatttataaattgtattctagttgagctcatatttttatttttctattttctgaatttattttattttttatttcgaattttaattaatctcgtattgtgttttatatagactattattttaatattttttattttttatttccaattttaattgtttcaacattgtattcgtacttaaactctctattttattttttctaattttggattttttttattttcaattttaattagcatcgtattggtttcttatatagagtcttttttcaatattgtttattttcattttaaatgttagttattttaaaaatgtattcctacatgaaatcttcttttattttttttctaattttggattttattttatttttattctgaatttttaattaatctcgtattggattcttatatggaatcttctttcaacattccttctttttaattccgaatttcagttatttttaaattatattcctagttggacttttcttttttttttcctaattttggattttattttatttttatttcgaattttgattaatctcgtattgtgttcttatcttctttcaatattgcttatttttaatttggaatttcagctaattttcacttggaatcttcttttctttttcttcgattaatgtagaaatttctagtcccgacagcgaatgtggtgcatcctttcaaatgaaagctgttttaataatataatagatgtcttcggcttatgaaccgcgcttcaggctctcttggtttggcttaagcttttaactgacattttagcttccatattaaattttaagtcattggcttttaagagcctcatcatttggctttttccctaaataagccaaaacggcttattagggaataaaaatgaatttgtaggtaaaccttttatatatgtgttcttggggacttaaaagtcaatgctgaaaaaaaaactacattgaaaaatctcaaaattaagtttgaaaatttaaaatgtggctttttctttgactgattagaccatccgatgagagcctaagtctcaatgatatagtgttatctgcaaaaaaaagttactcgaacctacctatttatttaatgctataaaaaatggagatccagcaaaaaaaaacgtcatgcttatttgagctagtcttttttgtcttacaaactggctcaagagcccaaacaaagagaccttaaaatgtcttcaaccggatccgtgctcctagccctatttcctctcgcgtcgctctcccctgcggcggttcgggagacgatgacccggccgccccctctctcccacctccctcctctgcctcgccgccgtcggcaaagccgcgcggctgcaaggacggtagcggcggggcttcgcgcttcccaatatcaggcggagggggggcacgcctgggaggcggcggcagggaccgccagatccgcgccgctcggacggatctggtgggacggcaacggcggcgaggttggcgatgatgatggtcgaggcgagaggcgcggggaggggttgtggccgatggcggtggggatggcgacggcggcagggcggcagcagtggagtccgcggatccggcggcggcgcggcggccggtgtcctgcaggtagcctgccccacggctggcgtggccggcagtggtagtaaggaggacggctggatctg

SEQ ID NO: 13388 - DNA, 4867 bp, Oryza sativa
aggaccagcacgtcaatgtcagggttttcgccggttttcctttaattaaccgtgctgttgtaaggtttttggtccaattttccttataaactggatcaactctcttcttctgtaatgaactacatgaactccctacctgtcccctcgaaaaaaaatgtcttcaaccaagtgctaagtttcgtaaacaaaaacaaggctaaataaatatacccagcaaaataatacaacactcagatgcaaattcttaaatcagtaagatcactattagatcaaaatataagagtttgagatttgaaaattgtattggtagatttgtcaatatttgtataaatattacaaaatttcaatcagaaaaatattgatcttatcagtaagaactgaggtaatatatcagcatgattttttttctttataatacaacactcagatgcaaattcttaaatcagtaagatcactattagatcaaaatataagagtttgagatatgaaaattgtattgatagatttgtcaatatttgtataaatattacaaaattttaatcagaaacatattgatcttatcagtaagaactgaggtaatatatcagcaagatttttttcaaagaagaaatccgcacatataagcaacacacttaatataaaacagtgcttaactattgcatcgttgtcaagcaagttgcggtgtgatttcttgcatgggaaatactccctccgtggctccgttcaaaaacaaacgtagttctagataaccaaatgcatattaggaaagagaaactgaaacagtattatgcgtataattaatatggagaggaaacaaggaagatgatacgacaaaaatgagaagaaaatgatgtagtggtattaaagaagttgtatggaccactccattttttttaggttaaaaatacacttttttgaggatggaatggaggagtaaatatgtagctccaaattacctctatttggttaaaaaaaatgaatactatagaatgatctaatatcaaataattaaaatggatgaggcttcaagtcgtctagcccatcaccttggtgaagctaaccgaaagatttctgggcgtttctgattctttgtttggttatataacaaatcgacaaactcttacggactactacgtaaaagatctacttggtgatctactgatgttcgtgaaagttttgaattttcttcgtaatagggcagcaatagcatacgcataacttaaacccggtccacagtaaaatcaattgcaatggctggtaaaatttaacatcccgacatataaataagatttcatcgttgagaattacttgagatatatatggaattgatgagtatcaaagggaaagaaaacaaattcagaatgcgtctcttatatttttgatttcgttctctagctccctaaatttgctgaataatcaagatcgagatgttgtgtttgtgatgacagtgacagtgacaaaagtagatataagctcgattcagttttccgaaagtaaagatcttcaggtcgacgtatctctcatgaaaaccgtgactgtttctaactttcaatggatcgatcatcaaagatataaaacatcacatgaaagtggtgagtcccgtggacatatgctttgtttttcctgtctttggtaaaagcatgtttgtaatagagaaatcttatgctgatgtatcaaaatttcaccaaaaagacaaaattagtatgtttctcatagtacattagcattgcctaacatttaaattttgtattaaaaaaaggtactaatttgtttcgtaaaatttaaaatttgtacaaatgcattactccttgaatctccaaatccccctacccctcccccagcaccgccaccacaccccaatctgtgaagtggagtttctccatattctcattagctagtttctcgtaatttttactttctcaaacaaaaccttaaataattaaataaaagtctaatatatatcaaccaaacacctcttggagaccaaggtggctatataggatggcttcatgcatccaaccaaatgtccccttgcatacatgcatctactccagctactagcttaattatccagcagtgaactagctagcaatgcagtggcaatggccatcttgacaaattcaggcgatcaaaatgacggcacatgtaattgctccctgctttcgaagagattaaactacacacatcacatgcacgcttccaataatgcaatccccaggcgattgggacaatcaaatacatgagcaatcatgcattcatatgaatggtaagtccagcgcaattattggctaccatggtggcgtgtcctcctataatttgtcttatctgtagatttatgttccatctgtcgacttggatcgatctatagcttcttttaaaatatatgaaaaaattgtaattcagaatttatatcacaatataagtgtttctagaatctagacagtaatttcgatgtacggaaatccatatattttaagcgaatcaagtcctatggaatctaagcaaattcaaaattcataatttgatcactaattatgatggctgaaaataatattttccttaatattaatatatttatttagtaaacaacttagaaatggctatatatttttggaatagaggaagtagtactaatctatatatctatatattttggtatattttgataaataaacataaagggttgattatattaattaatagatcatgttgagttgaatcgcgtcttatgaagaacgtatatgctaataaagttctcttggaaaagaaaagaaaacgagacatatattaaatctcttttttgcatttaagcaaaacacagcttttgaatatgtttaagctcagggataaactcgactttaatacttcatgatcacttgagaccggccccctttcagaaagacgaaaccaagacgatttatttgagtgcaacatatcaagatcaggcatatcaattgtacacgaccaattggctgcattattgcagatcaatgtcgcgacaataatgtacaattgtatttaacctcatcatcatgtattatatattcatgtacatgtagagctacattatacctgattaattgatcaacgcgtattaattcctccctgtaactattgtacttctaaatcttgctctttttctcttttgtgctaatggagaatacatatacatacatacatacatacatacatacatacatacatacatacatacatacatacatacatacatacatatatatatatatatatacatacatatatagacttccccctccttaccaaggcccaaaacccacctcccacctcggtcaaaggcccctcccaccggtcaaacccgcctactaactccccccaccacccacctcttctcagctctcgtcccaggatggtgcagtaacacgacgaccactgtgcagtaacattgtgtcttacgtgcagtaacaaagttaaaatatagttaaaatatagtcatgacggatctacttttgataagctctttttttctagcatcatggtgcaaacggttttaaaaaaatcttacatcacttgggagatattgttcttcaaagcttgacttttttgcaatttgtctctccacaagtagtaataccattccattacctggtaccacctggctaatggaccgtaccaccatccccttatgaaggtacctcccctgcgtttacctatttttttggggtggggtacttggataaccccatggtaccgggtcccttccgtccagtaccacttttattttggggcagcaacaagtatatggttagcatctgagacttttaacctatatatttttgtttcaattcctaatttactgtaattcaccacaatattactgtcacatcttacacatgcagtaacgctatattggagggaggagaccaattttcttgagaagagggagaaagatcggttcttgaggaggggaatacgtagatgcatcttgaagtttaatcctccatatgcagtaacactataacatcatggtggaaacggttttaaaaaataatacatatcttgtgagatattgcttttcaaagattgacattttgaactttagccctccacatgcagtaacagaatgtgtaatttacagtaacaggggtatatacatgtagtaacatggttttaccaaatgtataaaattgttcaaaacactcctacatcaatcagacatcgctcaaagccacctacagactttacctatggcccacctatttgatcttcatctcgtaaaaatgacatagtaacactgcatttatcatgcagtaacatagctacttggaagtggtaacatgcacctattatgtagtaacacttctacttttgtgtagtaacaagtatacggttagcatgtgaggctttaacttatatattttttgtttcaattcctagtttatgtagtaatactattcaagaaatgcaagacactttgttactgcaaagcttattgtctttactaaactcttgtagtaacattgtgatagaactgtagtaacgtacagtagtaacaagtaatgctattgtattactacttgtggagagtcaaatttcaaaaagaaaagcttttaagaacaatatctctgatgtcatgtatggttttttaaaattgtttgcaccatgatgctagaaaaaaaagcttatcaaaagtagatccatcatgtctatatttcaactatatttgagcgttgttactgcacgtaaaacacagtgttactacacggtgaccgtcgtgttactacacagcttcgcgagacgagagctgagaagaggtgggtggtgagggaagttagtaggagggtttgactgagttttgaccggcgggagggggttttgaccagcgttt

SEQ ID NO: 13389 - DNA, 4705 bp, Oryza sativa
actccatcgaacatacttgatgagttgagggtttccctgtaataataactttgtattattatatattttcataaaattatgtattgttaatttcttctcccaccagtacgtgcgtaaaaaatttattgctagctaatcattagccccatttgcaatgatagaattctaaagggggaaaaatcattcgatttaaataatagagaattaccgatgtcatagttgtccaaaacacgatttttcttcctacgtacgtgaaagtaacttagtcacgaagaatttgagaaaaataatttacaccgacgcaatcgcttgctcatcgacgacaacctacaagtaacaatataacaaatagtgaggaaaggaaaaatataaagcagcattcaatcagtcaacacaggtgttctagccatatatatgcaacccatcaacatggggaatgcaacaatatatatagcagcctagctagtcttcaaaatgatgaagcccacagaaaatgcacacaagcaaacaaacgatatctcaaaatataaaatcaccagatataagacagacgctcccatacctgaatttttgtttcttgcaagaaatcaatgcatgatataactgtaacacatcaagttgtctgaccatatcatatatcatcatgcatgcacagcctaattaaatcttacacacaaagaaaccaaaattggagaaatcaaattcctcctctcccaggggcaaaataggaagagagatatttctttttgcaagaagaagaaacagttacaaaatctcatggaaacttacacctgtcccttggccattttgatcaccatgtgatgtgagtccccccacttacattaatctcatgctaaaaaacaaacagataaataaataattgccattgccatgctgccacgtgtcatgggacacgtcacctcctcttcctctcccgcgagtatataaacccctcgctcccctctccttcctcccgccatctatctccctctcttttgaggagggcaccgccatttagttaattagtagttgttaattatcttcactaaccttaattaccctcacgcaaagcactctctaatcctcctcggcgctcgcataatcttgtatccctcatctcagattatcatcacctcgccgtgttagaaaaaaggtactatgtttggttgatttgtaataattttcttggttggtggtttggttgatttcttgattagtgtgatgctaattgttttcgtttgaagggagtaagttcgttttatcgtcggatttggtgagagttcgccggagtagaagaagatgacggtgacgccgcagatcacggtgagcgacgggaggctggcggtgcgggggcggacggtgctgaccggcgtgccggagaacgtgacggcggcgcacgcgtccggcgccgggctcgtcgacggcgccttcgtcggcgccgacgccggcgaggccaagagccaccacgtcttcaccttcggcacgctccggtgagcaatctcacagaattaatttcccaagatttctacaaatttgtcttcgctgcatttttgaattcacagaattttaaagagtttttggcatctgaaattttgcagggaatgccggttcatgtgcctgttcaggttcaagctgtggtggatgacgcagaggatgggctcctccggccgcgacgtcccgctcgagacccagttcatgctcatcgaggtccccgccaccgccgccggcgacggccacgacggcggcggcgacggcgagccggtgttcgtggtgatgctgccgctgctggaggggaagttccgcgcggcgctgcagggaaacgacgacgacgagctccagatatgcatcgagagcggtaagtaggtcttaggatacaaattggatgaaatttgtgtttgaaaattaaatttagacgagtttcggtgaaattttccaaaactttggatgaaatttgtagtgatttggacgacgtttttggggcaggggataaggcggtgcagacagagcagggcgtgaacatggtgtacatccacgctgggaccaaccccttcgacacgatcacccaagccatcaagtatgaatttctctccgctgtccccatcactaaaattcctactcgtactacgtttcaaatgaaatttacacatctgacacgtctataaattctaattctaatgtttgaaatttgaaaatgatgcagggcagtggagaacgaatgcagacgttccaccacagggacaagaagaaggtaatactaccaattccttttgaaatacagttctttcttctttttttttgaaatattgagaaccgatttgatcatttttgtttgtttgatggatcgattttctgttcatgtcacagatgccgtccttcttggattggttcgggtggtgcacatggacgcgttctacaccgacgtcaccgccgacggcgtcaagcagggcctccgcagcctcgccaatggcggcgcgccgccgcgcttcctcatcatcgacgacggctggcagcagatcggcaccgaggacgacgacacggacgaacaccccgccgtcgccgtccaggagggcgcccagttcgccagccggctcaccggcatcaaggagaacgtcaagttccagagcaagaacggcggcgccggcgaggacacgccggggctgaggatgctggtggaggaggtgaagggggagcacggcgtccggcaggtgtacgtgtggcacgccatggccgggtactggggcggcgtggcgccggcgccggcgatggagcggtacgaggcggcgctggcgtacccggtgcagtcgccgggggtgacggcgaccagccggacatcgtcatggactccctctccgtgctcggcctgggcctcgtccacccgcgcaaggtgctcgacttctacgacgagctccacgcctacctggcgtcgtgcggcgtcgacggcgtgaaggtggacgtgcagaacatcatcgagacgctcggcgccggccacggcggccgcgtcgcgctcacgcgcgcctacaaccgcgcgctcgaggcgtccgtggcgcggagcttcccggacaacggctgcatctcctgcatgtgccacaacaccgacatgctctacagcgcgcgccagaccgccgtcgtccgcgcctccgacgacttctaccctcgcgacccggcgtcccacaccatccacgtcgcctccgtcgcctacaacaccgtcttcctcggcgagttcatgcagcccgactgggacatgttccatgtaagcatcaaccccttcgtgtccgacgccggcgccatttcttcttcttgcttcttaggtgttcgatgtgtggtttttgcagagcttgcacccggcggcggagtaccacggcgcggcgagggcgatcggcgggtgtccgatctacgtcagcgacaagccggggaaccacaacttcgatctgctcaggaagctcgtcctccccgacggctccgtgctccgggcgcgcctccccggccgccccacccgcgactgcctcttctccgacccggcgcgcgacggcgagaggtaacaaacaaagatttcgaaatttgtgtgaaatggtttcgaatttgggttaaaatttgatggaattttttgtagtttgctcaagatatggaacctgaacaattgcggcggcgtggtcggggtgttcaactgccagggcgccgggtggtgcagggtggccaagaagacgcgcgtgcacgacgcggcgcccgggacgctcaccggcgccgtgcgcgccgacgacgtcgacgccatcgcgcaggtcgccggcggcgacggcggaggctgggacggggaggccgtggtgtacgcgcaccgggcgcgtgagctggtccggctgccgcgcggcgccgcgctgccggtgacgctcggggcgctcgagtacgaggtgttccacgtctgccccgtccgcgccatcgccgcggcgccgggcggcgccgccgtcgcgttcgcgcccgtcgggctcctcgacatgttcaacgccggcggcgccgtcgaggagtgcgccgtcgatgccgcagccgccgtggcgctcagggtgcgcggttgcggccggttcggcgcctacttctcgcggaggccggcgaggtgcgcgctcgacggcgccgacgtggggttcacctacgacggcgacacggggctcgtcgccgtcgacctgccggtgccggagcaggagatgtacaggtggaacctggagattcacgtctaggatgctgctgctgccacgtggcggtgcgatctttgccctctggtgttcgtggctgagacattcccagccgttggatcattgccattgatggtttgcagcagagatggacggaccgatggagagattgtgatgtgccctcttacgacttgcaacgcggtagagggagtatgctttgctacatctaaaatgaaagaagaaaattatagtatgcttttgtcatgttatggcttgtaaaatgcaataatatgatgtaatgctatggtttatgtattattattagctgataaataaaggatggtgctccttaaaaatatatttgcttactcgcctgggtacttcgaggtcttgaagccctccaaatgatgggctcctttggaacggggatttcaaaaacacatgaaaaaacataatgtaggaatttcatgccatggcaaatcctataggaaatgaatccttaggtttttaccaaaattattgtttgg

SEQ ID NO: 13390 - DNA, 1601 bp, Oryza sativa
gggacaacagttcacatgcgcttccaaactcaccgaattgcttatgttgttatgattctattgactatgaaagtttcaacagctcttcatcaggcaagattgaaagaaaagggggatggttggaagattctagcagcaggagtacaatttcttgttatcaatgatagtggtcgtcaaaggtgctctagattgcgctacaaaaatatggttctatgaacttggaacccccaacactgggtttacagcacaatcagtgcatggatctagcacacatcagcctcaggtaactcgtgctctctcatgagttatctatttgtggtacaggtacacaaatgagaagatgaagaaggctcccatctgcaacaaagagggaaattatataaagagctaggtcatgacttttacaaacatatatgtaacttttacaaaaatcttagtaattccagccaaggaaacaggtatacaaatgagaatatgaagatgctaccatctacagaagtgacaataactatgtccatctaaaatgtaaggtcaagaaaaactcatgtctattgaaatgtatcaagtatatcttactgttgaaaacgacgcagcatagtacggatatgccgaagttatgaatctttcatactcattatgcctgtaagggcgcactggaatctgcaggagagaaacaaatggttgaatgcagttttacaaaggtcgataattatcgcaaaatgcatatgctttgtgtgaagttgtaaaaaaggaaagcatcgtggaaccaacctgcttagaaagagagagaccagtatatccaagcctctggtactcaactttgaactggaaaactccataaacatctggaactttgaaggatgttgaaaatacaccctgtattggcatgaaattttattttaacaaacagcaagctaaaaacaaacattaatgcaatactgactcatagtatctcataccttcttgtcagtcgacagtgtcttcagaacataagggctcatcatgtaaaactgaacttgaacatcatcagcaacatacggcttccagctggtcccagaccattcgtagatctcaacagagtattccttcagggaatcatttacattagcatgtttaacttcacagtgctcaattgatataacaggcaaagagttaccaagtcatcattgatgcggtacatgccaggctcatttgtctccccaaccttgttatgcttgacattcactgcctgaaaagtgggacatagcaaggttatgacatcattcttatttataatttctgttgtagaaacaaacatattcaaaacaaagaaaaatgtgataaaggtaacatataacctttagatggcccctctcatggaagacccatttgcttgtttctgtcacaaattgttcatttccagctttctcatgcctgcaccaatatatgacaaatatataaagttaatatcatttccatttgattgaggatatcatacaaccatttttaacatacaaagcataatatgacaaacattaatacagtgacaaaagttacaatatgctttcagtttcaggtatgtctattcagaaatatgcagcactaagatctgcatatattga

SEQ ID NO: 13391 - DNA, 7498 bp, Oryza sativa
caaaagtttcaaaagtaattaagctcaccttatcttgctaccggccttctgaacaccagattttaggaacctattttaaaagacactgaataagcaatcttgtaaaatcagaggaagcaacttcgatttagcatacctgttgctaaacagatcgagtgatccagatatcaagacccgagcattgtttcttgcctgcaaagggacatattaggcttcttaaattcatcggaaagctacatactggtgatcacataaaactgatgagatacaaatctttgcagaccattggtctagcagtcaatactcaacaatgaacaacggaatgattactggccaagaaaactgtttcgcttgtcctttcacttttaaggaaataaagtaagcaaaacccataagcatcgacaccaggtggctaacactaatgtaaactaaattatttgttggccataaaaggaagggttgtagacttatgcagaactttacaggaaaccatttaactgaaatggattgatccataaatatggtttagtgtcttatgttaatattttgtcaaggatagaagcactaaaccaaatctgagcaacaaattccatagcatcaagcacatgagacaagcataaatcctgtacctgcataacagaaaccagtgatatagccgaccctgtgagagatggaggggaagccaacttagactttgggtttgctgagtatgctgacggagaggcggataagactttcaggacctacatatatttaaagaaggataaatgaaagattatagttaaaacttcctatccatagtaacaaaatagactaatagaggcatgcaattttttggtaacaaaatagaaattaaatgacttaccaagctgttagatggattaaccgcatgtccaattccccgaaataatacaggggcctagtaaacagggagagttattaaaagaaagcactacaagtacacattgtaaacaaaaaacagaaaaggtacccacacattgtgtcataggacagcagtggaaaatgtggtagaaagctttttgaatttaatttgacaggcactcgtgggcacaatggacagcaatgaaggaccaaaattgttcccatgacagccaaaattctactgactgcaaatactgtaaatattcttgctactgaataaatccaaaacagtactcagtccatgactctcatgctcattattcaaatatatcaatggtgatcaggatttagtctcaactcagctccaactacagtttattacaagaaagtaataaatatataaaaaattaaagagcagaacggttgaaagacatgagtcttttttgaagtattagtaccaacctcaattttctttgaccccagtatcacatctgactggatgaggtcatcaccagcaatcaaagtatgatcaccttcagcatcagtggcagcataattaatgtgatcaataaccattgcctctggatcctggcaccatccataaacacatgagactgagggaaacagagacaacgattgatcaaattaacaagctttagaaccacaggtatatcttacctcatcaaaatcaaccccacactctgttgcaatgcctcggataagatcagaggccgaagagtctgctgccaggatcatatcatgaccagcatcgatgaattccagaattgaattttggtccactgatcctccaaaacctgccagtgaaaagatacaaacattaagacttcgcaggactgaggctaaaccaaaactgaagcatcacgagcagagagcaaagcatttgcaacttaacccacagatttaaccagccacaaaggagcaaaaatcaattactctgtagcacagcagaattgaaacgaacttgactgttacaaccagagcaatcaaatcagaacacaagtaaatagcccttgcagtggttgatactgttacaatctcatttttccactagagctaaacaactaagcataacctctacagaaccttactacctaaatccttccagttggcgtagaattcaacaccccaaaacccaatggatggattgagctacccatcagagatcacagaattccactactcccaaaacacagatcggatcagacgaacgacctctctactctacggatctaacgcaaaaaccaacccatagccacagatcggatcaagccccatccatccacgaactgagtcactggatctcatgagcaggggggggataatgagggagagagcgtgggggaaaattaattacgcggggtggagggggcgaagaggacgaggccgtcgtagaggtactggccgtagcggtggagtgagagcttggggtcgtcggcgaggcggaagtcgagatcgaaccctcgcccctggagcgacgcgaagaaggccgagtgcgacgaccgcaccgccaggtcgtccacgagcaccagcacccgcctcccccgcggtcccccctcgtccgccgccgcggcggtgacgacgaggagggcgagggcgacggcgagggcgaggtggtggtggcgcggcgccgccattgctgcgagatctcgcggcgtggggaggttttgtttcgcgtggggtttgggagaggaggcgacgacgacgaggaggacttgaggacgcttggaggggggagagggagagatctgggccgtccgatcgtgcgatccgacggcttccaatggactggatcgaagtggccgtgtgcagtgtggctgtctggtctaggtggtgattgacaatccggccccaccgtcagtggttgtttttgtttgcattttcatcctgaaggtttaagggtctgttcagattatgtcaaaatgaacattttcaaaattttggtaaattagtaacattgtcaaattttagtagaatgtgctcgattcaatattatcaaaattccatagacattaccaaaatttggtaacaaactaaatataattacatagttgacgattttaccaaataatggcatggtttgaaatagtatcgatctgaacaagccctaaatcatcgttctttttgtttttttattataatctcgtgtgattatttattggatattttgcttaagctctttcttagtacgtaggataagacaatctatcatgccgtgaaattccaaattggaatttgatagtcacttcttacagtggaaaaatagagaggatattttgctgaatttgaaatcaaatgatgaaatgtgaaaaaagagaaagccatcgttagaagttgtttttgttttcattttcatgagattaattcatccattgttcttttgattttttttattaactcgcgtgattgtttattagatattttgcttaagcttttaaattttgtttctttgtacaagagaatctatcatgccaagaaattccaaattgaaatttgatagcagtttcgcgaaaaccgattggaatagtaagccggggtttaaaccaataaaaccattatagattcttatgactatttctgtacagtatttttacaaagggaggcatgtaggtaccgtatcatatgaagataggcttaagctgtagaacaccatatgatttccaattcaacgtcaactattagggtcagctcagcacccagagcaatctcaaaaaattgtattctgaataatgagcataatatccaaactgaatctgttgacagtggaattttccagttaatccgttacaaaactaggaattcggtattactaacataaatcacatcagcatggattacaccatctactctctctttgcctaccaaagaacaagtggtcatgatagctgcaattgcctgcaaacagttacagcaaaaacaccactttctctccacatgggtaatcaccaggtcaaactatccacctgaagatgaatgcttcatgttgtagcctgaagaagcccgaacctgaattttctttgagctgccagaccagagctttagtcggagcacaagcggtttcttcataccagctcctgatccttgaagctcgacagtttcgcattctcccggtcacgcttgaacacaaggtacaaggggctgtagaacaggacgcagacgccgaaaggaacaatcatcattgtcagaagtcccctggagagcgcatacgctccttctgctgacccgttcgcaaggttcacagtcttgctgtcatagccatatatcttctcggtgaccaagccgacagcgggagctgccagcgaggcgaatgagccctcgaatgcacggtcgaaggcgtagatcatggtccggtgcttgggagggactacctccgcaaacatggggttgtttgcagaggtggcgcaccagcttatggtgatgcccatgaagaagagggtgacggcgtaggcggaccagtaatcaaccgactgcgggatgaccgtcaggaggatccacgagaaagggatgcccatgaaggcactgaactgagcacacatgacacgtgcagaatctggaaagtgtcgcgagaggcgatctgctatcacccctccaaggaaagctccagttgcgcacccaatggcaaacaggctattcaatgccgccgagctgttattgtcaaaacctaagaggatttaaacatcttgacgtcaaattgagggcactgtaatcatttgagtgttcaaaataataatcaatttgtcatcataccgatgagttcaaaccacattgtgaagaaaactatggcagtccatggcaatgatccaattattccttgcaggacgatgatctgaaacgtccgcaccttcattacagatcttgttgctaccaaagaatccctccatatagaaggaggtggaagaacatctttgctggccaaatgtaacctgggtgatgaaataccaatttatgctgtcatactgaagtgcatatagtattgttcacagttaccagctgcaggttttaattctaatattgtgcagtaattagttcagggataaatccattgcacgcttacccaaagcacaacgaatgcaaatttacaattgatgagctacgcacaacgaatgcaaatttacaaatttacaatgcaatctacccaaagcagaccatgaatctagaaaggaaaagcgatgtaaaattccaatagaatctgatccattggataaaaaacataggatggcccatttatcctagtgtatcataaaaagaaatcatattgttaagctcatctacaaaataaccctgttctgaaatgaaattcgaagcagattaaaatcacgcaaacaaagaaagcgttataatgatttcatatcctatatgacaaaatcataatgatatggagatactacttgagatgatttccatgttactgtattgaactccaaaagatctgttgaagaattttattcttaaaccctttttgtaaaccggacttgagtggtactttttatcaatgatgtaacacaagaagatgatacggaacgaattaaataacatagataaaagtacctctcatagtcatcgtcgtcaagaagatgattaccagggatttttcttgggtcagtcgcatataagtacacaagaatgccaattatcaaactgacgagagcaaccataataaatgcaacacgccatcctgccaaaccccaatagtcatttccagccatgattgtggctagaatgctaccacctataccacctactgcaccgatgaggcttagtaaaccaaaccctgcgccacgtgtaccatctttgtagctgtcagcgatgaacgactgaagtgccggtattacaatagcaagtccaaggccatttacagctctccagaatgcaacctgccggaaatgctggctaactccaacagcccctgttgataaggcccagaagacagtccctattgcaagcactgttgggcgatcatagtgaagggagaggatacctgccaagggagatgctatcgacttcagaaagttcattagaaatgtaaggtatcccagatcagcaggaccagcattgaacgctgcactgacttccttgtaaactgccggaggagattctcatcggcacgctccataatggaagccagattgatgaggatgagagatacagagaaaccaaaaatattctttgctctgcaagaagggaaagactagaaacggttaattctatattacgcaaggtaagtttccctacagtagaaaatgtaattgtgtgcctcaattttctcaaccttcattcgaaccatctaatttccaactggatacagcacaagcattggaatgacatagccatgagtccatgacatttgcattttgcagtttgaactttgaactacagatagaattttgaaatttaagctgcacaaacctgatgtctcttgacatgaacctagaacatggcactagaattgaagagattcaacagaaatggagctactttgctgagaacacgatggtggtctggcttttttccaaatgagcaagacatagaaaagtccgacagatctagctcaaatatatcaaattgtgtttttttttataaaggaagcttttattaatctcagacgattacatccaattgtgtacagaattgcttgttaagttcattttacatgatatggttccacatgtaacaacttgtcagaaccgtgaagcaatcttctgtaagatggaattaagtcttgtttgtaacggtggaacctaacaatggaaaaccagaacttaagaagaaatctgctcccatatttttttccattcgaatgaaagtgggtatccactcaacacccaccatatgccacataacctaagaccaaacaccatctgaagtgcgcggcatatcctcaacaccttttctctatccaaattgcgccagcaactagctagagcttgccttttttttcattgcccactagctgagaaaaaggtgaacgatagtggggtgaatgtcaatgccaagtccacttgcagtggtacttcatgctggcatcaccatgttccatgcctaccggtcaacgaaacactgaagcttcttccaagatcttcctgtgccttttcctctcagaaaagataaggtgaaaaagattaaacttggtcacatccattcttgttcttggttaccaattcctactgcagtctagccaccgacggcattgcccatacatgaagccattagccatggatctgaatcaaaattctcactaatcttatcctacttgacccgatataaaagactaaaagacgaagctttgctgcgatgcttgccgatgtaagcacatggcatatcacccaaaaagcatttcttgagcttcttgtgctcgatctggtaccaaatacccatatataacatcgagaatcctcgtttgagataccaaatagcccgtatgtctaagaaatgccaaaaaaaaactaaaaagaaagaaaacaaaagcaagctataaacaaatccttctcatttcccatttcttgttttatttgaatcaaagcatcaccaagattccaccacaccccagcttcacggagcattgctttcccaacaaattggggaaaaaaaagaggagcat

SEQ ID NO: 13392 - DNA, 557 bp, Oryza sativa
atgacacatttatcactgccagccgacatattcaacaaaatgcataaaggaagtgcacttttattaattctcctgtactattcttaaaccgaacagtacaccatttattcaatacatgaagaacaaattaaaatgattttgcaaatcctcacatatgtatactatttattacatggaattcaaacatataaataaaacctcaatatttatcaggataatgttgccacaagtgctccactaggtcttcacgtagctgatagtgagtttcgtcgtcccttatttttttgtgcatctggataaaattatcaagatcaggtatttcatcgtgggacactctgacattttctcctccctctgggaaccgttcttcccaatcaacttctccctcatcttcaataatcatgttatgcatgataacacaagctttcatgatgtatcccagagtcttttcatcccaatgtcgagctggccctcgaacaatggcaaatcgagcttgcagaaccccaaaagctcgttcgacatccttcattactgcttcctgtgctttggcaaaatat

SEQ ID NO: 13393 - DNA, 913 bp, Oryza sativa
tggcccggggcgacgacggcggcggaccggagctcgacggcgacggcggagagagagagcgacggcgcgagctcgattccggcgaggacgaagggcggcgagaggcggaaacggacggaggaggagcggggagggtttaaatagagccgggtcgagagagggtggccggggaagggaggaaaccggcgcgggaggtctggccaccatcaatggcgccggcgagcccacttgtcaatctctctctctctgttcttcttcttcctctctctctgttcgtctctttctcattgcgccgccgccgagctccaccatggctgagccgtcgtgcgtcgtcgccgtcggcggtgaaccccagctctagtgtcgaccaaactgagagaggaagccctcaatctcttcgccgtcctcaaatccctcgccggccatgaagaagaaaacgcccgctgtcactgtagagctatctccatgtctgcctcaccaccgttccatacttaccttaacatgccgaagatttttcattttgattccatcctctctcgtgcagcggatcgacgggaacgccatcgtgtcatcgccggccttggagcgcgctctgcgcgtcgccgcctcgacgtcgtcaccgttccgggtgcagtggatcgttgtaggccgagccaccacgccatcagcttcacctcgacctcctctctatttacccccaagtaccctatccagtcgcgcagcgatcttagagatcggcatcatctttctccaactccggtcgctgagctccatctttgatttctccctctccggtgagtcccaatccgattccttgccatggtagcctctcatggacctttctaacacgaaagacatgcatgcatgacaattctttgaagaaattgagccatcgccgttcatccaaggtgaa

SEQ ID NO: 13394 - DNA, 5347 bp, Oryza sativa
  unsure (1)..(5347): unsure at all n locations
caacgaagacatggcagaagaggaggaactgaaggagccactcacttaggctaggagttcagatggtgaattcccaggactatggtggtccagagccgtgtgcggttgggggatcagcggcgacgtagtcgtggatgacgggcggtgactcggtgaaggcggcgatggaggatcggcgggcggcgtggtcgtggtcgtggtcgtggtcgtggtcgacggggatcggcaacggaagacgggcggcaactcttggaggcgcgacggagatcggcggctgcgcggaggacggggatcgcgaggagctagggtttgcgagagagagagagaggggggatcggagccgggactgggcggcggattggatcgacgggagagaggcggcggtgggagggcagactggggcggcgacgggagtcgatagcggcgatgcgatgcgggagaggaagcagcggatctcggagggaggcacgggagagagagagaggcgcggatgcggtgcgggagagagggagttgcggaagggagaggagcggatgccgtccgatgcgggagagagcgcgatcaaagggaggtgcggagccatccgatctaaggttgcgttccgaacagtcttccctacacgggcaggatatgcgcacggaaaacggaacggttctctagtgtgtgattaattatttgctaattttttaaaaaatggatcaatatgatttttttaagttactttcgtatagaaacttttttaaaaaaatataccgtttagcagtttgaaaagcgtgggcgcggaagacgatggggtaacgccgaacacagctgtatccacaaatgaatttggatcgttggatgtgtcacacgataaacaaataaaactatttgttgaattataaggtaggtagattaaacggatgggcaatatgctagttaatgcaaatggcacaagacaagttatgttgtgtgtcaaggacaataatacttttcttttcttcgatacttcgatccagacttcaacagtttgtcaccataaatttacagaaagttgattttgatataaaaaagactactgacaagttttacagccatgcataactcatacagagtagaaggcagcattagaaggtaaaccatttccagtagatacaagaacgcccagatattgagcataatccactccaaatttgataatctaaacttgcaaactatacttcaacctaaccacatttatcggctacatatgatcgagcagtgccattgtttttttaccctgaggtgtcaaatgtcataaagcgttatctcctactcggcattaagcctgctaatggactgggttaaatggactgggttctagtttggattatctttggttgggtgaaaatgggttgctacttcaaatggattggatcggtttgggtgacacagagaagtggattggtgcgcccaggatttgattcggtgatttccggttgaaaatggatttaacccatggatgtatagatggccaaaaggcccgcctggtacggcccggcccaggcacggcccaccagccatcgggctggcacggctcaacaaagtgccgggccatgccggcccatgggctgctcctctcgcctaggtcgggccggcccgaaggcacgaagtggcccatcgtgccttttttttaaataagtctattttacttccctcctctttgggtcgtgacatatatatatatatatatatatatatatatattttgctacattaagtctattttccctccctcctctttgggctgacatatatatagctaaaataagtctattttacgtctctattctttcgaccgtggcatataatatgtctatttttactccctattgtttatgtgtcgggcttggcctgtggcccatcatgccttgccggcccggtccaacatgccggtggaggggcccaggcacggccccaacccccatcgggtcgtgccgtgcttgggccgggccaaaatgtcgtgccgtgggccgggccatcgggcctcgggcctcgggccttttggccatctatacatggatagcaagtggattcctttaatggactgagtctgactactttctgtcgtcctctgccgcaccgcacatgacctggacttggcggctgctgctggcggagaggccgcgcatggcgccacctcatccgtgggagccgagggccgaggcagccggtacgtgtgcagttgcatctcttcaaactcctcccgctttgccgcctagagctagccactcttgagccaactgggcttctcgctgttgtcccactgctcccacatggggacagggcctccttgccgtggccggtgatggcgcgctgagcctggacaacatctactatggcggggacggcgccgctgggcatgtccaccacatctaactgcaggtgtgcgacatgtacgagggaccagctgcgctgtcggcccgtcgctcgccgccgtcgtcgaggagatggtcgtggccgctgctgttgtggtgagctggctggcctcacgctgcgcctgcaccgacgtgacagcagctgagaacggcgccggtgtcctgtcctccgccgccgccacgacgccacagctacagccatgcagcacatactttgtccggctgcgtcgccgccagcaaggacggcatggctaatgaaggatcgaagtggatttaaagtgggtttaaatggtttggaaggtggattgacaccataaaaagaggaatgggttggttcggtttggactgacgaggaaaatggattggtctggtttggattttatgggatggatagtggattgggatggtttggatagaattgttagctgttgtggattggattcgatatggggtggatcttgccctacattggactctagaccctaggccatcactctgtttattgaccttatgaacgaaacctccccatgttgccaaccaaaaattggatcaagctacagcaacatcagaacagagtaaactgcaagagaagaattaccacacgagctaacagcaacggagcaaccccatccccatgccaaaatccttgtacatgccctttcccaagacgaaaaagaaaaataaaccgtgctgatgtgaaaacatctgcacaacccggattaggatcctctgacgtgaagtcagagggacgtggtgactgacatgtgggtcccnccgctngtggacccacatgtcagtgaccacgtcatggggcagttcacgtaagaggaacggcttccgcacaacccatatccgcagcacagcagagccgagcaagccggattagccgtccgttccaaggatacactgggcatttgatcgcatggctggtttacgagatccagtgacatgccggcggcgtctacagcaaccccgcatacacacacggggatcaaatcatgggaagcgcaagagatattgtgaactggggggaggagcgtcgggagaagggggaaccaatcaccacggaggtcgggagaaggggggaaccaatcaccgcacacacgcaccgtttagcagcttaattgagaagcgtgcgcaccagaaacaacagagtggagccatggaggttgggaaccggccaccacagacgaacttagcctatgtgtggttaatgctatttctattttctctcgttaagctatgtcacttcaattgtttctagctcctagatgattgatctatggtccaaattacttcctccctccctcctattcttctcttatgaattcatatcactttgattttatctttagataattaatctatgttacctttcttcttttccttctctcaatgagtaatatcacattagttttgcattcgaatgatcaatctatatatgatttaaatgttataagccacattatcttagttgtttatagatttttctcaatagttaacaaatatgaaaattatataaagtatataaaattatatcgtctagctatcttacatattatttttattattatgtaacccatgaggttttagctacttttaatactgaaggagtgcaaatcatcataagttcataaccacgccacatggacacttgacaagttgggtggtttaatttagggcacgttctaattagcacattgggattatagctaggattgttgtaccacgcttccaaaggtaaaggcaaattttgctacagaacacctaaattttgtgtaatttgctgatagatatcgaaaaaacatatcacggctgaaagacatattaaaaaactggtaatttgctagatgatactttcggcttaattggattgataaattcttaataaagacgagaatgtccctaacaccacatgcttcaaacatgatgttagagtaaaattttagaaagtatgcaactctaaatttgccatctccccaagtatatcactagcatacattatatttcaccttcgctccagtctcagcccaaaggcttttgacactaggggcattcttgtctttttgaaaaaaaattccctccaattgagccaaaagtgtcctccagcaaattatcagttttttagagtgtctttcagccatgacacgtttttacaatgtctaccagtaaattacacaatttttgagtgtcccgtagcaaaatttgccggtaaaccaagcaaatctctctgcatcagcattacctacgtaactttttctaagctattttcaactttataatgtataagtcatcttataagtaattttggctaatctatcattttagcatgtgtttggttgggagcatatcccgggatgcgatgggatcatcccatttttgcatatgtatggttgagaaactaggagggataggatggttccaaaagagaatattccttcaatattcgggatagcctcatccgaaaaaaagtggcggacgaagccatcccacctccgcacccatgactcgcgcctcatgtgcggtaaccctttcaccgcatctcaattttccccttcgttcttttctcctcacgagtctgttcctagggttagcagcgggagcagtgcgcgaggcggctgcgcgagcgggggtgagccggcgagacaaggcggcgggtgtaacgccccgattttcgttcgggaataaaaatcaattaataatacattttctagaaattaaataaaagttaaatcaatttaatcaagtgaaataatgggagaatttgaaattttcctttaaaaatcatggccgggaatattttgtaatattctttgtgccctaatgtactctccggaattttccgtgaattttcggagctcgagaaatagttttaatagcacaaagatcattgcatcaattaaaataaaaagaaaaaaaataaaatcctccctgctctctttgggcccctt

SEQ ID NO: 13395 - DNA, 19738 bp, Oryza sativa
gcctcccctcccctataaaaacaatcccccggccatcctttcccttttccccaactttcccgcactccccgcgctctctcccgctctccccacacgagcccaagcgccgccgatcgccggcgaccctccagccggccgctgccgccactgtcgacgtccccgcgccgcgccgcttgcaccaccggcttcgccgtgccttgccgcacctcggccccactccgttttcccatttcatcgccggaaccacctccccaccgcgctccctttttccaccactaaccgacgagctccggccgccgctcctcgccgctccagccactgccaagccgcgccctaccaccgtcggcttcgctgcatcgcgtggtaccccggccgctcttccaccttcgttggagaccgccgaatcaccgccgtcgtcttcgccccgtggagtgctgccgcctccctctgctcgagccccatcagccgcctccttcgccgccatgcccctcggtgagctccgccgcctcccttttcgcctcctccgctcgttttcgccgctccccggccgccccctcgctcgtcgggccgacgccgccatcaccgttgtcgtcgtcgtccttcccgcgtcggtgagcatctccctcctcctcccctccctttctttttctctctttgcccgccggccgccgcatgcgtgtcgccgtcgcgccgcgccgcgccgccgccggtgtcgccgccggtggccgtccggccgcgcgccgccgtctggtcgggttggtcggcgagccaacccacccctccgccttgcacctctaccgtggactcggtccacggtgggctagatccttttgcccgctgacgcgtggggcccgctcatttggtggacccggtccaagcccgcacctccttgacccgctaacgtgttgggcccacctgtcggcgtcggcgccccttgctgacgtcagcgaatgccatttcctttgagaaaatatttaataattgcgcaataaatcgagtttaattctagaaattcatttaaatggcccaaaacttctaaaattcatgtctaattcattcgaactacgaattgagccattcaacttgcaaaattcatctaaaattgagctctacatgtttgttaagtttttatgtactgtttccttggtttttattagagtttttcctcgttttgcgtgccagcgtgtagtttccgtcgtttcggaagtctgcggtcgcaaggaaaagagttcggaagatcaaagtgaagaagcaaggcaagtcacacattccccttgagcattttgatcctaatttacaaatattttactgtttgcaaacaaatatgcatgttttgctaattacatggggtcagggttttacctatctgctcgcttgtgccatgtttacttgatatctgttctttgtcaaccttgggtaataaatcgactagctcatgttacttatgtgacctagctagaactatatgcttagccatgcttaattactactagctcagttgatgggataattacagtattagacctttttagtatcagaatgagctatgtgctcaagacatctggccatgcttcatggtcataattatccaactaaaatgcgactgaatggtgggctgtgggtgcatggttttgctagtcgcacccatggcagttaaggaccggttcgcgggatgccctggaagaacttatcgtacttaccacaagccagcgtgggcaacggctggacttgtagtgtatctttcctctagtcgacgcatccaggcaagggtgggcgtgatggagcggggcgggccctgcgacggcctctgtcgcttccggattcacctaggcacgagaggggactgcccgttgcccgctgggaacgggggtgaaacctgaggtgtggtgtgcttggctagagggggttatgcgaagggtcctgtcacggactctttccggtatgtcgtggtggcatgtcggcgcacggaaacgtgtcgtggggctgtgtcttgtgggtacagttgtacacctctgatcagagtaaaactattcgaatagccgtgcccgcggttatggccggtcgaccagattcaccgtgattagtcccatcttaataaatcgacccaatgcactgtaattcaaggtgggttggttgggcctgttcaacgtggtgtagggttaatcagtggaaattcaatattactttaattactcaaccgtttacggttttctcaataaaatgttttacaaccgcctttatgcaaatagccacaaacccctccttgtatcccctttgcacgtctgcatcgttggtgtggcttgctgagtacggtggttgtactcagtcttgctattattcccccttttcagaagtgtagtgcttctgagctgaagacgaagttagaggaccaaggctcagaccccagttgagttttgcctgtggagtggagctgaagccccgctaggatcgtcttttccgctgccgccgcttttgtttcggtgtgaggactaagtgcctctcctgtaagtattttacgctttatttacgtttggaactgtatattacttgtcgttttgtgtaccctggctggtcctggacagggatttaatacgcaaaatagtctggaaatttgggttaaatttctgggcgtgacagcgggcaagcaggggcgaggtagcagcgcgagcagggcgcgagacggcgtgcgagcaggaagatggtggtgcctcctctcttgccggtctcttctcactcttatatcctttgttcgtagccaacaaccacagatcttgccgctgctatactaaaggtcggtgagccggacaataagccaccagaaggtttacttgacacattgaaaatccttctcggttttcaggagatccacaaatctttttactatgctcatttggtttccaatcttcacattgctagaactttcgatggacttccatttgaaaacaagctgcattgggttgctatgttcattagtgagaagtcccctagatcaatgtagggttattggaagagttgaatagttcttttggtattatgtgttgttggttgacctatgttgttattatgtaaggcttaaactgccaaaatgagaacttactattaggtgcaagacttaaatttgctatttatgcgtaagaccttaaactgctataatgtgtaagactttaatttgctattatgtttaagacttgaagttactatgtgtggcttgaattttctatgtacagattgatacaagaattggtgtatgctaattatttatgatttttttgaatggactatgtgatatgaattgcattttatttccaaatatagtgatatgaacagtattctatattccaatataaaatatagtgtgatacttatgtctaaatgttatttttgcaatgtgtatactctgatgggtaacatcaccaaactaatggagtaggtaactctatacaggaatcccaccttcatccctccatccaaacaagggttaggatcattccattccaacccataatatccctcaaaccaaacaaaaaaacatggttcgttctatcccttgaaccaaacgaaaaataggatcatcccatcccattccaaaaacagagatggaactaatccatcccacctcgtgcccaaactaaacaggatcattactttgagctttgaggacggtttaaatagatatatgggattatttcccctcatttctcttcaacttgcttgaagcatccatggtggcatggctacattgccatgagcataagcacagatcaagaagcgtattactcctatatatccaatcagccgatataaagtgcaagtgcaacatcaacacccaaaaagaggttaattaaactaatcccctatgtcaaaatcgaaacatgtcataattgtaatttgtaaatagtaatttggttgcattgtcacatccaatgctcacgaccacccatttgccaccacaaccttgctcacccagtcactatctgcttaatttgttattaggtaaatgcaaatcatatataatgtgtctgcatcaggattagattgtcactgcttgtaagcctgttattagttggcctgcagctgagggcagatctctgacgaaactgaaattcccttccacaccggtcatcacacagcaattttaaacaaaaagttcagtatgaaatggagcaggatattaaggtctgtaatggctaacatttcagatttaactgcacaaacatacagtaggacagtctaagtaattaagcattagcattatgttctataaggtcagtacaaatcactactttgcgaacactcctctgaactctgaatgtttacaatacaaaactaagcacacatttctacagaattaagtaacacatatatatacaacatatatcatgattatatagaagcaatagagctacttgatcaaccatatgcaaagaagaagatgatgtgaaattgattgatcaattaagtagaaaacaagtaataatcataattagctagctagagatgatataattgagcaaggctagctagctttggttagaactttagaaggagaagaaggagcgcttggatggcaccctgccggcggccttgcagaagttggcacggtcgagcacctttgccgtcttcctcccgcgccgcgcctccgccgacgcccgccgttcctccgccttccgccgcgccgccgccgcctcgttgcgagccttctccgtcgccttcgcccgctcctcctccagcttcctctgtcaatggattgatcgatgttatagctgatgatttctgcatgatcgagttcttggtcggatcaatggcgaattagttggttttttttacctcgatcttggcgagccaggcggtggccttgtcgacttgctggctctcccagccattgatgacgacctcctcgcgcttgaacttgttgttgatcttggccacctcctccgcctgccacgccgccaccttcgcctccacctcctccttcttcacctgctccaccggcgccggcgggccgctgcccgccgccgccggcacgatggcgagcgcgttcgcctcggccgccggctcgttctcgccgatgcgcgccagctgcagcaggttcaggtcggcggcggcgggggcgtcgccgggaacgtcggggctgggcgcggacgacgacccggccgccaccatggcggtgaactcgcggctcatggtggcgaacagctcgacgtcgccgccgccgcccgcgccggaggacgacagcgagcggtggctcgcggcgtcccacgacggctgcctgagcggcggcggcggtagatgcggaggcgacggctccgggtggatgtcccggaacgcctccacctccacgtcgtcggcgacatcgtccggctcggcgcggggagccgacggcgccgggcggtgctcgagctggtccgaacccagcatagctactggctgatcagtatcgatcggatcagagggcggtggtggccatggatggatgcggggttcttggaggtggaggagaagagtggaagcagaggaggggaaggggattgggtgggaggaggtgggaaaaggaggcgcgtgcacggctcgtgatcggcatgcagggggacacgtcgctctcggattaacatgaggttttaccgttttccctccgtcaccaaataggttaatttagtctcgtagtactaaattaacttaactattaattttcatcagtagcaatagtgtaccgatggtagatgagtcatggcttcttcaacagtgtacttcgtttggcttattaggctgtttgaatttaatgaaggtaaagatgttgttagcgtacataaaacgagaaaattattaacgtgtgattaattgaattttaattattataaattttcctatttatttgatattttaaagcaaattctatataaaaagtttttacacgaaaccctccatttaacagtttaaaaagcgtggtaacggaaaacgagaaaaaaaatatgtatcttaatgaaaaaaaaaccatttccaaaaaaaatactgactagatacataactaaaatatctatattttaaaatagaggatgcactaggggactcgatctagttttaaatgcaagcccatgaaatatcttttttttatattgagaatacactataaaagtcacattggttgcccaaataatccaaaatttaaaatttcaaacttaatttagaatttgattttcagataattttaacgtatttttttataatggcttttaagtcactaagaacacatacataaaaattatatctataaattaattttattccctaataagccattttatcttattagaaaatatgggcaatcgatgaggagctaaatttgtatcctttaagtggcgggcaattactttactgatatcaatcgttggatataattttagaaactagttcgctcttttcctgtaacaagacaaccatatatatgtagacgattctcactgtaacaagacacaagacaatcatatggagacgctttatatatgcaatagagacattctagcttgtctccacaggattgtaaagatgtactccctccgtttcgaaatgtttgacaccgttgactttttagcatatgtttgaccgttcgtcttattcaaaaacttttgtgaaatatgtaaaattatatgcttacataaaaatatatttaccaatgaatcaaaccataccaaaagaattaacaattacttaaattttttaataagacgaacggtcaaacatttgctaacagtcaacggtgtcaaatatttcgaaacggagggagtatttggaaagtgccataggaacgtctgtgttacaaagagaagagatagaaatgagatgaactcattggtcctcttctctgataatatgccaagtgactttaccagatgatgccaagcgactggcctaaagacttgggtaaaaaggtgtggttgtgtgaggtgggaaaagaaaaatagttcaccaatgtaggggtttagatgaagatcgatcatggcatcagatgcctaccgacaagaggacataattaatttggttacatgaacaattggagaaacataagataaagatgaaagagtgtaacttgctagatgtaacgacaaatctaaagggcagcaacaaagacggacgacaaaggattatgatttttttaagttgctagaagatattgaattcgagagaatgaaaatctagaaacataggacatgagagatgattcatgccaattgcaatgtgtacttattgagtgatatcattattgtttttcatgatataattcaatgatatcctaaaataatcgaatgaaccggctagaaatttaacccatgatgatgaacctctcaactagtagctatactctactatctactgttcatattatgttgattgcaatcctcaacaaagacaaaaaagcaacccccagaaatataatactaatataatacaattaccaaaaagccatgtccaattaattatttgcactggtttaattagtggagaaaatgatagatcaccggggtccctttcatgtggatgagttggaatggaacaggcatggttacaaggtgaggcatcaccctcacattgacatggaccgtctacctctaagcttgtgacagcccagggccaatacacactgattacctgtctccttgctgtgcttttctccagggccgtcggatcaggaaagtacgtcctaaattaatttggatttcttctttaaaatttctacactctcacatgtggaatacctttctgaactcatcgctaccttgtacatatactttctctatttcacattataaaatattttaagttttgaatagatttatacatagatccgtttacgtgctttatatatgtttaaattcatataaatgttaatgaatctagatgaaagattggacagatatagacatattataatatgaaatgaagagagcatatatctagaattatgatatgctgatcttaccctaggagcaatggagaagaataatataaaagaaacagtatacctctgtaattaagcatggtgatcttgattaattaagttccaaagtaatcactcctactaatgagtactgtatataagaagctggagttcgacctatgtgttgtccaaaaacattgatggtttaattttctctcagttactccagacaatgccagggcatggaatctgctgaagaacaagttcagtcacatgaggtggttagcaaaccaaccttcctctgactaatttaatagcatgttgcattgtttggttgagattttttttcccttctctttgatatgagaacaaaataacaagaagcaagtcaattatatgcacatgagtgatagatcaggtgcagccggtgagctgtaccctactgttcatattgcaatatcaattactaattagttatttgcacttggaagttgccacactgttcaggcatggccatcaattggctaactagctaggcatgccatttcagaggcattagtctatttctaggttgtattaagaatggcttattccataaagattagggttttttaatttattcaaaaagtaatggaggagatactaaaaccgacacatctttgaccactaaatgcaaaactcactatctcaacactagtaggcgacattatagttgagccttgagataaaattttctaattaagatgttttaagagagcacttgtattatatttttgtattatatgttttaagctggagtatgtggtttgtactcttgtatctgcatctgtatagtattatacgactacatgtatttacctcttctagtaatattaaaagcatatttaaacttcttaggtgcgtttgatttagattattgagcaaactatcgacttgattatataaataaattaaatattttaagagataaacttaataaatagattaaaataagtggtcttgagaacacacatttttcaaggtgtggatgaaataatttatcttaataatttaactgataatctcaaaataaattgtgtataaaatccagacgatcttcataatttcattgaagaggcaacgtactttagccctgtttaggttccaccttaaaatttttcaccctgtcacatcgaacgattaaacacctgcatggagtattaaatataagctaaaaaataactaactgcacagattgcgactaatttgcgaaacgaatcttttaagcctaattgcttcatggtttaacaatgtggtgctacaataaacatttggtaacgacgaattaattaggcttaataaatttatctcttggtttactgacggattatataattagtttttctattattgtctgaacaccccatacgatatcctttacaatactcgatgtgacacgctaaaactttacaaccctaaatctaaacaccctttaaaaatcggaacgtgaacgtaaaagagacctcaaatgataagatgaaatcgtgaaacctaagattaataaccggttttccatttctcccaatgtcgctgctgtccggacaggcagtgagacaggcacatcccttctacctcggctctgattaactgaaactgacacaaagtttcagaagcccaaggcaacacgtaacggtttcgccagaattacgtaaatggccctgggtggagagcccaacaaccgcgcggccgggctgtcggtggcatcgaagaaaaaaaaagaaatgagatccacacgcgtacacctaacatgcaaaacggaaaaaaaatgaaagaaaaggaagcatacgtcacttaccggtgggcccggctcactgttgtgtcggtcgtggatgttctgctgctgctagcagggctcacagctcgcaacagttgttgggtgtcagctcggtggcttcctccattttcacatgatttaatttctctcttgttttttttcctgttgagaatgaatttcacgtggcaaaaggaattaaatcatgtattgttgaggatgcataaggcgttgttttaaccacttcgaataatgaattgttagcgtatacttcgtctgtcccaaaaaaaaattaatctaggagggaatgtgactcctcctaaattgatgtatgtggactaggttaatttctttggacggagggagtatatatgtaattattttcaacttattccatggtgtgatattcgtcatagatagttagaagactgagtttacatatacatgatatgttctatacattattttaattaccaaacgatatgtacatgtcatggtgactacatatattagtaacaattaatgtgattatagttgaacaatatgtgaaggagccatgatggtagtacagtgcatcatatctcgttatctcccactaaatatctgctagtgacaaccactgtacaggaaacttgtttgctattccattgttccactttagttggtgtggctcaagccacaattaaagttggcatatacacttaattaaaaggcatacgtaatcatttataaattttattggcttgccataacacttgaacaagcttgctttgttacaaatatatcccttcttgaaaaatctatggttattttagcaagaaaagaaagcatatctatcactcattacaacattgtttgtacctaaacaactaaacataatgtttttatttttgttttcatagcattcctctctcaaatacacacgacataagtcccctattactattactattatcggtgcctggttccttatacaagttaatttcttagggaaaacacgttcattcagagaaccaatagatttatgttgtcgtgtatcatttgtttttcttatgttattttctttcccattggcatgcgagcacttctagtgtttagcgtactcatattcatgagggtcaagcaataatagcttcctctcatttctcatcgtcgaattgaccgtgacagacagagtattcgagataatcacaaacgatgagatgagaatattggggatttgcaaattaatcaggatacaattaataatataccagtcacatttagccatacgtgatatagaggtggatttgttatcgaagagaggtaaaaccattacttattatttgaaacgtaattgctaaaaaactgtcacgagtttttttggaaaaaaaaacttttagatataactatagtatagattgcaatgcaatagttatagtgaaaaaattatagttacattataactgcattataactacagtgtaagcacggtaactccaatgtaatttctatataagttagatataaagttacatatactattttaatacttatatataagttacattatattttatttatagtagaattatattacaattatactataagttatggttaccgttatacttgtgacagttttttttaaagatatagtcccattttgaaattcttagaagagactgtgtgggcctagcaatttccccgcaacagccgcgatccatgcccgcgcggtgatttcctctgtcggtgcccgaccgccaacgcccgctgacacgtgggccccgcttgccctccagctcacctttcgtctacctcccgcctcacactcctcccctcacctcctctcctcgattaaattaacccccgaaatccaccaccaaacgctcgcgagattaatccgattttaatcctcgagatttgtttaatggcagggctaatctcgccccaggccttgtagaaagcgacacccaaaccaactcacctccattggtgaggtgccctgtccttttctctctcctcctcctcctccatagttaagctccccaccaccactactactagtagtagtagcgctgccacctcccgctccactcccgcgtcctctgctggaagccttcttctcctcgccgggaggattccaggtaatgcccgctccgccgccgccgccggtgactctgctctggtgtgtttcttgggtatcagttcttgatctggatgttgttcgattcgtttcttggcagcgcgggatgcggcggtgctgatcccggtgtgcacggatcttgggtgtgattcggtgagctgagagctggtttgctgctgctgcagcgtgcgccatggacggcgacgcggatgccgtggtgagtgccccccgcccgaaatgccgatgggttttcggccgcatctcgtgtggatcttgtggaggagactccagattttgatttgatttggttttgatttggttttgtgggtgatctatctgttgcgcagaagtcggggaggcacgggagcgggcaggcgtgccagatctgcggcgacggcgtgggcacgacggcggagggcgacgtgttcgccgcctgcgacgtctgcggcttcccggtgtgccgcccctgctacgagtacgagcgcaaggatggcacccaggcttgcccccagtgcaagaccaagtacaagcgccacaagggtaaatgctaccatctctctcttctcctctccctcctctccatttccgccgatctcgccgccatcgactgtaaataagttcagaaacatctcagaaaaaaaaagtctggatctctagttcagaacagtcaaaacgagcattcttatagatggatcctgttgctttcttgttaggaaggtcatacaagatccaatgtttgttgattttttggaaattcagaaaaaaataatgtcgattagtaaacgatgttacagtcatgctaaggctttgctgaactgtgtatggaattattcagggagcccggcgatccgtggggaggaaggcgaggatactgatgctgatgatgtcagtgactacaactaccctgcatctggcagtgccgaccagaagcagaagattgctgataggatgcgcagttggcgcatgaatgctgggggtggtggagacgtcggccgtcccaagtatgacagtggcgagatcgggctcaccaagtatgacagtggcgagatccctcggggatacatcccttcagtcactaatagccaggtgggtgcgagtttttaacagatcgtggtatcagttgtccgggtatgctcaaatgattaatcttgaattggattttgcagatctcgggagaaatccctggagcttcccctgatcatcatatgatgtctcctaccggaaacattggcaagcgtgctccattcccctatgtgaaccattcacgtatgtttatttcttgatatgatgtcacttctcattaggtacatccgcttgagatctaagatcgtaattatcttttcttgcttctttctagcaaatccatcaagggagttctctggcagcattggaaatgttgcctggaaagaaagagttgatggctggaaactgaagcaggacaagggagcaattcccatgaccaacgggacaagcattgccccttctgaaggtcggggagttggtgatatcgatgcatccactgattacaatatggaagatgccttactgtgagttctgacatcttcccctcagggaacataatcttatacgggatcatatgcgctgacatttacaaatgtagtatgtgtggattctatctaaaacactgactaaccgaaaattattatatcgatgtttattgtttttcaacatagacatcaacatatagccaagcaagtgggtgacctaaatgtattaagagctgcacttttttccactaacacttccagctataatttttggtacatcgaattggtactaaacaaaaagaggtgtctgtcctaagttcctagtcaactcattagtgcagttgccctgaggtgaatgagggttttctgtccctgatagaaggaagcaaaaatatatctgaaagttacaaattgaaataatttagagattaaattatgtgagcatttttgatggtgcataaacaagtcttgtggcattaactttatgcatttgaattgcaggaatgatgaaactcgccagcctctctctagaaaagttccccttccttcatccagaataaatccctacagaatggtcattgttctgcgtttggttgttctaagcattttccttcactaccgtattacgaatcctgtgcgcaatgcgtatccgctctggcttttatctgttatatgtgagatttggtttgctttgtcctggatattggatcagttcccgaagtggtttccaatcaaccgtgaaacctaccttgataggctggcattgaggtgatctcctttttagttctgttgtacttaatccaaacaaacatccttattcatattgctgatgccgttaccatctcatttccattaacaggtatgacagagaaggtgagccatctcagttggctgctgttgacatttttgtcagtacagtcgaccccatgaaggaacctcctcttgttactgccaataccgtgctgtccattcttgctgttgattacccagtggacaaggtctcttgctatgtatctgacgatggtgctgcaatgctgacttttgatgcattggctgagacttcagagtttgctagaaagtgggttccattcgttaagaagtataacattgagccaagagctcctgagtggtacttctcccagaaaatcgattacttgaaagacaaagtccacccttcatttgttaaagaccgtcgtgccatgaaggtttgtttgctttataaacacattaatattaattttgctatcttctgctccaatgctaacagtcttcccaaaaaaaaaacctgttacagagagaatatgaagaattcaaagttaggataaatggccttgttgtaaggcacagaaagtcccggaggagggatggatcatgcaagatggcacaccatggccaggaaccaatactagggaccatcctggaatgattcaggttagtgtatttcaaataaaatctactatgactatggttgatgtagcttcttttacttgatgattatgattattgctttgctgattgctctttctgatttttcttaggttttccttggtcacagtggtggccttgataccgagggtaatgagcttccccgcctggtctacgtatctcgtgagaagcgtcctgggtttcagcaccacaagaaggctggtgccatgaatgctcttgtgagtagttgaatatttacaaaacttacactatctagttcattttcacttctcttctaaagttctaatggaggattaatctttttctgcaggttcgtgtctcagctgtgcttaccaatggacagtacatgttgaatcttgattgtgatcactacatcaacaacagcaaggctctgcgggaagctatgtgcttccttatggatccaaacctaggaaggagtgtctgttatgttcagttcccacaaaggttcgatggtattgataggaatgatcgatatgcgaacaggaacactgtgtttttcgatgtaagttggcaattctcctttaagattctcgctcatctgcaactactagtgatagtgtaatcatatttgattaacaaatgatgctaatattttttgatgcactaattttaaatttctaacaaattcaatattttttttggggatatttctgtcttctacagattaacttgaggggtcttgatggcatccaaggaccagtttatgtgggaactggttgtgtattcaacagaactgctctatatggttatgaacccccaattaagcagaagaagaagggaagtttcttgtcatcactatgtgggggcaggaagaaggcaagcaagtcaaagaagaagagttcggacaagaagaagtcaaacaagcacgtggacagtgctgtgccagttttcaatcttgaagatatagaggagggtgttgaaggtaccatccatatgttccagttattgcataatttaggattataagttgtaatcaacatatatgcatcctgacatatcatctatatggcaggtgctggattcgatgatgagaaatcacttcttatgtctcaaatgagcttggagaagagatttggccagtctgcagcgtttgttgcctccactctcatggaatatggtggtgttcctcaatctgcaaccccagaatctcttttgaagaagctatccatgtgataagttgtggctatgaggacaagaccgaatggggaactgaggtaacatgggctttctcacagcaacattggttacattcttttttagtaacttgtgtaaatttacaccaggctatgcaacttgcaatggtatgttaatgctgacatatgttgcagattgggtggatctacggttccgtgacagaagatattctcactggattcaagatgcatgcgcgaggctggagatcaatctactgcatgcccaagcgcccagctttcaaggggtctgctcctatcaatctttcagatcgtcttaaccaagtgcttcggtgggcacttggttctgttgaaattcttttcagtcgccattgtcccatatggtacggctatggaggacgccttaagttcttggagagatttgcctacatcaacaccactatttatccattgacatcgatcccgcttctcatatactgtgttttgcctgctatctgtttgctcactgggaagttcatcatcccagaggtaagcaatgactgcttatacatacccttctatagaaaatgtttgagacaaccaaactaactaaattaattttggaatgcagattagcaactttgctagtatttggttcatctctctcttcatttcaatttttgccactggtatccttgagatgaggtggagtggtgttggcatcgatgagtggtggaggaatgaacagttctgggttattggaggtatatctgcgcatctttttgccgtcttccagggtctcctcaaggtgcttgctggtatcgacaccaatttcactgtcacctcaaaggcttctgatgaagatggcgactttgctgagctctacatgttcaagtggacaacgcttctcatcccaccgacgaccatcttgatcattaacctggtcggtgttgttgctggtatctcatacgcgatcaacagcggctaccaatcatggggaccgctctttggcaagctcttctttgccttctgggtgattgtccacttgtaccccttcctcaagggtcttatgggtcggcaaaaccgcactccgaccatcgttgttgtttgggcaatccttctggcttcgatcttctcattgctgtgggttcgcatcgatccattcaccacccgtgtcaccggcccagatacccaaacatgtggcatcaactgctaagaaagcaggggattgtagagacagaaatactgccagttgtgttttttcagaatacaaagtgccactgccaccaattgtgttttaagttattaggaggtggctttatttacagctacgtacagaccagaaaatattgctcatcagaaagttacttgtgtcgatatgtattcttttgttgataagttatatactattttgatgagagtggctgacactgtcaacgagttttgtatcttatgaaggacacaataaactattagtttgcattctttaaatttccgttcagttttctgtctttcagccttatgcatgttggcagcttaaactaaatattctttatctgcataatactgttaattggctggttgattgctgtagaagcatagcttaaataatgtttgtgctaatgcattgtttcgggctgccgaaaagaagatgcctgacaatagtaaatgcaatttaaagaaaatctatcctttttctgggctgccgaaaagaagatgcctcacgatagtaactgcaattttaagaaaatctacccattttttctttgttctttacatcacatcaaacaactttaggtatgttggaaactttttgatgaaatatgcttgaaattatatcatattgagaagaataaattgtgacttttgtaacgagttgtatatctatttctaatttttcattactcacaatatagaattttaaaaatatcatttgtgtataccgaagatgatgacaaaattagaagattgtttccctcgcttacatgtgaaggaacaattctgatatagatgaaatcatcatcggcaagatgatatggatcgaacaattctgatttagatgggataacactaccatttgcttgtctgtcttctcactattataaaagagataatgtatgtattctcaatgttatgaaagggatgagtgatgaacttcaaatatgtcatgagtgatgaacttgaaatatgtcatgtaacctaagtgaatttaacacaagaagtgttgataattatttactcctttgcaagttttgataatatgtaccctgaaaactcactcaatccctttcattcccctgaaatttacccgatccgttctatacccctgaaatttcaacgtgtccactaccgttacattttccttcatttcactaaaacatttggttgcaaatgttgatgcttagtttgaatataagctcaattgaaaattttgtttgagtacatagtatgtgcattattttatgaaactaatgaaataattagtgcatgaaaatttgacataaattttgaaaataaaacaaatataataaattaaaatttctatttgaaattttaatatgacaatatatattttttatcgggagcattcattaaaaagttactgtgagcatcggtagtccaatctttgtatgaatgctcctcatttttatgactttttttttaaaaaaatacatatttttttatttcattatctaaaaacaaattttgtgataaataatgcatcgcataacaaactcataatgatagtctcatgtgacagacttttatatttttaataatgtagctcataaatttctatgttcatcgaaaagataaaatggtcatttttatagaaattagacggttactaatggtcaattgatgggaggagtatggaagggatctaaatcaaatttcgagggtataccagaagtaaccaaaatttaagggcataaaagtgattagctaaaataaatttgaggggtatgcaagagattttctcttctagtaactcaacaaaattggtttccttcaaagtcccaactatttggtctctccacctcagtctaacaccgtagttttatagctcttaattcttcctataaggtacaaaggaaccgatatatgttggctttatagctcttaattcttccccataaggtagaaccaatatatgttgagacaccaagcgtgtgaaatgtttcggatgtaagttgcatcatttgttgtcatgcaagaagttctttaaacatcaatttaggtggactcacgctacaagtgtttggagatgagtactgaagggtggtatggatattcacagtgaacatattattgtgcagttactaaggtggataagtttatatgataataaaatgtatcctttttctgaattccttttttttttcctttttgaaatgatacttttctgaattctgaatgaaaaatttcgaacattttgcatgatgtatgcacaatttccattcatgtaatcatgctgtctctgtggactttggctcaatatgatttggcaaactatggctacatagcaaaaaaaaaaatcattttgcttaattcgattcgaattagaattgccaaaagatgctaccagtgaaggactttggaagaaggtattcagatttctgatttacggatcacaccatttgattaatcgatttatgctttttattaactccacccacataccagattaaaagactaaattagttctcagtttctcatcttttttttgggttgggggggggggggtggggaattgaaatttcc

SEQ ID NO: 13396 - DNA, 6582 bp, Oryza sativa
atctgacaaagcatggtagtggtaataagttgcaacaatccaatttcctttgaagaataaagttcaataatcctttgacttagcattaacgaacgctaagtactcacaacagatcacaaattcaagacccaatacagggatctttgcatatcgatccaacaatcatgcatatgctgctcaggtgaagaacatggatgtgctgtgcaaagctgcagctgttgtaccaacaatattacgctattttcagcgttatgattgtggatatagagggtgtgactccatgtctcgttcaaatatgaattgaaaatactttttttctttgccatgatgaccgaatgtaaaaaagttacaagaaagtttttcgtccacaattagttatcaataaagatgtgcacaagagcgcatgttctaaaaccacggaccaaccgcacaaacacaagctataaaaggaaagccgaccaacaaactgactattgctatgtgaggctagtggtcacggagccaataacaacaccatacaccatagaacggagactctaaaaacaatgtttccatgaaggttgcgacgtcaaaagacaccactatcatcgtccatccaaacaaactgtacagacacctaactttatgcgaagacataacaactacttagacatggccggtacatcagaacatgttgagtataacaattactcatatgatgatgtgaaggtttaggtgctacagattgtatttccaaatcaaatatactatctccgtcctaaaatataaagttttagctataaatctgaacaattgtctgtttagatttatacctaaaaatgttctattttgggatggagggagtgcttaatagcttaaagctcacgtatgactcaaatatatatacaaactatacacatatttttttaaaaaataagtaacataaataggaagcaaatatttacggattctttgaaatgcaaatcaactaaaaaattaaatccctaggaaaacaacaactatatgggttgaatatgaaggtgacaaattgctaagtaaacattatctaggaaggtaaaacaatgagtacagtaacaaaaatagagtgaaacttctgctctcgaaaatttatgaaactctagatataatatgcgcacaatactgtgcaatgcattgtgcctgcaacccactaacttcagttgcagaattgcagcctataataataattcaactatagtaatacaataaatttggtttcttccaaaatctcactactatctcaatcatcccaaattaaagtttttcttatatagttgagatgtcacatatatacatgcaagacatgcaacatgcaatattttcccattcaaatagatttctaaataccatacgaatttttgaaagagaaaaagttcatgtgagagaggatatttgcatttttcacctcatgcaaccagcattgatgaaaatgccatatgccttgcgagaacaccaactctgtgactcccagataaattacgcaaggttcaccgcaacagattgtggttcctaatctttttgttccatcttgtcttatctctgctttgctctcttgtgtttgactatatcaatttgctcttgatttcagccatcattaatggaatagcattaattgtactaaccaatttggagaagtgtttgccagcgttgttttgttatccaatttagtcactaactacttttataatttgaggtgaattttttaaattttggtagagatctttaatttttagtagaaagttgaaaaatttgagttgaaagtttcaaaacctgattgaagctttttaaatgtttagtgcaaattttaaaatttgaattgaaagtttcaatttctcattagaaagtttacttcaaagttcaaacttgaaacataactatttactaaaaaaaaatctgtattataaaatttacaagaaattttaaaagtattcagagatgactacaaattgatatacaaaatttaaagctgcacggccacacggccacacgggcaaagacttgcagtctgtcttggtcttgttcggtagcgtggacatgtattagcttgtttggcctatgattatttggaactaattgataaaattctagcagtgttccattgtggttcaatctaacaatatattttccaatatgtgttgacattattaacataatccaagaaacacatttaacaatcaatacattcttccccgcaaaaaaaaacaatcaatacattcggggtggagacagacctggagcaattagggcttaagcccaaggcctagctccataattctattgagaccacatcaaaccacatcaaattaacatggaaaatattttaagaagtcaaagaacagctaactcaaccctaggcgtcatctattcaccgctagaatactaatatttgcttaatgtccaagcaaaaatcctactaataaattaataaaatgcttggctagttaacctgtggccaatgggatatttatgtaatgatatataccactcagaaatagttgtaaatagccaacagggcacatttgtaaacaagtttttaaatatacttctcagaaatgcttataagtgatttgacagtgtatattagtaatcgagggttttgatataacactaaaaaatgattgcaaatcgttgatgtgcgtactttttccgaagtctaagatcgggacactcggtaacatgcaaaaattaccgagaggatacaaagtctgattgggctaattgttgtgcagtttttggatgcatttgcatctagttcaacatcatcgatcacagctcttcatttcccatccttgctagctgctatttagttttggaaacacatacaaagcaatcgtacatgttatccttgtcaagcttcactgtgatttcgaggatatcatagtgttctttgattcaaggattacttttagatatgggctttccctattcaagggagaaatgcttgtagtaaggtgtaattagcctgcatttgcttcacgggacatgagtttggaaatttactgataagtgcatagtgcagtatgggcatttatctgccttccttttattgttcatgatctttgtttggatgatcaatccattgacctattatttttttcctggtaggagaaccatactgttctgatgtgtcttgctgtttgatgcttgatttaatatttttggatttgaaaacaaaaaacatgtcatgggtctgatgtgtcttgctgtttgatgcttgatttaatatttttggatttgaaaacaaaaagcatgtcatgggtcagctacattctattcagcttgttggctgagcttatgacgtacatgcaaaacgatgcaaatcattagtgcgtgattaattaagtaggagtataaattattatgaacttaaaaaatgaattcatttgctttttgaaacaaacttctaaaagtttttgcacgaaacatactatttaaatttcggaaagcacgctcaagtaaaacaatgatgtagcccagtcaaaaagctcttacgaacatagcattaaatccaagatgcatccatgtgtttttacagagcttacggacaccaaacgatccggcacaagctgctttgttgtttcctctacgcgactctatatctttcattggaatctgaaaatattatatctaactccctatgaaaagtaacaagtcgagcaagttgatacaatcatgatgattaaggtttatgcggaccatgttgtgaaatcaaacataaattaaaaactaatagtcaatgttcagctaatacacttagaactcaaatagatatagtgctgtcaaagccaaatccttgtgatgcattgtctccatgactcatcaacttcagttgcagaattgcaatctatcctagtaatgtcttgttcaaatcaatcccgtccacaagggtattgagctggatttggccaatccctcctttttagggattaaacgataattcaattacactatataaataaatctagtttcctccagaatctcaatgctatactctatatgcaaggttccaacattaaacaatggttggtgatgtgtcccattatccaaaatcatggttggtctcaatcatactaaagtagaactgcactgctggtttacttatgagatggcatatgtatgcatgatcatgcaatattttcctatcgaaataaatttctaaagaccgtaccacattttgaaaagagacaaaaaggcatgtgagaggaaatttacagttttcatctcttgcattggtgaccgcctttcggtcagacattgcaagagcacccacacaatcacacaaactcgattccatatcaaatgaacggattatacacctccatatgttccatatatatagagacaccaacaagatttgcatgggggaaacacatggatgatctgcccataatcgatatgggcagatggagcatatatgcatgatatgtaatatttcccattcaaacaaactttaaagacctataaatgtctgagatagaaaagacatgtgtgacaggaaaaaatcgcatttctcaatctcatgcaacaagcattggtaaatgatattcaggtattgatcaacattggaagagcatcattaactagattgaggggaaaaaagttgcgaacaacaaaatgcagttttttaccatatgcaataactgctatgtggtggtgtatgctgatggaaatgatctcatgcaaaaagtattagagtacgtgtagtaattaaccaaaccttcttactacctcaattctccgatttttttcataagcccaaagcagaaataaatcaaatacataatccttctctagccatatttagaactgtactctgtcccacatctcacaataagttgtctctaggaatcccaataaaatttagtgaggttttacagtgtttgcgaggtacttagaggtattgagaggtaatgtgaaccgttgatcaagagaggggcaagtgggtgagtaggtaaggggccttgagggatgaaatttctcaatttgttaactgagggtagggtaagagagtaaaaattatttgaactatagaaatcaactttctataggacgcatagtagttttgatcgttgtgttgatgacatggttcttcacaccaccttgccatgtcttgatatgagagctccattggtggtgagtgtgccctgcggatggtggctctataaaattccaacgacttagggcttgtttgattcacaccaaattcaggtttaaaatttgtttgaaaatttaattttgctttttaaatttagcatcaattttttcccatttgattattataaattattttttcacattgatatttatacttttttaagtaggtaacacataattatgagaaagggactttataatctttttagaaaaatctaaacggtcaactaacggaataggtatagagatggtcaaaacgagaactaatgggcatataggggatgaggaaaattcaggggcacaaaatagatggagaaaaaacttagggggcgtgtggagattatgggtaccacatacccacatggctggtctatccaactggttacaggggatagatcatctatgaatatgtataagattagaactcgggtattacgtttgcttgtgtatcaagggatggcctgtagtcctggtctattaagattatagattagatataggaaacttaaaccgtatggggataagtttctatcttgtaaccctgctccctaacctatataaggcgggcagagaaccccctctaggggcatgaacacaaagattcacaaccagatcatcagttcaatactacacccagcaggttcaaatccccaaataggagtagggtattacctctcattgggagggcctgaacctgtctaaatcctttatctccgcatccatccacttttaggtctcgtgtgctaccctttatattgccaaaatcttgtttaaacagggcgctttctggacctcatcccattcaaatttctgttactcaaaattaatgatttgatttcaacttaaaaaatattacatgagtacttggacagccagtagggatggagatgaggtgaaggaaaaggtggcttaggaggaagtgcttagggaaaccgatggatgatggagatgacaaaggaaaaggtgactgcgaaggagtgcttaagatgacaagtgcaacactcctgtagatatgcacataccaacttctcaacaagttcaacacgatgaatcaatgatgcaatgaccaatacctcacaaacatgcacatcaacttaacaattaggtgaatgtgtttctaagcttacaaatgtaatcggatactatccttactccttaggaacaaatcaaggagaaaataatggagaacagcatataaagccaagtaaagaattattataggagtcatcaagtacaaatcaattcatgttcacaggttcggacctccccacaatatcaacttcaaatggacctaaacgctaatataaaaagttactcgaggcctatgatacttgttggaaagtctatgctgtctaatttcaatggtattggtcagatatcaaaattcaatctgacatgcttgtaataacc

SEQ ID NO: 13397 - DNA, 481 bp, Oryza sativa
ctcctctctttccctctctttctttttctctcctttttttctctcctcctttcctttcctttttccttctctctctccctcccggcttctttctctcttcctcggcttctccctttctctctctctctctcggcttcttctccctggtgacgacgaccgagcaaggggaggaggcggcggcttaccgacgacggcggcggcgacggcggcacgacgaccgagcaaggggaggaggcggcggcttaccgacgacggcggcggcgacggcggcacaacgacggcgcacggcgcggcggcacgaaggcggcggtgcggcggcgcgagggcggcgccacgacggcgcacggcgcggcggcggcggtgcaggcggcgcggtggctcaaagcggcggtgcggcggcgtggaggcgggaggcgcactggagtgagtagaggagaggaggtgagaatgggggaaaatgggtgtggggtggggaaaaaga

SEQ ID NO: 13398 - DNA, 1521 bp, Oryza sativa
ttattgcttataattatgtttaaaaagtgaaacaacaacacccctctctcaactttcgactaaactcaaaatttgcgctaaaccctaatttttctcacaactcctctctcacaatcctgtctcacaaattaaatcgatgccgagagacctcaacccctcttctatttataccctaaggtggcagcccaaaagccatgaatcctacatgaataattagtactaatccaatatgaaacctaaccatacaagtaacaaacctatcctactacaattcaaatgtcaatcttcccaaatttggacgccttccaaatttgactcaactttccatacgcacacaatctctcttgtgtgcgatatggaatattcaccaccacatacattgttctttagcctaagtcccacatgatctcctaatcatccggacatcaacttctcccaagtcaactcccgatctatcaccggcaacactctctcaagacatcacacacctacacatgaatgaacaagaaacatattgagcacaagttaatttccaacttggctcaacattagcgcacaatagtactacacacatagaaattgcatgaagtaatcacaagtatccaaagaaacaacccgaaaccaactcttaataggagccagccggccagactgccgggctagccggtcagtctgccgtctgcgtgcactacaccggtctaaccgtcgcaccctgaccggtttgaccacaagcatcaaacaaactcctgtcttcgtacgatcattattaaccatctcaccacagacaaatatctaccaaatatcaaaaccaatataattctcatgccaaatgttcatcacaaaaaatataaataaaaaacattgatttcacaatattttgaattttggcattcatccattcatcagccattttcttattcaaatgtttgccaaattaaactaatacataagttactgatgttgtggcacaatcctttatgcatagttattttaattagttcactgttttagacaacctagctctagatctcatatatacatataatcaattatattttcatgttcagttttggttgtttcctactcttgtggcgacataataatgtttttatatctaaagatagtattggtttcccccaaagttccattcccaacatatttttcaaatgatcattccatatctcctatatatttgccaaaatgcaccttgtccataatcaagacagaaaacacaacttgcttttttggctctctcccctcactagcagctagcatgcaaggtgatgtatttaacattggcatcatctgatgaagagagctttattgagaagatgagatgcaggactgcttgcagttgcttcctttctgatcagttcctaaacagtaagcatcgcatgcagggagggaggaaatgtgtgtgagtggcaaaaattaaagttttcttggggtatcatgcaacaagcactgatcaatatgcgcgttaatcaagttgtactaattaatactccctccgtattttaa

SEQ ID NO: 13399 - DNA, 2708 bp, Oryza sativa
  unsure (1)..(2708): unsure at all n locations
aaccatggatggtaggcaaataagacactattcttcatcatgtactatattttaaacaactaagaaattattttttggcaataaaacaaagagaaaatacgggtagtgttgcatgcatatgctgatatacgattttagaaataagtgttgagtacatgaatctggaaataatttttcaggaaacacgtttacctatgagtgaatgagaggaactgtggagaaaaaaaatcagtggttggcggtctaaaagacaagacatagagatttggcacaactttttaatcagatgtagatggtcaaatctgagagtagatcgatccctcgatcctcttgatagtttgatatgctgcaaactaaccagaaaatgaaagttaccatatttgtaatttgtgatacattggcatattaagattggtgattaatgaatagaaatcagatatcccaataatttaaagcatgataaagtaccaaaagccaatcaccttaggagacagatgtcctttctttttcgccaggccagtggtagagatgtcttttcaattggtgatctgtgctaacaatttttcaatgtcatctatgatagcggcaaaccaaatttcatttcatcaccggcatttcctcaaacgattaagggagtgccttcaagcacagatttcccaagaaaacccatcggatcaatctaaatatggttggtatatccagtataccatttaaagggaatgaggaagatgtagaagcagaggtggtggtgtaggtttcgactggagaatgtatttgttagggcatctccaagagaatgctanacaggttactaanacataaattttaggaatttggtgaaaatcagctctccaacagactcctaaacatggtcccaaaatttagccacctccaaaaccaggaccaacctgaaccaaatattgggcaactagaagcgctcccaatcgaagcaatcgttcctgcccgcgccgttttttcttttcctggcgccaatttttttcctcgcccgcgctttccctcaaccaccgtctcttcgttcgccgggaggagccgcgcctttcttcccctcctcgcgccagcttcctctcctcgcgccaactccgttcagggcgccgccagccgtccgtccgtccgggacgccgcaggttctccaaggcgtcgccggccctccgtccagggcgccgccggcagcccatctaggtcgctgccacccctccgtccagggcgtcgccggcagcccatctaggtcgctgccgcccctccgtccagagcgctagcggcctccgtccaagtcaccatcgactgtcaatccagggaccgtcggcagtctgtgccccttcgtccacctcgcctctcaacgacgtgagttgctactggatttgtttgaggtaatttcagagtaacaactcatttattttctgcttctctccatggatctaactctctttgtgttcaattgaggttgactcactgatattatccccattgatatcctagtactgacaaggtccttatgtgtatttctttgttttcgttgatacaagtcttagatgaatatgtccaaaatagtcttcacaagttgctaacagaccatattcttctcaccctaaagttctattgaagtccacttaattgtactaaaactattttattcaagaagacaaatgggacatgctagtttcatattctactgaagattttatttctttactggtatagttgaggttttttcccctgaactagtataagttttttttttccctaaactgctatagttaagtttttttttcactgaactgctttgctttgaatgttgtattcataaaagtcagtatcacactgcactgaggcctaatctgaggtatgtttccattgaccagttccatctgttgtgtgtcatatgcttgtgcccacttttacttctatcatgattaaggtcaaaattaaggtcgaaatttttttgaacaatgttagtatattttagatcttcaggtgtggcatgctatctgccatggtgcatgtgcacttaagtcagcacaccacctgaaaggctgctgtctacaaatctaaaatattatatcaaacgaaaaatctgaatagcatctatcatcttgtttttttaggcagacagacaacattgcattgcttagatagacatgtaaacaaaataatcatcttccatttaacatacatgatggagataattgcttgtaggtcctactgataatggaagaagaaggattctatactaatttgatgaatgaggggaacgattccttagattgggatagtttgagtacgatgcctgtggaggatgatatgagtaaccagcttgatgagaatggcatgagtagtgagcctgtcacgcagcagttccccactattgagaggactaccgtggctagaccaaatcaaaaaagatcgaagaattttagtgaacaagaagataagatacttgtgtcggcgtggttgcatgtaagtttggatccagtgctaggcacaaatcaaactcgtgctgcatattggactagaatatacgagcacttatacaaaacgagtaaatccacaccagatcgcagccagaattcacttatgcatcgttggaaaactatacaagagaatgtcaacaagttttgtggatatctgagccagattgagggtagaagacaaagcggggttagtatacacgacaaggtactacatagtta

SEQ ID NO: 13400 - DNA, 5437 bp, Oryza sativa
catggctaatcttattgatttagaagttgattaggatgctatgtagacatatatcaaagaaggtggctattagacatacacatcttcaataaaaaaatagaataggatatagtaatagtagaaaaagattaaaaaaatccaatcagtgataaaaaaatccaatcaggatatatggaattcatcatttccatgatgaagcataaagtagagaccaaatttttaaatattgcttttcttatgcatactcactacatgtatgcacgtcacaatttctaatcaacatcagctttgtaaaattaatattgccaagttattttggtccttgttcgcacgaactagaaaagtttgtgtactgaaacgagcattttacaagtttatgcactaaattgtacccatttaacaagtttgtgtaccgccaatgcaatttactctttattttttatacagtattgttcaaattattacattgttacattgttcacatatggagaggaaagatatccttaatgattattgttactttcactagataattcatgatggtctacattaatacaaataaaaaaatgtcgaggacaaattggccaggaaatcaaatatgttgttttcgaggacaaaaaaaggaattttaccacatcttgtctaattctttggggcttatcacatgagtaaaaaatgaatcatctcattttattttgttttacataatgcaacacactagtacaaaagcgtttatcattgccacaattccagactgccaaaattggcagtgaaacataggcaatgatgcctccagactagagaacttttacggtacattctactgctagtatatactaacagtatatactactgctagtatatactaacagtatataaaagggtagatttggtatttgttaaaattctgaaaagggttgtttagtcatttaaaatagagattgtttttttatcacaaatagggattagctttcccgtggatttttttccctggatatcgtcaattcgtcatccgcttcttctcgttacatctggcgacaccggcgacggaggctgggcccatcttgctccctccctggcgcccttctgcaccttcgcctggtctgccggccagcgccctcccgtagacccagcatccggcgccgatttgggggattttttggaaaaaaatggggttttgggtggacggaaagacacgagagaaaaggagggaaatcgaatcgatttccgatggcggcggcgccgattgtggctgacggtggcaggggcggcgccaaagaaaccagcggcggtggttgcaagccgagcggcttcggtttcgactggtgccgggcaaacggatctgactaagtgagatagcatgaatttacaaaaatacccccatgcaaaaagataaaagacaaatttacccaattcaatttatactgcaggatagttaggaggaaaattagatgaatttacaccgttggatcaaatatactgctagtatatactagtagtagaatgtaccataaaagttcccccagactattactgccggtccaggaaacgacagtgatagtgctcctagggtgtaaaaatgaaaatgaataaagaaaaaagacctcatactccccataaaaccacttacgctgccacctcgatgatctatatcacctccggtcctgaagcctttgttgaacacccacttgaagttttgccgcttaagattcatggctctagagactatcaccacctaacggctgcaccgccattctttgatttccaacaacactacgtaccatcggctcatagctagatacctcgtggaacagggaaccactgtcaacatctacccatggggtttataccaataatgggtacaaggaaaaggaggcaggggagtcgaactggtcgacatggtgcttccttattgtgcccattattggtctgtctatgagttctccactggcctaccatctagtgtgctctaggatatcttcatctcgcctccctatactttcaattcgtgccttcatccctgtccagatctggccaaaggaggtgccatatatgtcagttgactccttttttaggcactatcacagtcggtcacctgaagttttatgattttacggagtcatcaacatttttaaccttgacaagctttggtgttacagaatcaccaaccaccttgatatctagaaactcctgaacaagatgggtttacaaatcaaaaccggctagaagaaccgattctaatgaattaggggtaaacatccatcttataggtggaacggaaggtttttggaacaaacttataaagaaattcgcactcctgcgacaagaatgaacaacttacagcggaaacctacttgttaaatttacaccaatcgaacaccttaatttatcagtacctttagttttgcagaacttttttcaagacaacaccaatatgcattatcacattgtagttgcaaacaatagctagtgtttctttataacttgttataataggagctaatattgcagaaacatagcttatatatcttgcatatagtgatgttagtgacagcagccatagatgcagattaagagaagaattctgacaattctatatatccacagaatggaggagataacaggatctgaggtggagaattgtattttgtatatatcttatttcttaaaggtgtacacatctcaaacagcaatgcgttctactaccatttattttgttttatctatagaatcctttcatatggatttgtcccaaactttttctctcccagaagaaaagtttcaaaccaggccgtttgtaaatacatcactgtataaatattcattatttcttcacatttcactcttgctgtcacttttcaggaagaacattaaaatatgtcggtgcttacattaggcattattgctccatatattcatttttggaatgcaatacttggcattaagaaaattgaaatatgaagaaatgacatcttaccaccgatgcgataggagcaatgttagccctttaacactgtgcaacgaaccgttcacgataacttggtttaccttaaaaaatcctttacaattttgttccattggcaaaggactaaaatgccagaaaatacccgttaggaattatcaagctcaaatgacataagtccacactactgtagtacattctgtacttcaaattttatttgtgtttaatgatcccttcctcctggccgggttttccaagagagaagacgactatttaagccgtctaaatctaatccctctcagttttagcctgagctcctctgcaatcttgacaataacgaagaatatcatcctgtatgtcaccatcatcccaaacaggatagcaaggtttacccactttgaatagcccatctccacttgcagcctttccttgagaacctgaagaccactgatagtggcattggcctcgatgagctgatcacttggaaaagacagccctatgaactcattcttgtaaaacccctgcaccgcatacttgtggaaggagatgtagtagcaagggtacttccacaccggcttcgggagctcgttcgggaggcggaagaagccaccattgagcatcatcatgccctgtatcccggcaccgatgatgattcccatgaggaagtctgggacgatgactgcgatgatcatcatcatgctctctaccagcagcgtgcacatgcagagtgtggcgacgaagtatgcgaagtgttccgcacctcgggtcagccctgtgaggtaatacatcattgctccggggatcacagcgatgacggcaaggtaaggggtggctgagagggtgtttgagattacaaattccatgactccgtaatggccgctcaatctctcccttctgaataactgatttccaaaaaatgttctcaggagttatggtatgatttatgcgttattacagcggaagaaggaaaacatttatatctgtttgacttcttgtttgaacaaagatgttattttttgaataaggaaaataaaatactgttttgttttattagtacaagaagaaacatttcctgttattgaaaagtatcactatactgttttcttctaataaattgtaaatccagttcctttgtattttaaaacacaagtgtaagatgtcactcatattgtttcttctaaatataaatattaacatatatagagacatctggacgagtgctttacatttagttttcccaaatataaatcagataactgtaacactgagaattcaattctacaagagaaaataattagtgggatttgaaaatataatagttctaagggaaacaatgttgcagaaaattccagtttacatcaggatagaacattacctttatgtcctctacgaaagaagggaatcctccaattgccatgaaagttacaagcgcggttgtatacattattacttcacatctactctgaaacatttgagcaagtatatcaatacaactgtacataacacggattatatgtttccctaggtaaaaccatatatttctaatgaatatttattacccaactcacctggatagaactgtagctgtaaccaacttggtagaagatggtgccgaggcaaatgccaatgcccaaataaatgcccaaacgcatccagtagtagcctatgtccctgtgcatatttaggaaggatcttcttgttagcacaaggagctttgtcaagaagctggcttgctctttccttctaaatggagttccaccctgttaacacataatacaaaagcaaatatatatctatgaggccatgaagcatcaatgcaaacataataatttaacaactaattatgtttcaaacttctatgatgtacttttagtagctctatcgaaacgaacgattaccgtgagcatacgcaaaaaaagaaaaaaaaactataatatagatttagcggttttactatttgaaacaatgatgaagtgacttcgataaaaaaacagtatttagtagaaaagtattgtcaaattgaaaataaagcaaaacacatatttattgatagcagttaaaagaatgactttttggagaaagcaaactttcatatagtaggttggcaaaggcaggggacatgatcaaatataaacagtaacaaaatgcaatggtgaaggactgcatgttcattgaaatgaaaactggatggttgtaagaattggtctataaaaattcatagaatgctgagtaacaattaaattttttatttattcataatttctttatatatataccacatatccgtccatagagttttatctgtgattacagagtgccctgtgaacaaaactaagagcatgtgtcggtgacatggggccgagggtatcgtgactagaggcttgggtagccgcggtcacccacgtggcctgaccccctcgggggggtcgggcccgaggatgatgtggccatccctccctctgtctccccgagggg

SEQ ID NO: 13401 - DNA, 3262 bp, Oryza sativa
ccggggctcacctaaccacatttattgcgggttggacgagcgcgccacgccgcatttaatgcagcgcagcgcacgcttatccggtccgtgaccggtcgcagtgtgtgaccggtcacagacctgtcagatcgcgggttaggtggcaacaggaggcctgtcacacgcctcgccccggcctgtcacacgcctcgccccgtcccgtcggaatgatgagagcctccaggcactcgtccctggccggagccggcgtgctaactcctggagttggtatgtcagtcccggccagattcattccaggcttcatcgcaaccatggcaaggaagtcattgtatgaagaagggcagacgtgcggcatgctaaactgacgcgcggtggacaagaatgaccggtctgtgactggtctgacgccggtcacgtcatcggcagacaaccgtgctcccacgttgcatctgcttccggcggagtggaggtaggtatgacccatcccatcggagggttattcggacagcggccattgcaaatctccacccataatgaaggaatgacagggttatcccctgtgtcaggcgagtgacggcgctgggcctcactcaaggacaagctgtgatttagcttccaggcgaaggcgcgagccaagttttggtcaagatagggtgggtccccacccaaaagaagagtaggtagaagtggtgcatgtggtatccccttgagatataaaaggaggaccttgcccaccgaaggaaggggggactctcagacgactctgagaatacctgagctcgtagagaagagaaagaggaagaggggttctagagcctgaactctcttgctctccggctctctgtaactccttcacacatagatccaccagaacacaggagtagggtattacgcttctcagcggcccgaacctgtctacatcgcccgtgtctcgtgcatttgctctctcgcgaacattccacagatcgagggtgaagaacctcacttagcgcccccggccgaaccggcaaaggggggcctgcgcggtctcccggtgaggagccccacgctccgtcagcatgctatctccgttccacattacaagacgttttgtcctcttcttctctcatctagatttactaacatatccatatatatgaatttggacacatatataaagacatatggatccatgcatgaatctattgaaaacccaaaacattttataatgtgaaacaaaggaagtatatcttaaagaaaattcaactaattaataatcgtaacataccatccctttcatctcaactatctcattggctgttttctctgaataagtggagtggtatgcatttgttagaatatttgttgcttcagctgctgtttttctgttagccttggagctttccatagttccctacatacattgtaatgctaagtaaataaatatacttccaacagtcctggcagaaaagaatgttattacaacatggttgtcaaaatatgataataaaacacctatacctcatcaaagtccttgttgattgttctcaggaagtggtcggatgggttcctcaggtgtgggcatggaaaaccactttgggtaaaaaactgaaatagatgaatatagatgtgcaatttcaagagcaattaaagagattgtggttattagttacaaacatagttgttaggctgacatattctccctctagtcgcactgaatggaaaatacatttcggacactgatcgaagtccaactttgctaaatgcatatgttttcttatttacgaatacaacggattctagtttcttttgaagagattaagaataaaaggaaaagactataatgtccatcattaaatgaggggtagttaatgagtggagcgtgtttatgtgtaaaatcgggtgaaaattaaatgaggggtggttggatggaaaagtagtacctaaaatctaaaatctttgtgaataaaattttaatcaaaagtcaaaattccagtgaaaatagatagcatacaaaaagagtgtcaattaattacctcagtagcattagaaactgtcccaaagaataccatcctcccataggctagcaataagagaccatggaagaggtcaaagacgtcgccactgggctggtgcacagcggcaatgacagtcatcccttccctggcagcgacccgggtgatgtggctcatgacgtggtaggaggcggcgctatccagcccgctggtgggctcgtcgaggaaaagcagccgcggccgtgtcagcatctcaatgcagatgctcatccgcttccgctgcccgccgctgatgcccttggtgatacggccgccgatgcgcgtgtccatggtgtcgctaagccccatctcccggattacacgctccgcgtgggcgcgcttctctgacgccagcatcgtgtcaggtagctgcaggtgagccgagtagtagacggcttctctcaccgatagagtcgacatgagcacgttgtcttgggttacatatgcctacacaagaattataattatttttttagctgacagtaaagaattaatattttttgggctgtgcacttcatgtacacatctatatgggctgatcagtttggcatgataatgcggtgaaataaaattcctcacagaaaaaaaaacagagacgagagacaagcctcacctcctgtgaagcttaaaaaatattctttgttaagagtttcattattaattcatgtattattgtatataattattagctaattgattattacagtagatattttgtcagtgtagtatgcaattacaacaaagtgcataaaaggcagcaaattaaaagcatggctagtaattaaccttgacctttcccgagataaatggttggaaaatacaattgtgagtgacagctgatataatgatttcttaccgaggttccgaaggcaagcttttcctgccggccatttattaaaatcacaccggtttgattcatttcttgtcctaaccgtcctgcagtgccataaattcatcaatggttaaaacgagagatggagaagagtatggagacgaatagtataaatttactaagcattataatcttgcatccatgaacaatatatatgatttatattgtctgctgccatcttgtttcagcatgaaaaaatggaaaaaaaatgctgaataaaagctacacttggcaacattatgtctaacatgaaataatatcataaaaaatgttctttatgatattttttttagataaatgttttttatgatattatttcatctaaactaatcaccag

SEQ ID NO: 13402 - DNA, 4567 bp, Oryza sativa
atttatttttaagcgagggttagtcgaagcgaattaaaatcatatgaaaagtcactgtctctctgtttggaacaatgtacagtaacaggaggaggcaaaaccgaggaagaatttcttgcaccatttacttttgcaccaataatgtcggaaaataaatgtccagtaaaagtcaatatttacttttgctatgttgaagaatgagatgagacgaaattccttcatctcaaaccccaattatctatcgattgtgttaattttttacattttctgttatacggctgcattcgtgtactttgtgttcttacgttttgtcttccattccaaacaagctcttaatctttgaaatttgctcaaagtctatttttaccttaaactataaaaccggttttttttacccccaccctccattttttaaactagacaagaaaaatactatgataatatttttattgattttgcttgcaatggaattgcctttcctagttcatattgacattgcactcattgtccatgtagatgtcacctaagtaggcccacaattacgaaacttccctaaattaagtttatgtgagaaaaaaaaaccactagctctagtacatcgatcagaaatccatatgttttagacccaagtatatggttttaaaaagttgaaagtgagaaataaccgtttctgtaattcaggatgacgaatggactttgagcaaagttgagggcaaaaaataggttttaccctaaaatttgtagctgcccacttccctctagtactcactccttccaaaagtctaagtcctattttattctttaattttttctaaaagtctaagtcctatttgtagttattatatgctatattaaacttttgatcggaaccgaagaaatcattttaatacttattggttgcatgtttattagttttgtcataagatgaatgagttaactataccttggtcttggtgcaaaaaaaaaggacctagactatttgaaggagggagtactaacgtacatggtgtgcactcaggtgaaagtgaaaaaaatactatgcatccattttatataataagttgttatgatattttgctagtcaaacatatctaagtttgattaagttcataaaaaaaatttaaaaaaaatataataccaaattagttccattaaactaatatttaatatattatgataatatgtttgttttgtattgaaaatgttgctttatttttttaacaaatttggtcaaacataacaaagtttgaataagaaaaaagtcaaaggaattgtaatatgaaacgaagggagtagtaattacacaatttttttataaacaggaagatagcccgcgcgtatgcgcgggcatgtatcatgattatgttttgatgaatttatatgggtggaatatcaaacggatggcatataccatgcttcataagttcgttttcctcacaaatttctttatcgttttggtattgctcaaataaattttctaagctatttgttagctttatactatatataatagtacttaattcatctatacaactaaatatttacagccttcctagttatttaaaaataaggtagacttaattagtttgtttgtttaccatacatttctaataaattaagtttggataaaaagtaaggtgtttttcttttttaattgaatgtttagagccttgttttacaaatcttaaaaaacaattattgctaataaatatgtttatttgtactatcaagctagccctttctctaatttgttcatattgacgtaatttgttacacatactttatatgatcaataaatgcgaaggagatatacataatctagaacttgcttccctatgatacgtgtgacctatagagctttttaaatatacctagtcaatatgagtcttaaattttaaatctaatactaacaaatattacttttaaccaattagatattgctattttagtgtgaattacatatataataatacatgaagtaactcataatgccatcataatgccatggcatcgtagatagagggaaggccaatttaattgatatggcaacggctgtttcagtttaagtgaaaattaaaaaccatttctttacaaatttgttagatgttctataattggttcaatttatcccctattgacaattttttttctattttataccagttattatgaatcttaatttattggtttaattatgtatagatcaataattagaatagatatgagacatgtagcttaatataactatggatgtttcgatattattggttgtttctcttttatcattgttactccaaaagatacagagagaagaggagagcggagaacccaagcctaaaagtggagggaacggaaagcgttgtgcgtatgtgatggtgagggtgaggtggaggggactttgtttttctaatttttctaaacgatttaagttaaaaccgattatcatgtattttgttttttaaaaaatcttttttaattttaaagacatcacgatgacttaaaacagatcagatcttagatacaccgatgtaagctggacaatttatcaagagactgccaaatgcattggttcaaattagctatgtaatgttgccgcaaatcatgcaaactgatttaattagctatgttatattgccgttaatctcctttcacaaatcatgtataactaatttaattagctatatatatgtataatcttagtgttaatctcctagcttccatttatatatattgccgtatatataataaatatagctatgagttagtggtaacacaatatgggagctaatcagcttgtgctacgtatatacagagataagttaattagcgataaacttgccgccgcagccaaaccgactcataaccggacgcgcggtatagcataatagaccgtccgagtccaccttacaaaaatatgggtcttttccctgtcttattttttttattaagatgaatctaacagtagagaatgcatgatgggtccaccttattgaaaggaaaatcgaggaaaatcgatggttagattttgtatttttagaatatttattattttctttgatttattaaagcgccgagtgacatcctagaagcgtttgtaggagtgacatatgacgattcagaagtgtttgtagaaaatttaatggacttttagtatataatagatatatacataagtagatagttttaaaaaaaacatagccctggattttcatttaaatcgatgcgtttagtatttaaatcattagattagattgaataaagaatttagtctcttcctgtcctctctctctcacctacgtacttctgttgaccatctatttttatggatgcatgtatttttgactgtctttttttatctaagtttttgtatgattctttttgtgaacagcaggtaattgctttcaatcgttggtacgtatgtaccagagaacagttatactctgtgtatcatataagtaggaggaatttattaattttttaatagtagatctaatctaatggtgtaaaataatgggtccaccaatttaagtgaaaattgacggtgagattaaacagtgccatgtgacggcttatgagtatttataggaatgtcacgtgacgacttaagagcgtttctagaaagtttaatggacttttagtatataatagataaatgaagttttgaaatgtttttttttgaaggggtttgttatctacatatttatattcatcataaaatttgatccattgtctttgtacgatcagtaaagtatactgtaagaacatttcgagtggtcgaagtgaacgaaacaacaaaagaatggactaaggatcggttaatctcatccttaagagcctcatcggttggattatccattatctttatgtccgctaatttaaacaggcaaacctctattttcttttgacagagttctcaattcaccaccctcgttttttgcgtgcacgtttttcaaactgataaatgtgagttttaaagttgttttaaaaatcatattaatttattatttttaaaaaactagcaaatacttaattaataatgcgctaatgagatactctgttttgtgtatactggaggtgagttcccaacctcaccaaacgaacaagaatgtcctgaaaaatattttgtaatttgtctattgcttctgtaattgatttgatatgatgaaatcaaggaagtatcttatgacatcttaggaactgaagctcctatatgtaatatataatattttaagagaaattgatgattgttttcttttaaaacaaagaaacgatattaggtattctttcccttttgaccggtgagagtatcgtttctgttcgggtgtacgtttctgggctttggaccacgaatcagtgcggtgtcctccacctgaagcgattgcatcaaggcactgtttcgtacttatacctgaagcgcgttggaaacgagaagttgtctgtgtttagttccacattagaattgaattgaaagtttgaagaaattgaaatgatacgatgaataagttggaagtttgcgtgcgtggaaagtttgatgtgacggaaaagttagaattttaaaaaaaaagtt

SEQ ID NO: 13403 - DNA, 15447 bp, Oryza sativa
tcctacacacacaaacttccaactttttcatcacatcgttccaatttcaaccaaacttctaattttagcatgaactaaagacaccctgaacagggcctacataggcacagcgttagcggcgtgagtgtaacgacaaactaattccttgactgcccacctaggtcaacattaggccattcccaacacaatgactagaataatatctaccatagtattaaataagctatcatctagaatagaaaatgaggtggcaagtaaataaatgtgaaaaagaagaaaaccatgtcttgcatgagacatggtttatacacaacatccaaaatatcatgtgagataagtagcattaaactagtttcttattgatgtggagtttatagaaactatgtctaatgttttgggttggaaatggccttatactgttatatttaatttcttcgataaattaatgatggcccaattatccttgaatactaaaagaagtcttcaaaaccttaaacctcactaaaattaaatcctcaaacctcagtaaaattgttttgaaaacatatccacacgtatgtaattgcgaattttagattgggttatttgagggctaaattctctatttgataggctaagtttctaatttaaaaatagatgtatatatcctattggatgtaaaaaccgggtaaaaaatattcttctctagataaaaaaaattgtaattgtggccatcaggatttaatcttgatttggactgatcactatgcacccactagttcacagtacacctctagtttatgtcttttttttagcatttacttcatttgtatattactgatgatatgattacgttattgacaaatactcttttcatctcatagaaaacaaatttaatacatgatgtaatatatcttagtaataatttaatacatgatgtaacatatcttagtaatataaatctgaatgcaactctgctgcctagattctattaaaatgcgtcatatcttttatttattttttaatagaacggagacaatatattgtagcaacaagccactgtaacacaatacatactttctctgtacgtcttaatgataggcagccagaagaatcttcgattgattgcttttaattaattagttaactaataatcaatgacttaattaattttctagttagcgtcagaagggcaaagcagcagtaggcgtatgcatgtgtccagctccagcgccttggattgcgaccattattattcattatttttccgcgagtccaaggttatagagagttagtattagtttaagtttttgatttaccttgcggtcaaaccagcaggctgtggttataaaacaattacgcaatgatttttttgttacccgattaggcgcgctgcttatcctgttgatgttaccatcaactcaaacttgatatgggttaattagatcaacaaattatgagatcgattagttaagaatgaactgtatgtattactcaataccaatagcattagtttgcatgaataatcttaccccaacttggccaattaatgtttgttagacggcatgtacggatcaaaaatattagtactagatctctttgaaaggggagatttgcaataatgacgctgcaaacattaacctttactataataatactggacccacatttcatagatagcgtgcactagtatgtagtaataattattgtacaaaactatgtgatatcgggcactttacatgaatattatatattatagaaatgctagatatggatatatgttgcaatattaagaaagtgatgtttggggtgatgtttcgacatactcgctactatcgaaaggcacataaatagattgacactatagatagtggaatagctaaaactggcacttatagtatttttcccacctccatgggctaataaaaaattggtacctttaaacggttatatgtgtcagttctataaaaaaccaacatgatctctttttttttaaaaaaaaactgacatctttattttattataggtgctagtgaattaaaaagccgacatcaataatatattatagataccagtttttttagaaaccagcgtacgaaaaatcgagccgagccgaccactcgtccttattcgctcgagctgataagaagagcaggacatggtccctctccccggtgtccctttcttacacgcctttctctctcaatcttcctcttgcatacttctctctcttctcacgtgcgactccgcccatccagctgcggaggcgaccatccccacctagtggcgacgctatctcctccaccggattcgacgggaggggaggcagcgagctacccaagcgacggtggctacgcactcccctccgctacatacagtgccccctctaccagatccggtgggagggaggtggcgacaggcgtggcaccctccgctcctcgacatcggcccattctttgtgttcttagtgtttggtcttcttggattaaatgttcattctatgaattaaatgttctatggaatttggttgggtaaagaggtgcaggttcctgaatcggcaccttttagctctcctcaaagatgccgcttgttgggtgctggtagggaataagtcactactacaacaaagaagaggataggtgttggttgggaaccggctttaggtgacagatttctccaccggcacctatccgttgttttgaagtagtgacttgtattttgagctttagaatataataaattgtatatagcgggttatttttcaggagatttaagatgcactagctagtgggtaatgatgtgacatatttatatcttgagttttagaatatagtaattgttactagtgaaaagcatcaaaagttataggtaagattgtaggcaacgaacatggattattctatccgaatattaactccacaaattaatctgatacagcccatcatcacttgtcatttgtgaactattactttattattattattactatgtacttaggccaacacgatagttattactactatatacatcaagttaccaactatatgaattcgtatatctgacatatgttaatttacaggagatcaagtataaaaggtccatctataattaaactactatataactaaaactttgtacgagaacacttcagaaatatttttatttacaacattaaagcagttcctaagacgaggggaggagagggcttagcctccctcccatctagcttaatattttaaccaaaattagcattatcacccccttagcaaataaattttgtggctaaagtaagaattgggcatccgaccttgctaaaaatcaggcagtccaaatattttattacattttaccatcagcaaattcaagttatatgttgtaaaaaaattagtcattaaaacatttgggtgaaatgttttccctccttcctaaattgattaggtcacccctaacccagaatctatcgagtagttttcatacttgtcatgtcatatagacactatgtgtagaaactatacatccaatggatggtgttttcaaattaaattaccatccaatcatctttcttctctctccttttatccacctatcccattatttttattcttgattattgtgtagagatggtttcttgcatgagaaatggtttcttcatctttttacctctttgctcattaactctcttgccacatcatatttttgcttatgttacaatgtattcaatgctatggacactagatgagatggagggttggggatggccttagcacccctcccatctagcttaatattttaaccaaaattagcattatcacccccttagcaaataaattttgtggctaaactaagaatcgggcatccgaccatgctaaaaattaggcggtccaaatattttattacattttaccatgagcaaatccaagttatatgttgtaaaaaaattagtcattagaacatttaggtgaaatgtattccctccttcctaaattgattagcatataatggtattcaaaatttcttaaattgatcatcatataaccgtatggatacggattttatcagaatacaattaatgcattgtgcaagaatatgtgcatgctaagatgtaatttgtatggtgttttaatcgatgcatgcattctgagagaatgtgtgtatggtgtcttgattgatgtgatttaaattatccttggtattgatgcataaacatatatgatgatcaatttggaaagaagggagtaaaacacaacaaaatactagttgaaattttttattctcatacataacacatcagattttagaagttaaaatagatatttattttatcaaaatataattatctaatatcttattataaagatttagtgatttaattacatgtatatatacaacggcgtaaccagtttgcaaaccgaatagagtctttgcattttatctttatgtttactgttacatgcatgtattccagcccatcagccatcaatcagctcactcgaacgggaccaaatacgatgtattacaactagggagatctaatttcctatactgttgaactataccctacagctaagtacagtggatgcgtgtgcactcaattagttgtactccagttcacaattatggtcttagtagtgtgcacgcaaacctctccctcgaccagttcggcacctaaataattgaaccccaaccacacccgcggttgaatttgtctcatttgggcatagtgattataacaccaattcaaaacaagtagacagacactatacttgttttaaattttggtgaatggaattctgcatatatgactttcatcgacccagctcgcttgttcatcctcttagctcgattaggccgaggcttttcctccgctcttgagacgccgacgaccccttcctgctagcggcaatggcgaattggcgactcttctccccgcggcagcgacggtgacccctcagcgatggcgacccctcctccccgcagcagcggcagcacactcggcagcagcgattagacgactgtggtcagagctttaatttcctcctctctcccaatgcttctgaccccctcccaccagatccagaggtgcagcaagccaccagtttccccttggccagatccatacgcaaagggagtgggactgggagatggccgcctcctcaatcccggcaaaggacaagagtccatgatgcagcagtcatgacaacagcgagcagcagtcgcgtgcgagcaaattcgcggcaatgacaagctcgtcgtggtagtggcgatgtctcgatccatcgtcatttttggcagatcccatccatccaccaccgccacctcgcaggcacgcatcgccggctctaccgatcgagatagaagatgaacaagagagaggatgaacacaaaagaataggtttgggtaagaacaggacacaattcttgagggtaatggcttgcttctaattttataatattttagtgccacgtaatgtatatcataaatatatatagtgctacttttttaattgagcaaatttgcaatggtatgaatccaattaacccttattgttatacacataaaacggtactgctatatttttaaatttttaggcaatagaaaaaaattaaaattatttctgtagatctcgttgagaatttcatagaagagtttgtctctgcatgaaggtatttgaaaatatttaaaatccaataattcaaatagatcttgaaatgaatattcgaacatgtaaatgaccttagatgaaaagattatcaagtatagagttgtagatttgggtcggttctaccattcttatctaaaattgtttccattcgactttgaaaaatatgcacgtgtgagtgggtatgtatcatatttgcctgttcttaactttggctcccctatagctcaggaaagacggaaaatgcgtccgttctatgtacatgaaccaacatagctagtgcatcacctatttgatattttctaattaacgtgcctgaggattatcctcatggtataatttaaaacgatacccagaggttttatttttacaaacatgaaaaggatggggagatagcaaaatatatatcattccgtaaagatagacataaatataaatataaattgcgcatcttaaatttttatatgtacttggactttgaaacaaaatgttttgttgggagagaattgtcttcgttaatcacacaatattttgaaggttgattctatttggggacaaattaaggcttcccttgaacacaagatttttgaaaacagagaaacgcaacaatacgtaggaatagatgccatgcccattgattcgcatgaaagtctcaaaaaatcaatggaggaaattactggtgcaaaaaaaaaaaacccaaggaaatcaataccctattcattgtcccaagaaaacaatttagtttcacaaataaaattttgataggttggttaatgttaaaagtttgttatatttctctatattattttcttgagattatccaacagacgcatatgcacgcaccactacagacgtaatatcacaatcatacccctatgaatatgtccgctaacacactctcagagatgaaaactagtgatatatcttgatcacaataaattaaatcatgttaaaagcccacctacatatgtataatattcgttggctacaagattgaaatcataatgggactccatcatcacgctactcgtgcttcccccgataattctccacttcaatttcaaaataaaaaaaagaagaagaaagcctcaaatacacaactactaatactactttatttaacggtatcacagtatgcacgtgtaacagtgatgagcccgaaaacgaacctgcgagagtgtcaagaagcgtcgtcttcccgcaccccgacggccccatgatcgccagaacctcccccggccgcgcgtgcccggtgatcccgtcgaggatcctcgccggcggcgagccgcgagtgcggccgggcaccgtcacgcgcacgtcctcccacgtcaggaacaccgcggggtcgtcgacgacgtccgctgccgcccgtggaagcgaaactgcctgcgccgccggcagcggcacctcgacgccgtcgaacgtccccactccgccgccggccgacggcgcccatctgtcatcgacacgtcgtctcctcgtccacgggaagacggcggcgaagaacgacgaggtccaaccggtgacacctccgtccgcccgggcgtccggcgtggcgccgccgccccagccccagcgccagagcggccgcgacggacttggcgtcggcgcccaccgtggcagtggcgacgtggccgccatgatcgataacgagctaggcgtgcttgcttcttttggtgctacgactcgagctgggcgaagcagttactacgttgtttggctgggccgggcgggaattaatagcagtgttgatgttgggcaactgctgatcgacacgtgaaacgtcacgaaaagaatcaaatgttttacgccaagtcgtgttatgtgggaattatattgatgtacagtataatcaactgtgcagctacagccatggaggacggggagacagacattcggtacaaggtacataatggaaatggatgtaacatagctagtgccagttggttactctagaaaacactatctacctatactttaaatacaattttctcttaaactactcatccgatctacgatctgattgtaccgttatgttcgtaacaattaaatctttataacaagatcttacatgattatattttgataaaaaatataaattgcttttataatatatctaaattacttttagatttcattaaattacttcttagacatataaaagtaaattcaataaagcgtaaaagtaatttacatatattatagaagtaacttataacaaaaagaaagtaactttaatgaatgccttttttcattggacgtgaagtcatatttttattcctacaacgaatttacttctaatgttgtgacaaagttacttccgttttgttttaatactagaaaaaaatgtccgtgcgttacaacgggtgaaggctattttaaccatgttgttatacaatttagttaagataaaattcactgtgagaattcgcttggatatatattttttctttagaaaattatgagtaacaataaggagtctgatcgtattaagttagcatgtgagttttttttaagagatttctaatatgactacttctcaaaagcgaacgaacttaaaaactaactcaaatatgaatatgtatttccaaaagaacttgaaaatcgactcatacacggatgacgtaccaaaataccgacaaaaacatcttcaatttttataatagtagagatgcaaattacttttagactttattgaatttacttttaaatgtctaagacgtaatttagttaaatctaaaagtaacttttatatatatatatatatatgtatatatatatatgataaaagtaatttacaaatataaatatttttcgttataatataatcatgtaagatcttgttgttgtgaagatttaattgtaacgaacacatggtgtaatcggattgtatattggataagtaatttgagagaaaactttgtttgaagaggaaaaagggcatgcatgcatgtagtacgatgtagtagactccacgttttctccatatttaggcgtcgctggttacgacaaaaacgaaaggcctctctaaatatattttacgaatggaaatggatttgctgggggcgcttttctcgcagattatttcttcaccgtgagatccgcgctaaaattacttcccggtcgattacgtgtccgaagattatgaaatcgttttgcgctgaaaaataaaataagcactgatgattaaagtcctcaaccaaacaggggtcatgttgacggaatgttacctagcactgctacataaatgcgtaaaaaagaacggcactatatagatccgaaaacgctaaaacctgttagtgagttcacctagccatagatctagtcgggttgcacgatttggatggatgaacagagaggaacagagagggttaagggatgtcaccggttgacgcgttggaggaggaggaggaaatgccggccatcatcgttgtcgtcgtgcgcttgacgtagacagcggcgacggtggtcatgacggcgacggtggtcgtggcaacgtcgatcgtaggcggtcacggcaaggcgtggcgcggcggtgatggttttcccgtcactagctgcgccccctcgatcggttagggtttttgtgggtggagttggcggcggcgacgaacctcgtatcgtgtgccgccctagcctccaccctctatttatgtggcgcagggtgatgggggcccaccagccaatgggctgggcgcccccaatcatagtgcggtcaaggtccccgttgtggtgttgggccccatggggaagagatctatctaacattctccccatggatctcactatttcttttagcatttttctattccatcacagatttgcacatagaacatgtttcatcgtcacggttaatcgccgacggatttgacagccactatacacatctctattcagaaacagatactttaacttttgggtctaggattcataaggcttcccttaaacctatgccggctacatgttccttggacacgttgggtggtaggcctttcgtgagcggatccacgaccatcctttttgttctaatgtgctcgagattgattgtttgatctcggactttatccttcacaacatagtacttcatgtcaatgtgtttggcagcaccacttgactgattgttgtgagcgtatattactgcgggttcattatcgcagtataactttagtggtttctcaatactgtcaaccacctttaaactggatacgaacatttttagccagttcacctgccccgtggcctcatagcatgctataaactcggcatacatagtagaccctgcagtgatagtctgtttgaagcttttccatgaaatagctcctcctgcaaaggtgaacatgtatcccaatgttgactttgtattatcttttgcaaaatcggaatctaaataccccactatctagagcgattctgatcttctgtaggacaacatgaggccttttgtaccttgcaaataacgcaaaactttctttaccaatttccagtgctctgggcctgaattactctgaaatctgccaagtaaccctgtgataaatgccaagtcagggcgtgtgcacacttgcgcatactgtacgcttcccacagctgacgcttatggctttgttttcatttcgtggagctcatactgatttctgggacattgtcatgccccatactttaaccctttgaccataggaccaagtgtcgcactgcatctgtacatgttgaatttcttcaacacctttgctatatatgcctttcaacacctttgctatatatgccttttgagaaagtcccaatgtatactttgttctatctcggtaaatctctatgcccaaaacatatgaagcctcaacgaggtctttcatgtcaaagtttgaggacaataatttctttgtttcctgtaatagactgacatcactactagccagtagaatgtcatctacatacagaattaggaaaatgaatctcccattcttaaactttgtataaatatagttgtcctcaatattctcttgaaacccaaatttctttattgtcccatcaaactacaagtaccattgtctcgaagcttgctttaatccataaatggatctctttaacggcatcctatattttcgtttcctttcacgacaaaacctttcggttgtgccatgtatactttttcctccaaacatttagaagtgtcgtttttacatttccaaatcataatgtgccaccagtgccattataatcctgaaagaatctttacaagagactggagaaaatgtctcattgtaatcaatcctttctctttgcatgaagccttttgccacaagtcgcgccttaaacttttctgtattccctctggagtcatatttggttttgtagacccatttacagcctactattttggttcctttaggaagttcttctaaatcccagacatcgtttattttcattgacttcatttcatctttcatggcttccaaccattcggatgagcgagcgcttctcatggcctcttcatatgaggtgggatcatcctccatatgcgactcttctatattatgaacttcatagtcatcacggatagctgatcttctgactctttcagaccttctaggggcctcctcatttagcacattctgtacctgaggctcttgttgagcctcctgttgttgatgcgaaaaacacacactagcctggaagatctgcttaactttgttgcaggtccaaaatcttgcttttaggttcgtgagcgtgctagttgatttgatcctgcaatcaacgagaaagaaaaacaagaaaaaccgcggttaaatccataaacgatagccgatcggccggtcgctaatgacatatcatttatttttgagccgatgttatatgtaaatcgatcgatagttatgaataagtaagataagactaaatctactcgatcggctgtagatactaatgctatataatccttctgtcgatgtatatttaaaccaagtgattgagatagatcggtcgccatgccgagacagtataaatcacttagatagaagtatacattaacataaagattataaacacttgtagcatagccgatcagatagatctagcatgtatcagctagtactccgataccactctatgttaagatcctaaaacaaatagaatatatcaaacagaagcctaatatactttattgcgataagatcttaatataaagggcagacctaacaaatcaattaagcatataaaacaaaaagctaagtcaggtaagatcgactgaaaccccgatactatctccctcgatgatcataaaacaagctagatatcataattataaatattacttaatagatcgaactcaaccgatgcaacattaagcataaagacaagtatgagatctaaacaagatgatgaaaatctacaaaagatggtagatacatgatacaatctagattaataacagaatataactctaccaattgttcccaaacaataagaaccagtcgataacaagttatataacgcaactagcctagattgtaacatgtatatgataactcgacggattacataagcagggttaaagtatcatgaagatggaagcattaaccccgataatgcaagccgccataacaagctttacctctagttgaagatcgaatcgatgcagctcaactcgaaagcaagaactcgtcgaaataaacgaaagtaaaaagggtggcgatgcgccgagattgtattgaacgattgttaattgattacatgggttcgggttctatttatacccgagatacaagatatgtccttgccggacacgacatttatctctaacaaactctaagataccataattctttgcggcagacttttgcccaaacatatctctaaggaaattacataaaatatcctaattaatagatacagttgcctatccgagagccctatctccgtcgtggaaatcttcatgaagcaccttgattgattctagaaacatcttcgaaaccgtcatcatcagaatcggctgcatcacctctatcagctgtgtcggctgtcctttgtccgatccatttcagccgatgcagactacagtcgatgcctttgcagccgatgcatactatgttcttcaaatcaacttctttgtcgaattcgcctcgatctcaatgtcgaacctggttcataatttaccaaatttggtcgtcaacaccagttcaggcacattatatgtttgaggctgttgcagctcctcctctggtgtggcaataatttctgttgaatcctgtagaaagggttcctcactttcattcattgttgccacaggaggggtaacaacaggtgctggtaccgcaacgtcatgcattgcacgtacaatagcagcaggtagagagaagaaaggctcctgagtcgacggagcgggtacaaacacccgcctctcctcaagatcaatttctcgaactaccgagctccccctaatcatttcgtcttccaagaagacggcgtgtctcgtttctacaaactttgtataattgtttggataatagaaacgataaccttttgatctttcaggatagcgaataaaatgacagctgactattttgggatccaatttccaaggtttgggttaaatattttagcctctgcaggactcccccacacatggaggtgagctagcgagggtactcttcccgtccatagctcatacagtgtttgggcaccgatttgcttggaactctgttaaggatatgaatggcggtttttaatgcctctatccataaacccaatggtagagtggagtagctcatcatgctgcgcaccatatccataagggtacggttacgcctttcagctaccccattctgtcgaggttcgcccggtgttgaatactgcgctactattccattctctagcaatgtcgcgaccgagaaaattttgcattttcccgaacgctagtgtattaatccccgtcccaggaaaagccggggtacaccacacaaacatgatacaaaaggcacatctttattatatcgataatatttacattattacaaaggcacttaaggcctgacaataaaaaataaacagcagcggactagcgggcctacggctccatcttcacaggcgctcaactggggtataagccaggactccacctaagacctcttctccaaagcttctcttactgaaggggggaaagattgagcaagaatgagtacaaccacagtactcagcaagccacaccggcagatgcatgattaatgcaagggggtacaaggggtaatgatataggggttaagttttgcagaaaacagcatttaaaagtcacttagttgcccaaagccattttataaagacgatcctagagttacatagtgttattaatcaaggccgtgaaccctcacgaacctgccttaacccaaggcctacgatgattcagaccgaactagcaacccgaccctgggtcctagctcgtcccaagccaacccaggccaaccattccacattttagttgttacgcaaattttaagaattaaaacattaacttgggtacattgctaggcttgcccataaccgagggcgcggctattcgaatagattatactctgatcagaggtgtacatctttacccacaagacacatcttcctcacgtgtaaccacgtgccacataccaccacggtatacggacagaagacgtgacatagttcccaacccatcctagccataaacaagagtaccgacccaaccccacctacagtcggaacccccgggacaggtaggcaggactgagcccccagcagcaggacaccggccctgtgtcatgacatctcgactaccgggccgcagctcgtgtagccttcatttgtcctagagatgtccatcgacccccgacttcgtccatctccatccgtgtacttttgtttataaccagactgagccacaaactaagccttacctactagacatgtggaagtacggtagtgctttgcaacagaggcccgagcttaatccttatattggccggggtactacttcccacaactggcatgcacccaaaccccaccgaaaaacaggttttaggggctttgaaagaggaagagaggggtatgtccaattccaccataagccaaccattccatagtatccaagagatatgaatattcccaaagtctaaagttataaaaaccacctaatgttgtcctattaatcagcgaagcatctacctaaattcatactagtggaaccatgaatagagtacccactagttggggttttgtttatcctagggtgaacaaggtaataataacaataacaataataaggtcataacaaaggaaaataggtatggctagataaaacagtgataacgcgggaatttaagtaaagcgataatgcaataatttaaatcaaaataattttataaactgggattcaatatgctcaaggatgatgtgtcttgccttgcttgctttcccaaacgtcggcttcaacctccacgaagagcggatctttcgaagctgcagcgtctacacgaccaacggaaaagaaaaggcttttactctaataaactccatataacaagcaggaacaaagcacgaaaatgggttcttgacttcttaaggaaaaatagagacttgaacggtccaattccgagttcaaatggccaagttatggccatttgaagtttatatgctctttaaatgaatatttgcgaatttcttcatttaaattttaattttaaaagggtttattgcgtcaccccagggggaggggcgcgcggaccgggtccacgggagtggggccaacccggcaaactcacggtccacggtggaccgggtgcacccgggcttgcac

SEQ ID NO: 13404 - DNA, 35008 bp, Oryza sativa
  unsure (1)..(35008): unsure at all n locations
cactttattgcacgcggggacggcgggatgcggctgaatccgcggcggcggcggcgctagggcgcgggggagccggcgggagcggcaggaggaaggggatgacgggtgggcccacccgtcatcgagggtggcgggcgggcccgcccgtcagcggcgcgcgcgtggagagaggccgagtgggccgcggggagaggagagagagggggagggaaaaagaaagggaggagggaaggacttcggccgcgggccgggggggagagagggagactttgggctagacttggcccataggaaaaggaggattatttttaggttttctttttattaaactttgataattgttgttgttgtttaataaatatttttggtgctctgaaaatttaagtaaaatttgagggctccttttagaccaaggagaattcaacaaaaattctccggaccacattcgtatttttctggcacgtattttagtgtttgtcaatttcttttcgaattttaattaattctattattccttttagaaaatgatttttattttgggatgaatttatcaggacgtgacaagcaagaaccttgcaaaaggtctagggacttgcccataaggcgtatgccgaccatagtactcccccccacggtcagatcatactattttaatctttacatcatgctgattttcaacctcagctttgaatatcttaaatttatccaatgcttctgatctttctttaattggataaatataaccataacgggagtaattgtgtgtgaatgttatgaatgagtcatagccatccatacttttcacaggaaatggatcacaaatatctgtgtgaatgatttccaaaattcctgcgcttcgttttgcaccctttttgatgctctttacaaactttcctttaatgcattctatgcattgttctaaatctgagaactccaatggaggaagaatgtcattcttaactagtctctcaattctccccctcgaaatatggcataaacgaaagtgccataatttcgatgagacatcaggagttctctttcttttcttgttttcttttgtcaacgaggacacaacattcacattctcataaagagataacaaataaagctcgtcttgcaacacagcaagaccattacatgcattattataccatagttcacatttgacatttccaaaatggtaatcatatccatcaaaatccaatttcgatacacttattaaatttctttgcaaagaagggacataaaaaacaactcgaagtaaaagtgtgaagccattcgcgagctctaggagaagatctccaacagcttcaacttttgccttcaactccattggcgactctaatggagctttcgcttctttgcgtagtcctcgtcgaacggaaaccctttaaacaattacacgcatgaatagttgctccagaatcaatccaccatgtggatctagaataaccaacataatgagattcatttacaaatgtaataatgttctcaactttctttgccatgtgttaacaaccaaatttggtaatatcggcatcggaaaagaagattagatcgaagcgatgtcggaggcggagatcgagttcgaaaacagagcaggaatcggctagagtctagatcggctacggtaagatcggctgagtttgagtcggactaggtaagctgatgtagccgatcctggcagtacaacttgatgtgtgatgttgggttggattgaggtgcttcaaggtgattgccgcacatgggcagagtcctgaggaggcaattgtatctattaattaggatgttttaagtaattttcttagagatatgtttgggtaaaagtctgccgcaaagacttatggtatcttagagtttggtagagataatagtcgtgttcattatggacttatcttgtaattctcgggtataaatagacccaagccctatgtaacttttaacacacacgttcaatacaatttcggcgcatcgccaccctttttagtttagttttgtttcgacgagttcttgctttcgggttgagctgcatcggtttcgatcttcaacaacaggtaaaacttgttatgacatgtcacgaccggaattaacccaacgggcattctactcgtgcgtgtattattccttgtcccgggaggcaaggtacaccaaaagttgatacaattcagagttttacaagcggaagcgtaaatagataatttattacatgggcggcgaaggcccagcacacacgaagataaacggaaaacagcggaagactagggcgacgaccacaggcactttgcggcaggcacaagctagacaccaaagccttcatcttataggaactcctcttctaggttggggaaaaattgagcaagattgagtacaaccacagtactcagcaagacacacccacggatgcagaataaatgcaaacgagtacaagggagttataataaagaggttagggttcacagtaaatagcatttaaaagacttttagttgctcagggccattttgtaaacatgatgctagagctacacaatattattaatcaaggccgtaaacccgcacgaacctgccttaacccaaggcctacgaagattcagaccgaactggcaaccagacccaggtcccagctcgtcccaagccaacccaggctaaccattccacattttagttgttaagcaggttttaagaatttaaaacactaacttgggtacattgctaggcttgcccataaccgagggcacggcaattcgaatagattatactctgatcagaggtgtacatctttacccacaagacacgtcttcctcacgtgtaaccacgcgccacataccaccacggcatatggacagaagacgtgacatagttcccaacccatcctagccataaacaagagtaccgacccaaccctggctacggccgggattcccgagacaggtaaccaaggttgaacccctagcagcaggacaccggccctgtgccatgacatctcgactaccgggctgcagctcgtgtagccttcatttgtcctagagatgtccatcgagccccgacttcatccatctccatccctgtacctttgtttatgaccagactgagccacaaactaagccttacccactagacatatggaagtacggtagtgctttgcaacagaggcccgaagaccatgcacctcgagcccagcctaaaaccattttgagggttttgaatagagtgggaggtgtgtgtccatttccacatagtccaaccattccataatgtccaaattatatgagcattcctaaagtctaaggttatgaaaccacctaatgttgcctaattaatcagcgaagcatctacctaaattcatactagtggaaccatgaatagagtacccactagttggggttttatttttcctagggtaagcaaggtgataataacaatagcaatgataataaggtcataacaaaggtaaataggcatggctaaataaaacagtgataacgcgtgaatttaaataaagcgataatgcagtaatttaaaccaaaataattttataaactgggattcaatatgttcaaggatgatgtgacttgccttgctcgctttcccaaacgtcggcttcgacatccacgtagagcggatcttccgaagctgcagcgtctacacgagcaacgggaagaaaaaggcttttactctaataaactccatataacaagcaggaacaaagcacaaaaatgggttcttgacttcttaaggaaaacttagagacttgaacggtccaattccgagttcaaatgaccaagttatggccatttgaagtttatgtgctctttaagtgaatatttgcgaatttcttcatttaaattttaattaaaaaaaagggtttattgcgtgagccggggggagggggcgcccgggccgggtccacgggagtggcgggccccacccggcagcccctcggtccacggtggaccgggtgcacccacgggctcaccaaccggcaccgtgggccccacgtgtcagccgcacccggaggcacgggcggctgacggcgggccccactcggcggccacacggcgcacttggaggtggccacgttggcgcggccggcgggaggcggcgcccgcgcccctatggtcgccggcggcggccattggcacggcggagcgtcggccaagagaggggaagggaagggggaaagaggcggcggtccacggctcaccccgggtcgacggcggcgacggaggaggcggtcggagtggagggaggcggtggcgcggctcgggttgactgggacggcggcgttccggcggtcggcgagctcggcgaggcagtggacggggtcggcggcggtgcagcgaagctggaggagacgacgccgaggcgggggacggtcccggcgagcgggtaggcccggccggaggtcgacggcgacggcggagagagaggacgacggcgcgagctcgattccggctgggagaaagggcggcgagtggcggaaatggacaagggaggtgcggggagggtttatataggcttgggagtgagagagggcagccggcggggaaggaaaccggtgcgggagacccggccgccattaatggcgccggcgggattaggggggtttccatccgaaataaagagagagagaggggaaaatggggggaaagagagagggaatcggagggaatatttcccccattcaattttgaacgggggcggcggagcgcggcggatttggcggcggcggcggcgctaggcgcgggcggagggagcggcgcatgcggcgggaggaaggggatgatgggtgggccccacctgtcagcgagggtggcggtgggcgcgcccgtcagcggcgcgtgcgcggggagaggccgagtgggccgtggggagaggagagagagggggagggagatgggccggattcggcctaagagagggaaggaggatttttagggtttttctttttataaaacctttttaactttgtttatttcttgataattattatttgtgctctgaaaattccacaaaatttatttacacattttaggctttgaggaaatatacaaaaatcctccaagccttatttgacttttaagtttgcacattttaatttttggaggctttcactaggattttaattattctaggcataaattaaagggtatattttaagatcgttttgggacgtgacaaacctacccctcttaaacagaatctcgaccccgagattcggaagaactagcgaagatatcgggatgggctgcctttagctcgtcttcacgctcccatgtagcttcttcctcggcgtggttgctccattggaccttgcaaaaacggattacccaattcctggtcctgcgctccattgtgtccagaatcttcgctggcttctccacgtaggtcaagtcttcgcgaacttcaatctgctctgaatcggcctgctcggacggcactcgaagacatttcttgagctgcgacacgtggaacacatcgtgcacattgcccaaggatgcgggcagctccaactggtaagcaacttctccgcgtcgagcgatgatgcgaaaaggccccacaaacctaggtgcgagcttcccttttgtctgaaacttgtgtacgccccgtaatggcatgacccgaagatacacaaaatcgtacactgcgaattccagattacggcgtcggtttgaagcaatgttgcagcaagcacgggatcagttcttgaactcattcatgcagacccgcaaggggacacttgttcagaagtacaaaataaaagtggttgctaatgatcctgggaccagttcttctaaggatggagatgggaaacaagctctagacggctcggctcagccgagtatcaagggtgctaccgacggctctctaggaaatcaaggcgaaaattctcaagaagtccatggagtacaaggtgatggggtgaatggagttcaagttgacggtgctcaggggctgcagggaggaaatcttaatagtgatgtggcacaggactttttcaataacttccaagatcgggttgattacgctgtgcatcatgctttgatcaatcagtctggggtgttagtcaataccctatcaaacatgatgaagtcaatagcgatggttcaatagctgaacatcaggctgcaggcccggtttatttgcaaggaggtgtcttcccaaattatcggtctttgatcaccgatgttcagccatctattcaggcggttccctccgttgcacccacaactcagccgacggcgccggcatcaactcctctacctgctacatcatctatggcgccgggccagccgatgaaccctcgggtgttaatgagagagcatccacaacatagcgggcaggtttcgagttggccaacccaagatcaggttgctgccatgtttctgccacctcaacctattgttgatccaatacagcagcagccgattcagcaacagccgattcagcagacaccccaaattcaacaggttgtacaaccaaaccaacaacaggtcgtgcaaccagttcagcaaacaccaccaaggcagcagcctctgcagccgattcagcaaacaccaccaaggcagcagcctttgcagccgaattaacagacgccattaagatagcaaatcgttcagccgattcagcaccaggggtcaataagtgcatcggccgggtttgcaacgcctggtggtcagcctgtacaacaatttttaaatcaagttgtcccagaacatttggttcaccatgtatagccgaatggcacagtaatgcctcaagttgttcctgagcacttgatgcgcaatatccagccgaaccttcacaattaccaagggggtaacttgagttaccaatatcagcctccttccccacaagcccaatattagttagggggattggctcaacctcagtttgcatacggtcagttcgagcccatgaagcaacagtcgcaaggggcaactcaacaacgaccgtgggccgatgtgattgctgatgtaatgagggaatagtttgggctcaaaccaaaagagactggaagcttgtatcggcagccttaccctgagtttgttgagagagttcctcttcccaatcggttcaaagttccggacttctccaaattttcgggacaagatggtgtgtcgacttatgagcacattagccgattcttggctcagtgtggtgaagcatcgactgtagacgttctgaaggttaggttattcaggttgtctttatctggatcggcttttacttggttttcctctttgccgtattggtcaatcaatagttgggccgatttggagaagcaattccacagctatttctacggtggggttcatgagatgaaattatctgacttgacagcgattaagcagcggcatgatgaacctgtgcacgagtatattcagagattcagggagatgaggaacaaatgcttcagcttgagtttaactgatgccgagttagccgatctggcctttcagggtatgattactccgatcagggagaaattctcgtctgaagactttgatagcttgtcacatctgatacagaaggtaaccttgcatgaacataggtctgcggaagttaggaaaagctctaagaaggttaatcatgtttgtccatacatgtatgggtcggatgatgacgaggacgattctgaaatagctgcagccgaatgggtgaggagtaaaaaggtcataccatgccaatgtgtaaaaagttctggaaaagtggagaagtatgactttgatattagtaaagctgataagatctttgatctgcaattccgagagaagcaaattcaacttcctgctggtcatacaatcgcatcggctgaggaattaggaaaaaagaggtattgcgaatggcataattctgggtctcattctactaacgattgcaaggtttttagacagcagattcaggtggccattgaggggggcaagattaggtttgatgattccaaaaagccgatgaaggttgatggtaatccttttcctgttaatatggtgcatacagctggccaaacagccgatagggtccgtgcaaagggttctcaggtgaattcagctaagattatcaacaaatatcagaggaagtatgacaaggagcaggagaagcattatgaagaatacgatgatggttttgaccctcattggggttgtgagttctttaggttctgctggaatgatggtagaggttgccatctattgaaaactgccctgggtgcagtgatatcgtcgggagctcaagccggtcatataataggggtaatcggctaaggcagacaagagtttctgttcatcaaagattgggtccagtgaaccaaggtcatggccaggaggacaatgtaatcaggaagaatcaatggtgtccttctggtattttcatgaagaatcaaaagagaagggttcaaagattgaggaatagggagcgccttcaggaggttgaacaagaaattaatcatcggctgaagaaagcaaagccaagacaggagtggcgtgttaagagtcaggttcctgtagccgatgatgttgcagccgatgaggcaaagaggttgacaaaagggaagagtgttgtgacggcaccgattaacatggtctttacctttgccagccgaattcgggattgatcaagctgatgttgacgaggtggaagaggaatcggccaagttggttttgtcaccagaacaggcagtgttcgagaaacccgaggggacagagaattgacatcttaaaccattgtatataaatggctacgtcaatgggaagccgatgtctaaaatgatggttgatggtggggccacggtaaatttgatgccttatgctacgttcaggaagttgggtagaaatgccgaggatctcatcaagacaaacatggtgcttaaaggctttggtggtaatccatcggaaaccaaaggtgttctgaatgtggagctgacagtcggcagcaaaactattcctactacgttttttgtcagcgatgggaagggttcttacagcttgttgcttggaagggattggattcatgctaattgttgcattccttcgactatgcatcaatgtttgattcaatggcaaggcgacaagatagagatcgtgccagctgacaggtcagttaatgttgccagtgccgatttagctctttgggagatggatggcctggattgtttatctggaaaagtctgggatggagattttctaaaagtgtccgattctgatatacaaccaattgaagatggagaacccaagctattattttgagggcgtcgcggagggttcaaatgtctacactaaggatacagtagatgatctcgatgacaagcaaggttaaggtttcatgtcggccgatgatttggaagaaatagacataggtccaggcgatcggccaaggccgacatttattagtaagaacttatctccagagtttagaaccaagctgatagagctcttaaaaagattttagagactgcttcgcttgggagtattatgagatgcctggactcagccgatcgattgttgaacatcggctacctatcaaaccaggggttagaccacgccagcaacccccgagaagatgtaaagccgatatgcttgaaccggtcaaggctgagattaagcgattgtatgatgctggttttattcgtccttgtcgatacgctgaatgggtttctagtatagttccagttattaagaagaactgcaagatcagggtgtgcattgatttccgagatctgaataaagctacaccgaaggacgaatacctaatgccagtagccgatcagctggttgatgctgtatcagggaacaaaattttgagttttatggatggaaacacaggatacaatcaaatttttatggccgaagaagacattcataagacagcttttaggtgtcctggtgcaatcggcttatttgaatgggttgtcatgactttcggcttgaagagtgctggagctacatatcaaagagccatgaattacatatatcatgatctaatcggctggttggttgaagtctacatcgatgatgtggttgttaagtccagagaaatagaggatcacatagctgatttgaggaaggtttttgagagaaccagaaaatatggcctaaagatgaatccgataaaatgtgcttttggtgtatcggctggacagtttttgggatttcttattcatgaaagggggatcgaggtaactcaaaggagtgttaatgcgatcaagaagattcagcctctggagaataagacagaattacaagagatgatcggcaagataaattttgttaggaggtttatttctaatttgtctggaaggttagaaccttttataccttttatgagattgaaagccgatcagcaatttacttgggaggcagagcagcaaaaggttttggatgatattaaggaatatcttagctctcctcctattttgattcctccacagaaaggaataccgtttacgagttggaagggaaggaacaagtcgtattctatctcagttgtcggctcttggatgctgaaactagatattcccctatggagaagttatgtttgtgtctgtatttttcgtgtacaaggttgaggaattatctactatccaacgagtgtactgttagatgcaaggccgacgttgtcaagtacatgttatcggctccaatactgaaaggaagggttggaaaatggatattttccttaactgagtttgatcttcggtatgagtcaccaaaggcgattaagggacaagctgtagccgattttattgtggaacatcgtgatgattcaatcggctcggttgaaatagtgccatgtactttattctttgatggatcggtgtgtactcatggttgtggtatcggcttggtcataatttcccctagggggcatgtttcgagtttgcttatactattaaaccgtatgcgactaataatcaagctgagtatgaggcagtgctcaaagggttgcaactactcagggaagttgaagccgataccattgaaatcatgggggattctttgctagtaatcagccaattggcaggagagtatgaatgcaagaatgatacattgatggtttataatgagaagtgccaagaactaatgaaagagtttcggctggttactttaaagcatgtctctcgagaacagaattttgaagctaatgatttagcccaaggggcatcggggtataagccgatggtcaaagatgttaaggttgaaattgcaacaataacagccgatgattggaggtatgatgtgcatcaatatttgagtaatccaactcaatcggcttctcggaaattaaggcataaggcattaaagtatacattgttggatgatgagctctattatcggacgattgatggagtgttacttaagtgcttgagtgctgatcaagctaaagttgcaatcggcgaagttcatgaaggaatttgtggtactcatcaatcggctcatatgatgaagtggttacttcggcgtgcagggtatttttggccgacaatgctggaggattgtttcagatattataaggggtgtcaagattgtcagaagtttggagcaattcagcgagcgccggcgtcggctatgaatcctattattaagccatggccattcagaggttggggaattgatatgatcggtatgataaacccaccatcgagtaaaggacacaagtttatattggtggcaactgattatttcaccaagtgggtggaggtgattcctttgaagaaagttgattctggggatgccattcaattcgttcaagaacatataatataccgatttggtattcctcaaactattactaccgatcagggttcaatctttgtgtccgatgagtttgttcagtttgctgataacatggatatcaaattgttgaattcttcaccttattatgcacaagctaatggacaagccgaggcatctaataaaagtttgatcaaattgattaagcgtaaaatttctgattatcctcggcaatggcatactcggttggctgaagcgttgtggtcgtataggatgggttgtcatcgatcaatccaagtccctccttacaaacttgtttatgggcatgaggctgttttgccatgggaggttagaatcggctctcgaagaatggaattacaaaacgatttaacagccgataagtattacaaccttatggctgatgagagggaggatctggttcagtcacgattgcgtgcccttgcaaaggttaccaaggataaggaacgtgttgctcggcattataataagaaagtggtacctaaagatttttcggaaggagagcttgtatggaagttgattttgtcgattggtactcgtgatagtaaattcggcaagtggtcaccgaattgggaaggaccgttccgaatttataagcttgcgtctaagggagcatatatgttgcaagggcttgatggtgaagtctatgggcgagcgctcaatggcaaatatttgaagaaatattacccaagtgtttgggttaatgcatgatcagcttgtattgccgatgcatgacagccgatgtgtttacatcgccttgagatggccgaattggttatattgcccttaattttttttcatggtaatcggttgtggtttgccgatgtccaatggccgatattgttatatcgcccttagttgttttataattttatcaatgtttttgacgttgtaaaattaggggggcacatatatatcaaaatgcaatgcaaattttttgagcgaagttttgcgcaaatttcaaagtcatattaatcggcacagaggattgtcaagacagtaaagcattagagcgtcttagccgattacaaaaaatttctaagtcctattacacaaaagttattgagacaagtattgctggatagctgaaatagctttttgcctaatttgttcgacttcttcaatagcttgagcatcttgagcatcagttccaggaatgatcttcaaagacttagtcagttcagcaacattcttgatagccgatttgagtcttgctttttactcttcgacagaccgcgggagatcggctagtttcttgtgctccagatctaattcggcattgcattcttcaagttgtgccaagagctcaatcttgcgagcttcgagctgatcaatattagatttgatcggaccttcggatagctgatcaagtttggttttttcttcatgcacgagctgccgattagcctggattgtggcttcaatttctttgcgctcacggcgttcggctagtcttagcttggctttttccagcttgaactgatgttgctcgagataagcaactggagttaggacatcggccaaatcttcgggaatcaaagcttgaacttcatgaagccgtgccctaattgactcgcagtcaactaccaagctatctaaagaagaggcttctagccgatgagagatgtcttcatgtgtttttctcacatcatcggatagaggagctagagctttgcttgaagtatcttcctctgcttcatcgaggtaatctctgatatcaaaagagaagagatcgactagaacctgcagaaacaatttcggaaaaagtaagagcttggtagattatagccgatctaattgttgagacaaaggaaaatttactgggatagcaggagcagctggttgttcttcttcctcgatgagatgactccccacagcttggtagattatagccgatctaattgttgagacaaaggaaaatttactgggatagcaggagcagctggttgttcttcttcctcgatgagatgactccccacagccgatggagtctggtcacttgacgatttctgtacaggaggagaagcaggaggaggctgtagagtaaaagaattaaagacatcttactggtggagccgacttggcaatcgttgttgccggttttttcttcacagcagttttctttttttgcaaccacaaagtctatgagtaattagccgaagagagaagtaattttagaagaagtcaaagagagatacttacccttgtaaaatgaacgggggtagaaggagttggaggcgtctgcttgggtgaagccgatggtgttctttctgtgtcactcatttcggctacagcctggtcaacatctttgccaatttcctcttcatctaaagcttgttcaatagacggatccaaggcgggtagatcatcagccggcttatcagtcggcttagttttcttgaatttggactttttctttggaactaaggtcaaggtactcacggccgatgatctggttttccttttcttgtctgcatcggctggttccctggttaggccatgaaggagagttgaagtcttgggggcatggtagccgataacagggggagatagtccacctctattcggaattagaccttgagcatattcaatgtttttgccactgttactttgatgaggaggggaggactctattgtctgcaaaacaggagccaaagattagtcaagtaaggaatcggctaactgattatgcaaattagtaatgacaaagtttacctggggtatgacgtcaaggaatagatctgtcatatacattgaagccgattgatgaaatagatgcagcttctattcaccccaccatctgtcaaagtttttgcttctaaatcctgccaattcaatattatcaatgctgcccagagggggtcctgggaggttaagtagccgatccatcattagagtagatgtgatttgtcctcggcactgaatcttgtcggtaaaaaataagccgattaggagttagcccaatccaagttgtctggctgagctcattgggtgataaaactcgtaggagacttggatgtttctcccttgatgaatgccgacaagaaggatgcatgggctgatggcagccataagaacttctctggatttttggaatttctcatgattaatgtcttcaaatctaaagtctgatggaagttcaaggtctcctgagtcttcataatgaaaccagattcgtgcatctttcttaaaaccttcgtagaagctgcagaaccagtccttgagcagctcagccgatagcttcgctccagcatcggatggtgtggatgcatattctccatatgacatgcatctgcgatgggtgcgttcttctccgtcatcttccacaatcaggttctgtagtgggaattcagcttctgttacagagggccgattgacaactttcatgactatcaagtttaaccaagtttgtagcagccaccatggtccacctgctccaactattgagccgatggctattttagccgatgcattgttcaacatttggtacagatagccgagaaggattttgcccaaaggaaattctttctttgattctagggcttcggctaaaaactgccagttggttgtagggccacagctggatccacagaagaggatccacatgagcaagaaagctatatgctctcgaggggtaatagatccttggcccatatatgccgccacatagccagaccagcctcctatgctcttggtcttgaaatcaaattggttcttggtattcatactcatagggttagccaatgaagttacatctaatccagtaatcatggtgatgtcgattaaggttggagtccccttggttgaataagaaagcattgatggtgttggaccagaagtaggtggcggcagccatcagaggttcatctttagcagaattggctatggtgagagcaagcgcttggccgattccaatctcatcccagtgaaccttcttactagccgatacgcgttggtaccaggtggtccagctcttatcaggtgtgggtttttcaagagatggccaagacatgaagatattcttccagtgacccaggttagggttggctagcctaaaggggatccggttggtttcaccaataatgaaattagtggggtcgagattgccgattgggacaagaaaatagtggtttttgtgcgaaaggttgggaatcgcgacttggttggagagatgctacaaatccaaaacaaccgaggaaaagagagcgatgtaagataagagaaaatcgatctgctgctatgaaaggggatctagcctatggggacttacctcagcgtaatcggctgatggcgcatcagatgggttggtggaggatgacattgctgcgggcggagatctcgccggagatgaagtcgcctggaagtcgcttttgcgtcggaggaatagccggagagagagaagacaaagttttgcttgagcggtgaaaacggaagtcacggtgtgagatttctcgagggtgacggttaatatttaaagcacggcagtaacggtcggaaaacggcaaagtgcgaaacttgctcggagtcgatttacagcaaatccgaaacattatcaaatattccggacttggggggcatgtgttaacaaccaaatttggtaatatcggcatcggaaaagaagattagatcgaagcgaagtcggaggcggagatcgagttcgaaaacagagcaggaatcggctggagtccagatcggctacgataagatcggctgagtttgagtcggactaggtaagccgatgtagccgatcccggtagtacaacttgatgtgtgatgttgggttggattgaggtgcttcaaggtaattgccgcacatggatagagtcctgaggaggcaattgtatctattaattaggatgttttaagtaatttccttagagatatgtttgggcaaaagtctgccgcaaagacttatggtatcttagagtttgttagagataatagtcgtgtccgttatggacatatcttgtaattctctggtataaatagatccgagccctatgtaacttttaacacacacgttcaatacaatttcggtgcatcgccaccctttttattttagttttgtttcgacgagttcttgctttcgggttaagctgcatcggtttcgatcttcaataagaggtaaaacttgttatgacggcttgcgttcttgagattagtgcttccatctttatgatactctaatctagtttatgtgattcttcgagttatcatatatcttacataatccctggcaatatcgctatctaacctacaatcggctaacatctatcgaagaaggcagccgattaggttagattctgacgttgactcagattatataagatatttaccactttatgaaacttctagcggcttgattgtctagatattgttcttcttttcatacttaatgctgcatcagttgagtttgatctattaagtcgtgcttagaatatcaagctctagcctgccttctggttgccgattagggtagcatcggagtttcagccgatcttatctgatttagccacatttgctctatatgcttcattgacatgttaaatctgccctttatgtcaagatattgctgtattcaagcgtattaggcctttgtttgatactttatacctattttaaatatcctgatatagagcagcatcggagtattagccgatacatactagatctatctgatcgggctatgctataaacatatatagtcctgttattaatatatatttcgaactaagtgatttatattgtctcggcatgatgaccgatgtcacatcctgatttttgtttcaggatttataaattatttaataaattattaataaaatttatattaaatgttctttaattttcaagtgaagttaattgtgggaaatagaatttcctaaaaataaagcatggatggatttaatttttattaaattctccatgattaagtcaactctctgaaattttctcggatttttcagagctcaattcctaaatgatacaaagaacagttcagtaattacttgatcattaataatctaattatatttgttaagagcttttcttgtttaaaaatccttaaattataaattgttgtttaaaaggaattattagaaatgattttaaaagcttaaaagagaagatctaattttaatttgctaaatctcaatataaaattgagctagataaaattttgttaaatactttgcttaattctataattcctagatttttctgggatttatttgagctaaggaagtatttttaataaatggaattgcatttcataaataatttaaattgaaaaaggtttttaaaagtctcttttggctttgggccgaaagccggcccaaaacctctcttctctctttccctcggcccagtccggcccagtccaccgagccgccgctctcctctctctctcagccgctgacaggtgggccccttctgtcagggtcgtcgtcaacctcaggccgccgctgcccgaaaccctagtttcgcgccgccgccattcccttccaaattcgatcgatcctttccgtttccggctgaattgatagaggggaaacatcggctaattcgttttggaagttcgtggaatcgagttcgatttggatcggcctctttcctccgaaccccgaagtttccttctcgtcgccggccgccgtgggccttcgccgccgcctccgagcccctttaaaaggacccccgagctcttctctacccgccgccaccttcgccttcgcctctcgtcgtccgtagcgccctagcgccgtgtgctctagcgccgccgtcgccgccgtcgcttcagccgcgcgccgccgccgttccagacgtcgccgtcgctcgggaagaccgccgtcgtggtcgccgtcgcgtcgccgtcctcgtctgcccctttgccgccgccgaagaccgccggagcaccaccgtcgtcgtcgatccgatctccgccgccgcttcttcctcgtcgccgtcgccgtccattggtcttccgccgctcctttggtcaccggtgagttcgccgcgtcgcgttctacccgttggtgccttccgttcgcgccgccgcgccgccgttcgccggtgagcgtgcgccgtccgagctgtcgagccgccgagccgtcgccgccggtggtgacgtcatcgctgacgtcatcgtcgccctctcccgtgagccggtcgtggaccgatcgatctcggccgttcgttttgaatggatcgatctcggccgtccgtttccgtgaaccgccgccgtgcgcccggtccaccgcaaaccctagccgctgacgcaataatccttcttttccttttcaaaaataattcattactgtgtcataattcaattaaaatccatataagtgttttaatccgatttaatctttaaaaattcataataaatttatttgaagtcagaatgaggccgttcaagtctcataattcatctaaaattatgatctacatgtttgtttactttttatgtattgtttatttggtttttattagtctttttcttcattttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttgcattgattattttattccttgataccttgggttattattaacttgactagttgagctttatatattggttcagctagatattagatatgattgcttagccatgcttagaaacattagcacactattgggataacttatgactcattatttaatgatggcttaatgatagttcacgatggtcaatcgtgattggttaattaattacttgccaactaaaacttgataatggtgggttgtgagcacatggttttgagagtcgtgctcatggcaattaaggaccggttcgcgagctactattgtgaaacattaatcgtgccaaccacaagccagcgtgggcaacgactttaccttttgtataacatgattcattgcggagcaccagactgagaagtggtggagataagcccacgggggtcgctggggagtccatgcctctggtttttgagggggtgattatgatccaggaacggtgcactgtggtgggttgtgttatgcaaggggtaatgtcacagcccctttccgaggtaccgtggtggtactgaggcacatggtgacatgttgtggggctgtgtcttgtgggtatagtggtacacctctggccagagtaaaactattcgaatagccgtgcccgcggttatgggcgggttgagcaatgtttttcgtgattagtcccacacctctcacaataattattgatgttataactagtaataatttgcttagctcctggtttggagattagatctgtacagccgggtatggttgtttcagaatggctgggcctgagcagcatgggcgtgttgttcagtgttgattaaaatttctgattaattactccactgttttacatctcttaaatgatttgctaagtgctgcttttgcaaatgagcctatattatgccatcctttggtatccttgtgcacttgcatatttgctgtgtggcttgctgagtatgtcatatgctcaccttgcaataatcaatcaacctcagttgaagacaagttgcgaaggagaagacgtttggcttatacccctgttgagctgcctgtgggagtggagccggagcttcgctagattttattttccgctgcagttttcttcatggtgaggactaagtgcctcttaagtaagtatttatcgttttagttaatttgatgaatctgtatattaaattgtcagtttgtgtacctcggctgattcctagacgaggattttatgcacaaataagttcggaaattactagtgaatttccgggcgtgacaaccgatctatcctaatcacttgatttaagtatatattgatataaggagtatatattgttaatatctacagccaattgagtagatttagttccttcttatttattcatgactgccgatcgattcacatatgacatcggctcaaagataaatgatatgtcatcgcacctagccgatcggctatcatttatagatttaaccacggtttctttgcttctatttcttgttgattacaggatcaaatcaactggcacgctagcacacccgaaggcgagctttggacctggactggagttaagcagatctcccaggcttcgtgttttctgtcaacaccatgatcattttcaggaagccaggacaatctttcttgtaatgtcctgtcttcttgcagtagagacactgatccttttcaacagtgaactgttgttgctgaggcagatgctgaggctgttatacttttgaggagggtgacttgtagttctttttcttgttatctttaacatagttaatagagccaccattggactctttgattctttcctcctcttgcacacaattagcgatgagcttttcaaagttccatttctctggacttatattgtagttgacaaaaaagttgttaaagtgctttggcaatgagaccataaccagatggaccagaaagtcatctgagatgcccaaatctattggcttcaacttggaagccatgttgctcatcctaagaatgtggtctcttacaccacctctatggtactctctgtcacaagctgctttatcagctatgtagcataagtctttgaagaaccagtaaactggctctttattctttcaaggtagtcagagacggcttcacactttgggattgagcccaatatggttggctcaattgtgtttttttaccacagcaaaacatttcttgctggctaaggaccatttcgcatgctcaatgtcatacgacattgtgaggggagcattgtccctctctctctttcgccagtcagcatccgactctttttcacctctgacaagtgtagcaggttctataggacatggggtggtcaagacccaatccaccactcccaagataaaagcaaggtcgagttttcttttccactctccgtagttatctcctttagggtcagaatatcttttattcaacccatcaaggagtagccacctgaaataatcatgtactgtgagaacaaaattaacattaaaatattatgcattaaccttaaatcaccgttgggcaaaatagacataacacataaagccataactataacattgaaattaacaacgtttgtcagaaaattacaacatcatagcacaaaattaatgttcttaaaattaaattctcccgttggttcgaaatttaattttagaaacacgaatttttatcaatttcatctatttgtagcggaagatctatataaaatacatatgaacagtaagaaattctgttatttactctgtgtaaaaaattacccctttggttcaaattttaaccagaggtaaaacatgcaaaatctattcaaattctattgaaatatgcatgaaaatagacaaataaaaaaggaaaagcgctattgttcattgcccgtcactttcggcccattggaaaaaggcggcccacggccgagcgcgcgcgcgcgcccccttccccataggccgcaacctattcctaggccgggaaagctgccgccacgcgcctccctcttgtgctcaattcggccggccgacaccggccgtccgatcgccaaggtttcgatcggacggtcgagcggagagatcgggcgatcaaaagccctagcccgtccccagccgcctgaaaaccctagccatttacttccacgtgcagccacgcggagcagcgtcgccgccgccggcggccctcgtgccaccgccccatggccggcgtcctcttttctcttctcccccacagtctaccccaccaagtgagagagagagcggcggccgtaggagatgacagcgccgctgcgggccccctcgctggcacgcgcgtgcacccgcgggtgcgcgcaaggctgtcgaggggctccgtggtggtgccctttgccctccccccttcccattgccggcctaatgccatgcaagttttagaggaaatctagcatgaggttctacttcatgaaaactttcctatgagtctttaactctcctctaattcttgtgtttttcctgtggtccaatcaaatgatcattcctatgtttttcatgtgctttgcaatcctctgttttacacttacattcatatcaaaatcaagcgtttttcctatttctacattttttcaatcctatgattcaaaggggcccttaaggttatcagggaaaggtgccgtcacctttaaggcctaccctgcgcgagtagccactatgagtgctcattttactaaacaacaccttctaggctgtcagacatatatatgtgccaattctatttatgaactggcacctatgagctcgcagtatatagcccatcatcctcactcgtcgaggtgatcgagtaaagaacatagcggcacctctaggttttgttcgaccagctagaggaggggaggctttgctctaaatttttgggattgttggagattaactgctacaagattagttttcactatttttcactctgtttcattctttcttgttgaattcaaccatttgctaagtatatttatatagtgcgcaacgaaaataattattctatttgttttctatcagttgaatttattcggtttgttgaattctttttcttattatgtgcaacataacagacaagctgcaacatctaataaatgtttgattaagttgataaagaggaagattgcagaacaacacaaaaatggcatactacactagccaattcgttatggacttatcagatggcgtgtcatagagctattcaagtgcctccgtatcaactggtttacggacatgaagctattgtacaaagcttataaagcaaaattataaaggagaaaatttagaaggaataaaggagaaaattagcttgtaagcaaaagagtgttgtgtaacaaaatagtttaagtgttttggaactcagaagttttacatcaacccagatatttctggattgtcgataccacacgcgggcgtatttgatcaacatcgtcgatgatttttgcgtcttcggcatcagaccttggtatcggcttaatagatttacgccgatcagctggcttgcggatagtggctttgttctagctcttgccgtgtgctctccagcgcagcaagcagatcggcttctcccttgtccaattctttggtttgcttttgggttgtctcagggccgcggctaactcactgagcttggtttttttctgctctggctaattgtctatcagattcgatagtagcttcttcagttctcaagacgacgcggtcagccatacgctatcgagccctgaagactttgatccgataggtctcgaggtaggctgttggcgccaagtcattgatgacttcgtcgggaagaaggttttgaacttcttcgatacgaccccagatcggcacgcagttctcgaccaaggcatcaagcgatgcatttagctggttggtaatgtcgaggagagcgcttctgatagtgtctagaggtgggaaggtagcctttgctcatgatgtcgtcttcactgtcatcaatgaattggcgaacatcgaaagaaaagatatcggtgatattctgtataaacaagggttgtattagaggtgaagcgtgaaaggtaaattttggagttaatggagatagtttataccaggattcttggagcagcagtctggggttgggccttcatcggtgtgatggctatcgacaatcgaatcgagtgggaaggagcatgttcgcttgaggtctgccaatgaggaaaggaggttgaacggccagctgcaagtagcaattcatgattaaaataaagttatatgactaggaatgaaagaaaacgaggattaagtttacaatgctggaggggattgatgatgtggaggagattttcgatggacacttgcatcgcttacttgtttttatgcaatgtaaacggctgtagatatattttcgtaacggcaaggcaggctcctcatctgcagaaccattggcagcatcatcaatttcctcatttgcaacttcctcgacaaggacttgttccacttctaggttaatgtcggggaggtcgtcttctacttgggctcagataaatccgcaatcgtatggataccgctatagcatttcacacataaatattcccaagagtattgtagttatatttccacagggaaagtggtgacataaagatatgtttttctgtatctccttaatcagcctataattaattcaccatagtctaaacaagggttaggataataattaataaggtagtggatacacacaggagatccacctctataagaatatgtagtaggaaattagctttaggaaactacaattcatctgtacttctatactaatcatgtctagtatacacttaacatatacaagcttacaacataggatttagttgcaggcacccaggcaccagcaagagaccactctctgctggtctgccagcatggttatggcatttacgcactattacgtcatatccaaatgcggaggaatacaaaggactgaccgggctgtcaccacctgctggctacctcacttactgtggggcacacccgcatccaacgacatttatttagcctatgcaccatgcttattccaacaaataatatcactaactcctccggaactctcaccctacggatgaacaagttggagctagagcaacctataaaggtcatttgaccatcaccgtagaacagatcgactagcctaggatgaagcggatatacaaagtatatactactcatagaacttatactcaacaaagaaatatataaaccatgagaataaataaatagagaagataattctattaattggactatagacttatcagaagagtaaagtactagagacataaccaaaactccatgaagactatagtattaaagctcctaagctttattcctactagaaactatagagaatacaaagtgaaagggggaatttcctccttgaagtgtgtgttgtgaagtgaagtaagcttctccttttatagcctcctaatgacagtagtgaagtcagttgtaggtagggttgaaagtgattcggataatttccgtccgaccggaccttttttcggattcagatagtttcggtcggatatatctggaaatttttgaattcggaaatgaattcggattttttgtcagatatgaaagcgaatatgatataggtgatatccgtcggaatcggatatccgtcggatattatccagtattttccatcggatatccgacttacacatcagacccataagctagcccaacccaaaaatgaacttcaaattaaattttatgatactaaatgaactcatatgaaaaagttgttaaaaacaaagttgtagaactcattgagatctaccaattttattttggtcatttctccatccaagtttgattgaactatataaaatttgaattttaaaatataagaaattcaaataattttttcgggtagtaaatgatttcaaatggaaaaattgtcaaaaacaaagttgtataacatatcaagatctataacttttatttttgttattttgctatatgactttgtttgaacagtttgaatttgaatttaaaaatatgacaacttcaaacaatgttttcaaatactaaatgatttcaactgaaaaagtcatcgacaacaaaattgtataactcatcaaaatctataacttttattttggtcatttctacatccgacaaagtgatagtaacattgttcacaaaatttacatctctatcatttgtttttataaactagaagagagagatgtaaattttatgaacaatgttattatcactttgtcggatgaagaaatgactaaaataaaagttgtatgtcttgatgagttctacaacttttatgttcatgactttttcagctgaatttatttactgtttcaaatatcatttgaagttttgaaattcaaatttttaattgataaaacaaagtcacaaaaaatagccaaaataatatagtaaaaacacaataacatgatatagcatgattttagaaacacaatatcaaaaatcgtttgtgagtattgaggggtttttatattctgattaatattcgtcaccgtattcgtttcgcttcgtattcactccctatttatatccgataagattcgattccgctttcatatctgggtttccgatttcgattccgaaaaaaaatatgaaagcaaatatgatagagctagtttccgatcgtattcgatccgttttcatccctagttgtaggccgggaaacggacataactgccattaggagtgaagaaggaatcgccatgtggaagctcggtgttggaggcgccaagcctagttcagccaaaccatggccaccgtctttcaccaccgcctttgatgagaggatggcacctgggcccatatgatggttcctggtggtttggcccctctttaagtcggtttgcactgacttgtgggcccatcaatctcgtgctcagacatgattcggcggaactgtgtttcttcgcatgccagcttcatttctcctccactttaatgtatattctctgcatccacattagttctccaatcctaatacaattaaattatttattattgatatacgtgtaagaaatgttaatttcccctttattcattatgctagttggtggacaaaattggtggttgtcccaatcgatgaaggggccaagatctggaccgttgagattcaagagccgattgctcatgagtgtgcttgtgatgggtactcgagtctggattttgtcgatgaagttgtcgatgggttatgctattactacagtattcagaagtatcgggatacgatggtattaaggtatacgcgagactgaggtaaaaagataggagacatggatttttatacaggttcgagccccttaactgataggtaatagccctactcctgctggccgaagccggtgttgcatttatatatcaatatcaaatgagtacaatatttgggatgacccaatctagtctctgtcggcttgacgacatggatttccaacacgtagtcgacagctagtgcagtctttttcctcaaatacaaactcggccagattgggggtagtgctagatcccttttgttggcctctgtatcgccaacattgggttttgtctatgcttgtcccttatgttggtcttgttggcgtgtcccctctcgtcctagggtgtcttgcatttatacccttgcatgtccccttgtccaagcaaaactagggagacaagtgtggatacgatccgagtagtccttgtagtgcccaagtaaaattatgtttttccttcttaatccggaacaccctccgtacataaggcataattctgtataagaattttaaaatggtaggccccgttgagcctacccaagactatcgagtatgccttatctatgacactgacagtagcccccgactacaatgcaaatgaccccgttgcgtccttgaccaaagaccctttgaacacggaaatgctaatgggcgggtgatcgctcccccgtccgcccagcgatcacccgtccgcccatcccctatactcgatacactcctccctcctctcccccctttctccaccccttcttctcttcctactacagtacaccacaaaaattttgtaaaaaaaacaaaaagttagaaaaatttatgtatagaaatacaatatataaaaatttgaattcaaattcaaatttgaatcggctatgtaaactttggcttataaactttgggtctataaactttaggtgtataaactttagatgtatagaaatactatatatagaaaatatttgaattctattcaaatttgaatcgggtatttaaacttttgacttataaattttgggtctataaacgttaggtgtataaactttagatgtatagaaatactatatatagaaaatatttgaatttaaattcaaatttgaatcgggtatgtaaacttttggcttataaactttgggtctataaactttaggtgtataaactttagatgtatagaaatactatatatagaaaatatttgaatttaaattcaaatttgaatcgggtatttaaacttttgacttttaaattttgggtctataaactttaggtgtataaactttagatgtatagaaatactatatatagaaaatatttgatttcaacttcaaatttgaatcgggtatgtaaacttttgacttataaactttaggtctataaactttaggtgtatatactttagatgcataaaaatactatatatagaaaatatttgaattcaaattcaaatttgaatcagatataattcaaattcaactttgaaacgggtatgtaaacttttgacttataaactttgggtctataaactttaggcgtatagaaatactatatatagaaaatatttgaattcaaattcaaatttgaatcagatatgattcaaattaaaatttgaaatgggtatataaacttcagatgtatagaaatactatatatgaaaaatatttgaattcaaattcaaatttgaatcggatatataaacttttgacttataaactttgggtctctaaactttagatgtgtaaacttgaggtgtataaactttaggtgcataaatttactaaaataggaaagtaatgtggtgccaaaaaaggaaaccaggtggagggggggaggggggaggggatcnnatcgntnccccatctncnnnaaatccntcncccnttnggatcccccctttgaacatatgatgtcatactcatctaatcgttctctgcttcccgaggagatatagagtatgagaccaagttccctatccgatcttgctcgagaacgataggccaatttgaatttggattgaagtcaaaagataccatcttggcgagcacaccatcgctttaccctataacgcttgtcaaacccatccaattgttcccggacaaccgaacaggtatagagtacgttgacaagtctatatatctaactttcctgaaataaataacttataataaattgttcgataaaaaagcacctaagcgaacgcttgggagttaaatattaaaaataaattgaatatgtgtgtgacaataaaagagtactctcgctagagctgcccttagctaaacgtagtttattgtactcttcccagccccatctgtctttatggaaaattgtatttccacaaaggcagcttgaatctcataacaaactaatgtgaagcagtgagttcctagcccccacccatgaagttgggttttcccgagtacacgtcttagttcatacgttctagtgggtactctaacatgaccaatcttacatgacctgaacaagctttaacagtgacaggcatccacagccgagatccatgggaccccgaagcttgtcgggctaacttaataggatattagaatcgacttcaaccggttgagatatgaaaacataggaccaacggacaaatattacacatttgatatgtataaacacatatagagattaatgcacgggggtgatgagatcgccaccacgctggtcgaggaccaggtgtgtagttgtactcgtccattcatagatatgatgggaggatcgctacgaccgctggtcaaggactaggtgtagctatagctcgaatcctcatagatgtggtgggaggatcgccacgaccgctggtcaaggatcaggtgtagccatacctcgaccacttgtagaggattcagagaggtggaaggatctctaccatgcctgtactcggaccaggtgtgtagtcatacctcgaccactcgtagagatggtgggaggatcgctacaaccgctgttcaaggaccgggtgtagccatacctcgaccacttgaagaggtggtgggattgctactagtttgtagtcctatcttaaccatttgtaaagaactcgtataggtggtgagatcgctaccatgcctgtactcagactaggtgtgtagtcgtacctcgaccattcgtagagaacttgtagaggtggtgggatagctaccatgcctgtactcataccaggtgtgtagtcgcaccttgaccactcatagagatggcgggaggatcgatacaacagctagccaagggctaggggtagccatacctcgaccacttgcaagggcgcttagagttggttattacatgtgcatcctatgtggccaacatgactcacataccctacttataagtatatcagatgtccgttcacaatcatgtcgagtgatcaagccgacaacattagtgaggggaatgtatgtggtaactttttcacaaatagacctattcgtgaccgatactagatgtgagacaggttgccggtcttaattgtaggtttggttggacaactctgcattcattcgagaacattctcgacaatgggtgtgctcgtctgctgcccactatagtgctcgattattcctgaattttttttctagaaggcaagatatataacagacaataccaagtatgtacttgaaatattttataaatcttctagtattatagggatataaaaagcagatttaaattgaatatcgggtactatatttaacgtaaacaagcatgatttatacagaagaaacatagcaagcccccaatattaaaccgttgtcgacgtaatataggaacgctggcacaatagatattgtataaaaaacacgctctaagtaaacataataaattgttgatctaacaatattgtgtggatctgaaagttggtacggtaaattgtatataaaatgttgcataactgtgtagatatatgctggatatatcaacaaaattagtagagtaatttaaagcacaatctactaattacctttgttgatttgtgcatgacattaaggattgatgcacgtagtactctcctgtacacggcactgtagggtgtagtagacatatgatctaggagtacagccaaatgtgcgtgggccctcccggcttggaaggataggatgtgttcggcttgccgaggtccaaataccatgtatgtatgctcgtccgattaagagtcgaaccgtcacataaggtcttaggcctgagtataatcgaacttgggcaacagttattctgatatctcattgtagattaatgagttcatctgtaaatagcaccgtagttatctagtctgatctagtcgaattttggcggtgatattaatctggaagtattttctctgggctgagaccttatggtcaatatcatcgaaccgatattctccgcgacaacgacatcttgaagcttggctgatcctgataaatagaactgttgggtggcaatgattctgatctggtcgaggaatgtactctagtcgggtcagatctcctagtgtcatagtcgttgaagtattcctcgttgaaaaatccgtagcgacaatatcttgatgaatattgagatgacgagggtcccgatctatatgagaacgcacttcggtcgggtcatatctcccaaagccgacaacgtcgagtagtttgttgtcgaaaaatccatcttctcacaacccatcttgttgataccttgaaacatcagccccccctacctggtgcgccactgtcgatgggttataccacgactactgtatttagaagtatcgtggtacgatggtgttaagctatatgcgagattgagataaaaaggacaggagacatggatttttatactagtttgggcccctttactgacaggtagtagctctactcctgttggccgaagccggtgttgcctatatatagcagtatcacacgagtacaatatttgggatgacctattctagtctctattagcttgatggcatggatccccaacacgtagtcaacagatagtatagtcttcttcctcaaataccaacttggcaaggttggaggtagcactagatgcctcttgtcgacctatgtggcacctacattgcgtctttttaggcttgttccttatgttggtcttgttggcatgtcccctctcctcctagggggtcttgtatctataccctcggatatccccttgtccaagtggaactagggagacaaatatggataagatctgagtagtccttgtagtgcctgagtagaactctgcttttccttactcatccgaaacaccctccgtatatgaggaataattccgtataagacttgatttatggtgggcccggccatgcccaacctaagactattgggtatgccttatctatgaattgacaaaagtgcagcgtgattgggacttggccaaagacaagttgatgggtcaccatcgatggatgatagaattcatatgagacacgagaatagtgacccatggtgatgccagtaggaaggatgtagggggtgatagccgatatgaagatctcccggcttgtctcattggaattgatgttgatcggattgaagtccgatggacgcgtgtagcccttgaattcttcataagggatccaatttctggctgccctagggaaatcggtgcagaatttatcaaactagagtttgaaattttcaggtgtaaggctattccaagatagataattgccgcttcgccaagtgacatgcatcagcgaacaattctatcatagccttttgcaaaattggttggaaatctggagttggcaggggggcagtttggctaattcgatagggtagaacttgagccagagttgtacaagtcaccatgggccacccgggtgtccgataggttgaccggctaacagtttggccgatgcttgctagagaagttggtaagtggcgccaagaaaatattttcccaaaggaagcaacttcccttcagagagagcttgggcgatgtgttgcatatttgatgttggaaccgttgttgtgtcgtagaagacaaatctttccagccatagtttcttgaaagctatgtgctctctatcggtcaatgctccaattctagcatgcttggcgatatagcttgaccaaccgccaacagacttggtttctaacttgttgacacattttaccctcaaattgaacaagtttgccgatgaggcgatgtccaagacagttagcatgacaatatccagcaaagtggggtcatcggtgcgtggttgaacatgaaaacgttcaaggcatcgaaccaaaggtaagtggccgatgcaatcaaggattcatcttttttaggctgtggggtacacggtaccacggtactcacgggctcacggcaaggccttgggccaagaagcatggtgtgggccgagagccctaggcccatgcggattacatgtaaactaagaaaggtgtaaaggataaggcaactaatcctatcccatgtaaatagatggtaggtacatggattatgatgataaccttaccatatccaaccgggagccctagcaactatataaggggcgccgggggaagccctaagggttactcatcattctctgcataggtgctcacgtgctattccaacgctgtgttgtgcacacccacatagatctaatctacactaactacactagggtgttacctcacaccgaggacctgaaccagtaaaaacacataagtcaccatatctccttgatcttgtgcaccatataaattatattgccgatcataagatttgacaccggttcaggcgctcagctaatgatagagcaaggcactgagctataccaacatcataccatacttgatgattggcctccaacataggccgataccagtttttccagccggggagcttggagggccgagatttgaagcctatattccaatcggggatgcaagggctagattgcttaaatgaaatacgatttgtatcaacgttaatgaattccatgggctcctcgtcacccatcgatccaagaaaataatataatgcatgatcggctagtggaatcgctatttgatatctcatttgctacagtaagatgaacagtaaaaggggtgaacatgaataatacgaggtgcaaatgaagtaaactgagggttttgttgatctaatatgagaaataagaaaagaaaaggtagagtgtcatggagttacctctgggacgtcgctggtggtggccattggagaagatggagcaattcgctggtgnnnnnnnnnnnnnnnnnnnnnnnnnnnnnnnnnnnnnnnnnnnnnnnnnnnnnnnnn

SEQ ID NO: 13405 - DNA, 2785 bp, Oryza sativa
actccctacgagctctagaattgctgcacgccggcctttgaccacctttgcacattcggctgcgtcgcccacgtgaaggtcaacaccctcgcacctcaagaaactggaggaccgcagcaagccgatgatcttcgtcggctatgaaccaggctcaaaggcgtacagggcctacgatcccgtggcgcggcgggtccatgtctcgcgtgacgtcatgttcgacgaggtagcccagtggaactggaatggcgaactgggcgcccctgacgacaccgactttgtcatcgagtacacctccgtgttccagcctggcacaatgccagtgacgcacgcggacgcgggggagctcgcctcgccgatcacgggggggtcctcacaagctgccccgagccctgtgacaccatgtcgaacacctgtagtgcgtgctgctgcatcggaggttgagttcgtttcgcccccacctgggggagaagacgacctcaacgcggaccacgacgatgctccacttcgacacaggcgccttgatgatttgctggggccggctacaccgccgggtctcgcagtgcgggatgtccaggaggaactgatgatggtcagtagcgaggaacccacctcgtttgctcaagcagcaaaggaggaggcatggcggcgtgctatgctcgacgagatcgcctcgatcgaagagaaccgcacctggcggcttgtcgacttgccggctggacaccggcctattgggctcaagtgggttttcaagctcaagaaggatgcacagggagtcgtcgtcaagcacaaagcgcgcctggtggctaaaaggtatgtgcaatgtgccagagtggacttcgatgaggttttcactcctgtggctcagctcgactctgttcgcttgcttcttgcccttgccgcacaggagggatggatggcgcaccacatggatgtaaaatcggcttttctaaatggggagctcacagaggaagtgtatgttgtccagccgccgggatttgaagtggaaggagcagaggacaaggtgtataggcttgacaaagcgatgtatgggctgcgccaagcccctcgagcctggaacactaagcttgatgccactttgaagaaaatcggcttcgagcaaagcccgctggagcatggtttatatgcacgtggtactggccgcgggaggctgctggtgggtgtgtatgtggacgatttggtgatcgttggcggagatgaagacacgatcactgtgttcaagaggcagatgatggaggaattcaagatgagcgatcttggctctttaagtttttatttagggatccaagtgcatcaagaaggaggtgtcatcactctgaaccaggcagcctatgcggcgcagatcgtggaaaaggcaaggcttgaaggttgcaatccctgttctacgcccatggaaccccggcttaaactcagcaaggagagcatggcgtcgctggtcgacgccaccgagtacaaaagcctggtgggtagtctccgttacttggtgaattctagaccagatttggcgtttgctgtgggctatgtgagccgtttcatggagaagccgacggtcgagcacatggtggcagtgaagcgcattgtcaggtatgtggcaggaacaattcagtttggatgccgctacatgagaggaggagaagggaagctgcacggctacagcgacagtgacatggccagagatcttgatacccgtaagagcactacaggggtcttgttcttccttggcaacaatcctgttaggtggcaatctcagaagtagaaagttgtggcgctttcctcctgtgaagctgagtacatcgcggctgcatcggctgcgtgccagggcatatggcttgcccggctccttggcgatctcagaggtgctgcagctgaggttgtcgagttgagggtggacaatcagtccgcactcgccctgatgaagaaccccatttttcacgatagaagcaagcacatccaaaccaaatatcattttatccgtgaagctgtggagaacggggaaattaagccggcattcatcaacaccggagagcaactcgctgatttcttgactaaggcgctaccacgagaaaaattccaggaaatgcgaggaaaggttggtgttcttccaataaaacaggtacaacaatcttagagggagatttgttagaataaagtttgtgtaccttagttagcaggtttatttccttgttttttgagtcagtcttgcatgagcttgctgtcttttgtggaagtcatgcgttgtgagggatccgagagtatctcgcgttcccacgtcatacgccatgggcgtgacgcacgtctcgcagctgtggggatggacgcagcaaattgccggcgtgagaagcggtgttggttgttgttttttcagttgcaatttccgtttctatatatggagcaagatcagaaaagcagcagttggttacgctgcacaaaaatcctcttattcctctgttttgcgtctttgccggatcgctacagtgtgtgagtgtgaggtgttcgtccgggatcctcacgatccttgggttccctgacagtattaggatgctactgtgaattggcgtgcattataggctgtttcttgagtagatcacgtcttgtcactgtgaattatagcaagtaaaaaccaaggtcaactggacagcatcaattggcgtgcatggttgctgtcgtgcaatgtatagcagcagcatgtgtcatagtccgggcctggtataataatgttgcatgtcggcagcgatgctcttgaaattgatgctcttgcagaactctt

SEQ ID NO: 13406 - DNA, 35246 bp, Oryza sativa
gttcgcagtcgccatccggttgctcaccgtcgccgttcgtcgtcgtctcctcccgcgccggccgaaccccggtgagaactccctccccttctcttcctctcgcgcgcgccgctgctccccgcatgcgcgtcgccacgatgcgccgtcgcccgcgtcaccggccgccgccatcttctcgccggtcgccgccgccgctcgcctaaccggtcggccggcttgcagccgagctgagcccggccagtgccacctcttccccatgagccgccgcccggtgggccccgcctgccagtaccccctccctctctctctctccttgagtcactgacccgcgggtcccgcgtgtcggcgccgcaccccccttgctgacgtcagccctagggcaatattgcgcaataaatacattaaggcttttctttaatagtaaaaacacagagaatcttctaaaaatcataactaattcatccgagctccgattaagtccattcaagtctcagtaaattcataaaaatgcatagaatccattaaaattggttttgtttcctgtttcagtagtcttatagcctgttttgcttgtgtgctttgtttgtcgcgtagatttcggccgtttcgtcgatccacggtttctcgaagacgttgctgtggtctcatcagtgcgagagcaaggcaagtcatgcattataattgatcatattgtacccaatttacaaatgtcccgcttttctattaaatattgcatcgttttacaatatcacgtgggatgggtcctactactcagccatatattgtttaccttatgccattgctaactcgggtattaaaatgactagatgttggtttaggaaatgcttagccatgcttagttctattagtacacaaaaagggaatcacattaaagcatagactttgattattggcaatagctctggattagtgccaccgtaatggtgttggctaattaaaatacactacatggtgggctgtgggtgcatggttttgctagttgtgcccatggcgattaaggatcggttcgcgggaaaccctggaagaatttatcgtgcttaccacaagccagcgtgggcaacggctgggcttgtagtgtagcttttctctagccgacatacccaggcgagggtgggcgtgatggagttgggtcggccggggtgtccggttgatcggcttccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacggaaacgtgtcgtgaggctgtgtcttgtgggtacagttgtacacctctgatcagagtaaaactattcgaatagccgtgcccgcggttatgggcggtcgaccagattcaccgtgattagtctcacccctagttagcttttggaactggttagttcaggtggtggtttgggcctgtctcaacgtggtgtagcgttgagcagtgattggttaatattgattagttactgcaactgttttactgttttcaacaactgcttttaaatgctagctttatgcaaaaaaacctttagcctcccttggatataccctgcatcatacctcctcttccggtatgacttgctgagtacagtgggtagtactcagtcttgctctcttttcccccacaccagagttgaagtccttctcagttgaagatgtctcgaagaggttggtttcgtcactgccgtcaaggatgcctgtggaatggagtcgcccgctgcaggagtcaagtcttcaggcttagctcgcttttatctttttccgctgcatttgtaatcttttatatttttgtaagacgtggatctgtatgtcaacaattgtcgtttatgtaccctggctggtcctggacaggggtttaatacacattcagcttagtaattctggttcgtgaatttctgggcgtgacacgttcctcccgtggccaccggccttgagctcccgtccccgccgtcgttttgacgtcggtggtcctgtcgccctcgagctctcgtcagtggcggtttcggctcccttcggctctggcgacggtggcttcggccctagcgacggcagcgaattgacgttataggtgctatcctggttgctcaaaatctcggcagtagtggcccaggcagcagccgccttgttgagaagtctcagtggtggctgctgctggttcccgagctccatcccctactgctcccatccgactaggttgatttctttcatatgtagatgtgtatgatttcttcccttcttattgactgttgatattgagaagggaatgcaagatgtgcatgtatagagcaactatgtatgtagctagttgatttagtttccttttggtactattaaattagctcatgtactagataagtggtataataatattactgctatattttgttgttctgaggtcctgtaagtgctgaaatgatgcctaagattgcttgctatggccatgaattgttatgcagttaggtactctgccatattttgctactgtaatgcccaggattgcttgcaatggtgatgtactatgccagcgatgctcataacatacacagtacttgccttgttcttttagtttgtcacttgcattcgttttatggccatgatgcttatgatccacatagtggtgagtgcatggatggtccacgaagtgccttgtcaaaatttctataaattgctgaccattctataaattttctgtgcacttattactcagtctcatagaatatgatgcactcatggatatttcaatctttctcaacctctcaaatacaatcagtcactgagaactcaaattgcactcttaagggcataatggacatttctaggtaaattaaccactcaatgctatgagaactaacggtagggacatgggagggatcacaacgaaatctcgagggcacgcaggggattgatcaaaattgaaggatatggaaaggattgagtcagttttgaggtgcatacagggaatttactctagatggaatggcggcagcggcgttcaaccagaggtgggaaggaagctcacgatctcttcactttgccaatggatcagggattttctcgagtcattttgcagctggggttgagaagttgatggtgcagtaattcggcctgggttgccccttggtgtctggacactggagatgggaaagatgatgccaatctacctcgtgcacgattcttggtgctctgtcaggagttctctcaggcaatgacttccttggtctgaattgatcaagtctgatggtgctgtggcatggccagaggagcaatgtgcttgccagaatgcgagcatcacgtggcggcggcgatcctgatgctgcagagatggataagagggcggctggtcagtgcagttatgcagagtattgtgccatgttcccgcgaatagagatgggctgggatgctgctaggtggaccacaaaattggggaggatgaaggtacaaaaacttaggtacatatggatttgagttcatctcaggatttttttttcaacattttctcttctccgaatcgaattgaccaaacttattaatgtttttaaggcctgaccattttaatgcagcatttgcagggagcctagtttcctttgacaaggtgaagattcaaaattcgagttaagttgctcccaaaaattcagacaaaagagtgattcgtttgaatttattcaatggctaaactattgaattagaaccgatctatctatctatctatacctatgcctatggtaattgtgactttctacgaggcctcacattaactagaaaaatctaatcattgattagattaatgataaaaacacaaccacatattttacaattttaaagaaacttttgtcttattatgaaaatcttgtagattctcattcatgccatgctagaggatggcaaatgcttggtgttggaggaagttcttaggatggcaaatgtattataaaatacattttcaccaaatttcaagctcaaactcaactttatttaagagtaaaaaaaagacaaatttaggtgaatagtaacataacactattcacacgaaatttgtctttttttttctctttaccgaagttgagtttagagctgatatttagtgagaatgtatttcatatctatacctatctattgtaattgtttcatgaattttcaaaatttttaggtacgattttcttgagtttccaacactcaactcgttttcaccggatatgtcctcagggaggcggagaagggcgaagggagtagatggcaatggataaatgattgtgacaattatacagaggcctgaatgtactttcattatctaaaataaatagatgcctgcaaaaatggaagttatctaatggataacatctatggacaagaagctgttagatttagcctattgtagttggtaataatagacaaatggataactgaaagttaatggaatactgtgaattaattgtgtgccaattttagttcagtctctttgttccatataagcatagcaacagaagcatatttttttcattctcaatagaaacatggcttaattctctgcagcaattcacatattgtcgaaacaagatttcggcaatattaaaagggggtggctatcaagctggaaaagtagatgagtttggagacaaggaatttcatataggttcaggccttcttattcaagaagtaatacgctactcctgtccggggattgatccgccgagtctgttattgatcgtatgatctgggagaaaaatcatgtcccaaagggacccggacccctccttatataaaggaaggggtccgtattacaaaatacagtccatatccctaacggaatatgagattacagataaaatacaatcgtaaccgactatgatcctgggtattttctcgacatacaagtttagaaaccaacccgagtcctcatacagatattctatctaaatttggtaccctgtacccagctagattataactgccgtgtagatatggggtatccataatctccacagtagcccccgagacctttgcagtcgacgaaatagccttctcagaacaaaaaacaataatccgagtgcttcaattcctcctgctttagcctgtcgagtactaaaatcaaagactgtaaagggcgaaaataaaacatggcgcatcgagcaaatgtacctaattaggtgtagcccccgactatgtggttagttaaaaactaaacatatagtcaagaaccaaatggttttacaaccaaacatcatatagcaaagcacgcgtggtatccagtaagacacccagccgactacttcttagctttaatatatcaaggaaaaatatgaaaaggcccgagtgataaacactcaaaaggtccacaaatagacatatttggcaggaatccgagtaaaagctctgaagacaatccaccaaatatgataaaaatcatggtaatcaacgagtctaatagcctaggctataactcctacaattaccaaaataagcttataacatgataaagagaatgactactaataaaccagtcatctcaaattaacccaaacagcttttgcaacctaaaaaagcttacaaaaatagtataacacttttctgttgggtaccttttatctgcatcgtagtaattccaaagaattatctaaccgcattaaaaaggattttagcagcatcgggtcacatcattgtgagcacaaattgacaaagcaaaaagcgcctaagtccctagggatcacaacgggccacgctggtaataatattgggctaaagtaccgtacaggcccaggcctgttagcactcccgataccctaacaaaacactgaagtccaagtgacacttcatcttccccgctgagactctcgccatttccccactccttgctacagttctaaaccgcaccgacgaagctagggttcatcaatccgctccaatccatcctcaaaaattccacgaaatttctccgcgcgtccaacgcaccgatttcccatcaccttccaaccatatctcggactaaattaaaccatctagttcacattcatggcggaattgagagaaagcttcgagagtcagtgggcgccctccgatgtaatggaagaaaatctgaaaaaaatggtggcgcacggcgttcttccggcgaaggaaatcatcgggtggcgaccagcgttcggcgaagcgttcccgacccccgatacacacgagatcgtggtattttctcacttcttctatggcggattttctcttccaacctcaagattcttctgaggaattctgaacttctacgggattagcttgcatcatttgaatccaaactccatagttcacattgccaattttattcatgcttgcgaagcttttctgggcattaagcctcattttgccttgttccgccgcatctttttcctcaagccccaaccgaacaagaacaaaccatgtgtcgttgggggggctggtttccaactcaggggaaccttgagccaaaaatatttctccatgccctttaaaacctcaaacaaaggctggcatgcaaactggttttatgttcaaaatcctgagcccacactccccgagtactgctgcctccctccagtttatcaggacacatggaactcactgcctatggggaatgaagcttctcaggcagtagaactgatggaccgcatgataaagctgaaagaacaaggtctgcaaggagaacagatcacccgacatttcattaagagccggctggccccaatcaaagaaagatctcgcacgacctttgaattcgacggcaaacatgaccccaaccgtgaagatcctgaatctcttgatttcaaggtcatgaaggagagaatgtacaaaattttctcgaatgcaattgtagtcagctattcgcacttgctgctagtggtgccgtacaacgccttcaaccctcctccaccggtaagtatcgatcatctcaacctttctataaagcatgcctttatcttctaccaaactgacggaaaacttgaaatataggaatttgctttgatgaaatctgagcccccaattgctcaacaccgctcacctcatgggaaaactagccaagttagtggagggccgaaaatttggtctgttgatcaatcggacatttcaaaacctaccagccagtcggacttccgcaagaggaaactagccttgagtgatgatgaaggcgatgacgctaaaaaaactggtggcgaggaaacagctggaaaacaaccacggcaggctaatccaaagaaaaaaacatccagtcgtcccatgccgaaaatcagaaagtcttccaggtacaaatcatttgacagtcttccttgtattgaagctcattcattaaaatcatactgacaatataattcaaacttgtaggaaaccatccgacatagatccttctaaaaaagaccccaagccgactggcatggagagaagttcttcaaaagagaccaggtcgactgcaggggatcgcccgagtgacgaacagccggtgaccgacaatgtagatcccagcaacgagcccccgattgggagccagtgggccgaagctgggatcggtgctaatcaggagcccccgactggaaaccagtcggatatggagcaaaacaaggacatccctgaagtagaagctcgagctgacaaccctcctaaaaaagatgccaacgtcgacccagggtccagctctcctgctaaagtacaagggcctgctcgtccccgaccggaaataatcataggtaaatacatccttcgaactcaatctgatcaacaaacttttcttcaattgcttcatctttatttataaatgcctaaggcccaatggtcggcgatgaagaagaaatcctgaggatccagtcagccgaggattcacacccacccactttaatcaagtggtgggacgatgataagcaacctcagggaatcataataaacaggcaaaaagaagatgaggaagtgtgcttgctgaaaaaggcactcagccaagccactcgcattgtaaacgtaagtttccctatgctcagctccaactatcctgttttccattttacttaaatgccaataaatttgtattgcagagaatccatctcaggaacgaggcgaagaccgtaactcttgaaaagttagttcctcatctcggaactctcgaggcgaccagaaaccagctgcacgaagttaaggagctcgccaggaaaactgagcatgatctaagagattgagttgctgagctccaagagtccaacttcgaactaatcggttcatcaaaaggtaaacacaatctctgcctggcctacttgtgctaccatccttgtcatatcgattaatcaaaaaacaatacagtaaaagctgccaggatttctgaattagagaagcgggtccagactctggagaaggacaaagccgaattggcaaagcagagagactcggctctgaaagatgttgaaggtactgatgactaatacctcctatcttcgtgaccacttgttgatgtgaatatatctgtgcagaccgcaaagtcaagtcctaagtccaatttgacgtcctggttaacaaaatcaagaggcttgagggagttagagatgaggttgccaacaccgctgcaccactcgtccaagccatgttctataataacaatggtccgagttcattcgatgctactgaaattttcgacaagctgagaattgctccaaatacttattttaagaatatcaaagaggctggaagtatgggagcaagcctagcgttggcgatgaccaagtccttgtacccgaagattgatattgacgccgttgacggctttgcggacaggacaagcgaagaagctgctctcgacctcatcaatgacgcgcagaaagccgccgacaagatagctggtgacatagttaggagattccaggacaacgacctccggccggctggatctaacaattctgatgatgaaaaaactgatactgattgatgttgtattgtaatagtgattctgataaaaatgatgatgatggaggtacaatttgtacaatactgatgaatttatgctgtgcatgatatttcaaacttagctcctgatttcttaaaagtttttgtcaaactttgttgagcctaaaacccgcaaaagttgttaaaaaactttcagtcctcattgactaaaccaaaaaatcaaacagaacaatgataaatcaagtaagcaaattgaattgataaaaatcacactccattattatagtagtcaagaaaaggcttggtgttagcagtcaaagaggaaaatacagaagtaatgcctatgcataaaaacgacgaagatgttcaatattccaagagttgtcgatatgggtaccatcctcacgtttgagtcgataagaacctggccgagtgacttcagatatgataaacggtccttctcacaaaggagataacttgtgccgatcccgtgtagtctgaatttttctcagaaccagatcgccgactaaaaaagctcgtgagcgaacattgcgattgtgataacggcgcaacccttgcaaataccgagccgactgaattaaagctgcttcacggcctttgtcacaccccaaaaattcaaaatatatataaattgttgtttaaatggaatttttagaaataatttttttaaaagcctagaagagaagatctgtttttaataaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaagtcctcttttggctttgggccgaaagccggcccaaaaccctctctctctctttccctcggcccagttcggcccagtccgcagccgcccgcgcgcgcgcgcgttcggtcgctgacaggtgggtcccacctgtcaggcccgtcgtcttcctcgggctgaaaccctagtttcgcgccgccgccgccgctttccaatccggccgcccccttccgtttccggccgaattgatagaggggaaacaatctccgggatctcctctaccttttctcctttggaatcatcggctaaatcggtttggaaatcgagggattcgagttcgtctcggattcgtttttcccgaaccttccttcctcgtcgccggccgccgtgggccttcgccttcgcctccgagcccctttaaaagcctccccggtgtctcctctacccgccgccaccctcgccttcgcctctcgtcgtcggaatcgctttagcgccgtgagccctagcttcgccgtcgccgccgccgctccagccgtgctccgccgtcgctccagccgtcgccgtcgctcgggaaggacgtcatcgtggtcgccgttgcgtcgccgtcctcgtctgcctcttcgccgtcgccggagatcatcggagcaacatcgccgtcgtcgacccgaagagcttcgccgtttcctcctcgtcgccgtcgccgtccgttgatcttccgccgccgttttggtcaccggtgagttcgccgcgtcgtcctctacgtgctggtgccctccgtttgtgccgtagtgccgccgttcgccggcgagcgtgcgccgcccgagccgtttgccccgccgagccgccgccgccgtcggtgacgtcattgccgacgtcatcggggtcgtccgccgtgagccgccgtggacccgatcgatctcggccgtccgatttggattggttcgatctcggccgtctgttcgcgtgaaccgccgcccgtgcgcccggtccaccgaaaccctagcccgctgacgcaataaatccccttttccttttcaaaaataattcaatattacgtcataattcaatttaaaccgatttaagtgttttaatctgatttaatctttaaaaattcataactaattcatcttagctccgttttagttggttcaagtctctaattttttctaaaattgagatctacatgttaaaaatatccacatgtactgttcatgcttgtttatgtgctgttttggtgattttgttcttttctgcttagattccgtcgtttccggagagtccgttttcgccgaagaagagtttgaagagttccaaggccagcaaggcaagtcacacagatcccaaacaaccctttgagcatgttgatcctatttaaagctattatttcttttcaactattgcatttattttcgaatgtcattgggtggaattaacctattgtttgttatagcccttttgttcttgtttaccttattccttgataccttgggttattataacttgactagttgagctttatatattggttcaactagatattagaaataattgcttagccctgcttagaaacattagcacacttatgggataactaatgactcactgttatttaatgatggcttaatgatagttcacgatggttaatcgtgaatagttaattaattaatgtgccaactaaaacctggtaatggtgggttgtgagcacatggttttgctggtcgtgctcatgacaattaaggaccggttcacgagtttcggttgtgaaacattaatcgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttgtataaggggtattgtcacaactcctttccgaggtaccgtggtggtattgaggcacatggtgacatgatgtggagttgtgtcttgtgggtacagtggtacacctctgatcagagtaaaactattcgaatagccgtgcccgcggttatgggcaggtctaacaatgtctttcgtgattagtctcacccttctcatcataataaaagatgctttaactggtaataatttgattagctcctggtttggaatggtacatttttggtttggagatagaactgtgcagccgggatggttgttcagaatggttgggcctatgcaacagggtatgttgtatagcgttggattaatattatttaattacttaactgttttattaaattctcaaatgtttgctaaatgctgcttctgcaaatgaaaccctattatgccatcctttgttatcctgtgcacttgcatatttgctgcgtggcttgctaagtatgtcatatactcaccttgcaatcattcatcagaggaagagttctacaatgaggctgatggcgtggaggattaggtgtagccttggtcaagctgcctgtggagtggagccgtctgcgccgtttattttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacagccttcttccagtcggttcatatcatctactcggtcctcttcatagcgctcctcgttgaagttccgaaatcgtagcgattcaaattccacttcactcggcaacattgcttctgctccataaactaggaaaaaaggcgactggccagtagctcaactaggggtggtgcgcaaggaccgaagtacggacagcagctgttctacccacttgctggcgtaaggacgcagccggtcgaaaactcgcggttttattccttgaagtaccatgccattagcacattcaacctatccattgctcatgggatgcgctacagaggcataacaaactttgatgccgaagtcctcacaaaaatctttgaatactccgcccgtaaattgggtgccgttctcagtgatgatccgattgggtaccccgaaccggtgtacaatgttaatgaagaaatctctagctttgtctgccgtaattttaatgaccggtttagcttcgatccacttggaaaatttgtcgacagccacaaagagatgagtataaccgccgactgcctttttgaacgggccaaccatatcaagcccccaaactgcaaacagccaagacaatgggatggtttgcaactcctaggctggtaaatgagtttgtcaggcgaaaaattgacaaccctcgcatgttcgcacaattttgtcggcgtcggatacagctgtagaccagaaaaaaccctgccgataagccttgccaacgatggttcgcgcggcagcgtgattgccacaaatgcctgaatgtatatcctttaacaattgtcttccttcttccaaagacacgcagcgttgcaggattcctgatggacttttcttgtataactcggtttcatgtatgacataaagtctgctgcaccaggagatccgctcggcttcgtctttatccgaagggagttcttgcatggtcaaaaatcttatgaggggctctctccagtcggcttcaatcatgcttacatcttgggtgtccgtagcctcgattatttctttccttcgtacagtcggctcataaagatgttcgacgaatacgtcagaaggagctgcttctcggtttgaaccgaaattagccaatctgtcagctgcttcgttgttgtgttgaagaacatgggtgagctcaagtccatcgaatttgtcttccaacttgcgtacttcctgccgataagcagccatattatcatcaaggcagggccattccttcatgacttgattgacaaccaactgagagtctccacgtacgatcaaacgccgaatgcccaaagagatcgcaatacttaatccatgaagaagcacctcatactctgccacgttatgggatgcagaaaaatgtatccacaatacatagctgaatctttctccaatcggggagattaagacgacccccgctccactgcctgaaagcctcttcaacccgtcaaaatgcatagtccaatactccaccttctcctcgggtatgtcttcttggcactcggtccactcggcgacaaagtcggctaaagcttgggatttgatcgaagttcgtggcttgaaggatatatccagggacatcaattctaaggcccactttgcaattcgtccatttgcttcgcgattatgaagtatatccccaagtgggaatgatgtgaccaccgtgaccgagtgaccttggaagtagtgagataatttcctaacggtaattaaggcaccatataatagcttttgaacttgaggatatcttgcattggagtcggccaaaacctcactaacgaagtagattggtcgttggactttttgaacatggccttcttcttcacgctctacaaccaggactgtgctcacaacttgggaagtcgccgacacgtataacaacagcggctcttgcggatgtggtgaggccaaaactggtggagtagtgagaagtttcttgaaatcttcaaaggctttttttgcttcgggtccccactggaaattgtcggcttttttcaacagcttaaaaaagggcatcccccgctctccgagtcgtgaaacgaaccggctgagcgccgccatgcaaccagtcagcttttggacatctttctgggagctcggcggtttcatgttgagaatgtcgttgattttctctgggttggcctgtatgcctctatgagacaccatgaatccaagcagcttccctgacggtactccgaagatgcacttttcagggtttagtttcatcttgaaagcgcggatgctagcaaaggtttcttctaaatccgcaatcagatcatccttctgcttggtcttgacgactacatcatcaacgtaagcttcaacattgaggccgatctgagttgaaaaacatctctgaatcatgcgttgataggtggctcccgcgtttttcaatccaaagggcatggtgatgtagcagtaggccccaaaaggcgtaataaatggggtcttcaagcaattggattcttttagtcgaaaaaactgagtagcaatccaaaaaactgagtagctcgcagccggccgttgagtcaactacctggtcaatgcgaggtaacccaaaaggatctttgggacaagacttgttgaggtcggtataatcgacacacatgcgccattgccccgtctttttccgaaccaggactaggttagccagccagtcgggatgaaggacttctttaatgaagcccgctgctaacagcttggtcaattcctccttgatcgcatccttcctatcctgtgcaaaacggcggagtcgttgcttgatgggtttaacgtcttccttaacgtgtaaagagtgctcattcacctctctaggaataccaggcatatcagatggtttccacgcaaagatacctttattattttgaagaaaggtgatgagcgcgctttcctatttacaatctaactcagcgcctattacagcagtcttagttggatcagagggatctaaaggaatctttttggtcttggcatcgctttctccgctcttgggcatcttggttgcgggcacttctccttcgcctgctgtggacgcggccagtcggatttcttctcgggagagcgcgatctcatgggtctgggatatgacacgtgacggcttgtttgatgtcactccgaagggatatgactcctcgaggacccggcatcttcatcatcatgtaggtatagtgcggaacggccatgaacttggctagcgctggtcgaccaagtatggcatgatacgccgtctcgaaatcagcaacctcaaaacaaatgttttccgtgcggtagttctcccgagtgccaaaagtaaccggaagagtgatctggccgagtagtgtagcagatagttcttcacgagggatctgcatgtcgtccaaggtcttggcaaaaaggatgttgactgcgctgccaccatcgatgagggatctgcggagcttgacgttgcgaatcactgggtctagtaccagggggttccgccccgggtggaccactcggtcgggatgatccgagcggtcaaacttgattgtcgtttctgaccaccgaagatattggggcgtgttgggctggacagcattgatctctcgttcagtcaacttttgttttctcttggattcatatgccaggggtccgccaaagatgtggttgagttccttgcaatagtcctgaaaaccagtcgaggcatcatcttcgtcatccttcttctttgacgtactttgatctccgtcaatacttttgtgtgtattctcggcatactgctctgcaaattgtttgtagacgaagcaatctttggctacgtgattagaatttggatggtgcggacattgggagttcatgatcttatcgaaggtgttgatgcgcgaacgttgtcgggaggatggtgcagtagttgccacgagttcctcgggcttacgcttgcggtccttgtgactggtacttccactccctccagtagtcggcgtatctttcttcggcttccaggtggtgcccgactgcttggacgcagaaatagcatcttcggctttggcatactcaatagctttttcaaacatctgcttgactgtcctcggaggcttatgcccgaacttgccgactaggtcttcgtggcgaatgcccttggtgaaggcggcgatgatgacgtcatcggtgatgtcggagatcttattgcgctgttcagagaaacgtcggatgtaatctcacagggattctctagacttctggacaacgttgtagagatcaaactgggtactagggcattcgaaggtgccctggaaattggcgatgaagtgttcgcgaagttccgcccaagatccaattgtgccacgcggtaacccgtggagccaggaccgggcggaatctgctagggccacaggcagataattcgccatggctttgctatctcctcctgctgcacggattgcgagcccgtagacggtgagccaagactccaggttagtggtgccgtcatacttctcgattccagtcggtttgaagccggctggccaatccactcaacgcaggtcggctgtgaaggcagcaactccatccgcatcatcgtcgtagcggtctggtgaacggtagggagcatagcctcttgccgcacggcgctggttgatagttttgcgaagatcgatggggtgcctgtgaggtcgttcgactcggcgctacctgtgtcgttcgggaggtgagtggacggatcgctcatcgtgacccctgtccctacgactggatcctgcaccggcgatgctgaggcttggttggtgataatcttgagatcgaagagcgggaactcagctaccagtcggcgtgcgagtgcttgtggagttagccgggactgaggcggcgatcatggtcttcgtctgattcaagatgttgacgacgtgatcagcctgattgagcgcatcttcctagaggagggtgtcgaggagggtgattgctacaaccgcgttttgctggggcgtgcggaaaaccgctgtcccatcgacgtcttgctgtccgatgagatcacgtgctcgtcgcccagattccaaggcgcgctgtcgtcgatcctcagcctcctttgcagcccgttcacgatcttgttgttcacgctgtagtcattcttgctcttgtcgttgttgttcttcctccagtcggcgacgttcagcttcttgtcgggtgcgctcttcttctgcttctcgggctcggcgctattctgccgtctcattgtcagccatgaatacgccaaagaaaaggggtgtgtagtcgtcctcgtagctgtcgtcaaagtcgtcgaagtcaccgtagtcgtagtgatagccaaagtcgtcgtactcgaggatctccgttggtcgggaactgacaccgggggagctgaggtagccatccaattcttccgtcaagactgtcccgaggggttggagtatgacgccgacctccctagagctagattggatctgtgccgaagccggaccccgtctaggtcttcgggttggagacgccttggtcgtgaagacagcagctagatcatcggggagtctcatcaggattgggggataggacccatcatcttgatctggtcgtgttgaagtagattggatctcgtccgagtggtttggagccaacttgggagagatgatcttggggtagacctcggctgagttcgggataccgaacggagcggagatccgacctcttcccgactggtttgaatccgagtcgaggagagaaatcttgccaaagtcgttggtgatgaagtcgaggctgccgaatcggaacacctgcccgggagggaagacgaagtcgtcgatgccggagacagaacccatcgtactagtcggcgaagaacttgacgctacccctacctggtgcaccaactgtcgaaacaagatttcggcaatactaaaagggggtggctatcaagctggaatagtagatgagtttggagacaaggaattttatataggttcaggccttcttattcaagaagtaataccctactcctgtccggggattgatccgctgagtctgttattgaacgtatgatctgggagaaaaatcatgtcccaaagggacccggacccctccttatataaaggaaggggtccgtattacaaaatacagtccatatccctaacggaatatgagattacagataaaatacaatcgtaaccgactaggatcctgggtatttcctcgacatacaagtttagaaaccaacccgagtcctcatacagatattctatctaaatttggtaccctgtacccagctagattatacctgccgtgtagatatggggtatccataatctccacacatatatatctcctcacatggcgctacttcacaaggctgataggattctgtgttctttgcagccgttgtagtcatagcgatggtcatgtcatcttctcgtgcatatgatagtatgatattgtatgcccacctttatttctattttacaatatttactttttacgaaatttaaaataccatatcagttttattgtgttaaacttgttcaagactgttttgtttttgcgcgaagaaaatgccacatatatagtataacaaaccgcagctctaaggcggcaaaaggccaaaagctaaccacattttggttatgctattccctcgcaacaacctcgtttattagctaggctctattgatgtttaaggctctgttcaaatagaaggattgcctgatcttatcaaataggcatgcaaaacaagatgagtgattagtgtattggtaattaagtatactactataaacttggagaacgggtttatttgattttttttagagaaacttcaatactgtaaatgctggtaaaaagacacaccgtttagcatgtagtttcaaggaaatgtgcccactgtaaacgaagaagttgctctccctaaaggcagaaccgatcgtaacctcaatcttacacaaagtttgatggaggcggatttgagaggcaaatgaaaagtaatatgaaggcagtatatatatgcagctggtcttatacaaattactcgcacaatttcatatttaatttctctcgtatttatacaagcatataaacattttgtttcatttggatatgcgtacaaatacagactagatctgaccttacactgcattctggaatcatgcgtgcagcaaattgctatccgttgaaaccatgcacgctttcgaaatgcgaagagttctgcaagagcatcaatttcaagagcatcgctgccgacatgcaacattactataccaggcccggactatgacacatgctgctgctatacattgcacgacagcaaccatgcacgccaattgatgctgtccagttgaccttggtttttacttgctataattcacagtgacaagacgtgatctactcaagaaacagcctataatgcacgccaattcacagtagcatcctaatactgtcagggaacccaaggatcgtgaggatcccggacgaacacctcacactcacacactgtagcgatccggcaaagacgcaaaacagaggaataagaggatttttgtgcagcgtaaccaactgctgcttttctgatcttgctccatatatagaaacggaaattgcaactgaaaaaacaacaaccaacaccgcttctcacgccggcaatttgctgcgtccatccccgtccttgcctccgtgcagctgctgccggcttccctcgtcgcctcctcgccggccccggtcgtcatcgtcgtcgtcctctcgtcgttcccggtcgtcgtggcgctcgtccctccgttgagccgttctcgtccatcgtccgcgtccgtcaagcgagccgcggcagccccgtcatcatcttcgtcctcggctccgcgtcgtcaagcgttgcgccggccgcgtctcgccttcgtccaaggatcgccgccgaagtcgtctcctcgccgttcgtccgtcgttctcggccgcctctgccgcgcccgttcgtcattgtcgttcccacgcctcgtcgcgtggtggtaaggatccgtcctctcgctgccccatcctcgtcctttcggtgtcgccccgtacccgttgtgcggttgtcgaccccggtacccgtgtaccggtgtcggtagtcgttcgcttgtgcgtgtggtgaccatgttagtgtgcccgctcggtagccacgtggtttccacgtgtgcagcccgtgtggtgtctagtggagtccgtttgtcggccactcgcctcggttgacacacgggatctgtttctgtcgacccgtggaccgtctctgtgtacccggtccaccgtggtcccttaggttgacatgtggagttcgcatgtcaacagtgcagccttcctgtcttttccaggctagcgcttacacatgttttatagttgcaaagcttaattataataatccgcaaatcttcatataacagcattaaacttcggatgatcatatcttgatcatacgaaccccgaatcgacccgttcaagtctcctaatgtttgttaaaacctaaagaaccgtgtgctttctttttatgtattgttattgcttctttataggcttgtagctttgcttgtgtgcttcgcgtagcttctgtcgttccggaggttcccaaagcgtggttcgcggtcgtcgccgaaggttcggaaggccgttctctctgagcaaggcaagtcacatcatctttgaacatattggatcccagtttgtgaaattattttgatttaaattaatgcattatcgctttatttaaattcccgcattatcactgttttatttagccatgcctatttacctttgttatgaccttattattattgctattgttattattaccttgttcaccctagaataaacaaaaccccaactagtgggtactctatttatggttccactagtatgaatttaggtagatgcttcgctgattaattatgcaacattaggtggttttataactttagactttgggaattctcatatcattaggacagtatggaatggctggcttatgttggaattggacacacacctccccctcttttcaaaacccctaaaacggttttaggctgggcacaaggtgcgtggttgggttttgttagtcgtacctcgggtactataaggattaagctcgggcctctcttgcaaagcactaccgtacttccacatgtctagtgggtaaggcttagtttgtggctcagtctggttataaacaaaggtacacggatggagatggacgaagtcaggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggacggtactcttgtatatggctaggatgggttggaaactatgtcatgtcttccgtccgtatgccgtggtggtatgtggcacgtggttacacgtgaggaagacgtgtcttgtgggtaaagatgtacacctctgatcagagtataatctattcgaatagccgcgccctcggttatgggcaagcctagcaatgtacccaagttagtgttttaaattcttaaaacctgcttaacaactaaaatgtggaatggttggcctgggttggcttgggactagctgggacccagggtcgggttgccagttcggtctgaatcatcgtaggccttgggttaaggcaggttcgtgtgggttcacggccttgattaataatactgtatagcactaggatcatctttataaaatggctttgggcaactaagtgacttttaaatgctgtttactgcaaaacttaacccctatattattatccccttgtactcccttgcattaattatgcatctccggtgtgacttgctgagtactgtggttgtactcattcttgctcaatctttcccccttcagtaagagaagctttggagaagatgtcttaggtggagtcctggcttataccccagttgagcgcttgtgaagatggagccgtaggcccgctagtccgctgctgtttatttttgtttgtcaagcctgaagtgcctctgtaataatgtaaatattatcgatataataaagatgtgcgttttgtatcatgtttatttggtgtaccccggcttttccttggacagggattaatacactagcgtttgggaaaaggcaattttctcggtcgcgaaattagggcacattattgtgattgaaggagtggcaactgatccagccaaaattcaggcagtccagcaatggtcaccaccaaagactcagaggcaactacgaggatttctgggacttgctgggtactacagaaagttcatacaacactatggcatattggcaaaacctcgtactgaattattgaagaaagatgtgccatacaagtggactaaagttgaacaacaggcttttgacatgatcaaacagaaattggttcaagctccagttctggcattaccagacttttctaaagaatttgtggttgagacagatgctagtggtgtaggcattggggcagtcctgatgcaaggtgggcatccactagctttcattagtaaggctctcagtcccagatctcaagctatgtcaacttatgaaaaagaatgtatggttgttttgttggcagtagataagtggaggcagtatttgcaacatgcgccctttgtcattcacactgatcacaagagtttgatccatctgaatgagcaacggctgacaccaagtattcaacacaaagcttttatcaaattgatgggtttacaatacaagatcagatacaagaaaggggaagacgatagggttgctgatgatctgtcttggaaagatgagcagcaagaaatctatgcaatttcaacaagtcagcctaaatggttggagatggttgtggaaagttatcacaaagatccagccactatgcagctgatgcagaaactagctcttcagcctgagggcatggatgattttgctttggtggatggggtgattaggtttaagggaaaattttggctaggcaactatcatgaggccaaacaggcagtattgttatcattgcacagtagtgggattggaggtcactctggcatacaggctacctacaaaaggatcaagcacctgttcatgtggccaaaaatgaagaaatatgtcattgagtatgtgcaaacctgatcaatctgccagcaggctaaaactgaacattgcaagacaccaggtacacttcaaccactacctgttcccttgcaggcttgccacacagttagcatggactttgtggaaggcttgcccaaatctggaggatatgatactatacttgttgtggtagataaattcaccaagtttgccaagtttatccctttgactcacccatttacagctctcacagtagcaaaagctttcattcaccatatttacgatgtgtttggaatgcctcaagttataatttcagatagagatagagtgttcaccggtgcactttggcaggagctattttggttggccgatgtgaagctgaacatgagttcatcctatcacccccaaacagatgggcaaacagagagacttaaccagtgtttggagtcatatctgaggtgtacaattcatgcttgtcccacaaaatgggcagactggttagtccaggctcagcattggtataatacatcttccacagtgctttgggcaaatctccatatgaagtaatgtttgccaagcaaccaaatcagtttggtctagtgaatcttggagaaagcacagtacctggtatccaagtttggcttcaaaacagagtccatctcaatgacatcctccaacagcaacttctaagagcacagcaacgaatgaaagcacaagcagataaacatcgctcagagcgtcagtttgaagttggtgatatggtctttttgaaacttcagccctatgttcagatgtcagtagctcgacactcttgtcagaaactctgttttcgatattttggaccatacaaggtgctggctcgagttggtgcagtggcatatagattggaattacccacgggcagtgcagttcatcctgttgtgcatgtgtcgttgctgaagaaggtgctgaaacccaacatacctgtaagtaatgatttacccttaaattgctttgataatcctgatactgtccaacctgaagcagttctacggagacaattgattaaacgtggcaagttagctgttccatatggtttggtgcaattgtcggggcttcctgcttctctggcgacttgggaaaatcttcgtcaacttcaagcacgttttccgtcatcaccagcttggggacaagctgatacttaaggaggggagaaatgtcgtgatccttaagtctattagatacttcgtcggtgattctttgaattgggttgtattctgtgatgggccgtagatgggccggttgcgtgtatgtgtatcgatatgccgtgctggttcggcggtggcatcggacacatgtgcgttgtgcggccatttatatggcgagctgagctgtaaagcatttatcaaataagaaaaactcaaaccaacaacctctcatcgtatacctctgttctgctctactcctcctctcgttcctcaatcgcgaacctgattccccttcaatctccgagcgtttcgccggaatccgagagttcgtgacactgctgtagtgctgcaccaccctccccaatgaccgggtgaccggcttctcttctctatacacagcgcgcaatctgacctgtacatccatcctctcagtctcaatggggtaatccaggtgaggtggcgacgaggccccagctcttgcccctttgccgcccgctgccggatttgagcagattaggcacttacttcctttctcccgaatgatagattcagcacaagcgccaatctatcattcgccggccaatgctaatcgggttatcagatttattggaacttaattgtactactacctccgtttcaagttataaaactttcagattcattaacatatatatgaatgtgagcaatgctagaaagtcttataacctgaaacggaggaagtaatttataatgcatttgtagcacctattctcaagttaagcagatagggtgcactagtgccatagtagttccttcctgttcccacaatgccacagaacaattgatggtttatttggaaatcccatggcatttctaaacaactgatggttgcagaagtgagcactactttgtgctaatgggattaaaaacttattaatagttaataataggcttagtcagtatacaccctagttgacatctaaccactgctattctattccattttgaaaagacaacaaccgtggtgtctgctcccgtgactgccaggctgacttgtgggcccacattgtcggtgagagggggagcgtctccggccgcgcacgtgtggggcagagaggtggtgggatacacgcggtctgcaaggatggaggagggtgcgccggatctgcccctcccgtcgccgacgccggaggatcctcacggttgtatgctgtcgtcgtcgcccgagctcactgccgccctcgtcgacgagccgctgccgccgctctcgcctcgcccactgctcgagcctgtcgcaccgtcgcgaggagtggtagagggagaacgaggagacaggggaggagcaggagagcgatggtgagctcctggtcgccgagcgggcgccggatctgccccacccatggccatcactgatggatccatgcgcatggggggcggacaggcggcgggatccgtcgatgagaggggggacagagaagggcaggagcaccagccactcgaactgctcaaagacggcgcgcctgattggtcagagttgtgtctttgatattatttttctttattcttcctccgattatgtgaacttctcgtataaattatattttaccaagtacaagtaaaaatagattattcttaaataaatatgcatgcaagcattgctagttttctcttattttcggatatactgacggtcgaaattggtctgtaacgaccgtcaacaataagctaaggttataatccaccctagtattgttgtgctcaagccccaagaggccctttagttctaaagcagagaacataatccgcagtcagctagttctgccgtagatcgtcttggttttctatgtttattgactgtggcattctcttcttctggcacgattagctagattgtattactatcatgaggaatgtgatagtgccatctgagaatgagaaagcttgaacaaggttaagcgggttgtttaatcaataggacgccatgagcaaggcaagtcagtatatgcttccctccttgagcatgtgtatccctttttaataaatgtgttgattgcaaataaaattgcatgttacttacaaaatgtgtacccaaaacttgattataagccaccttgaaagtgttaaccaaactccttgttgcgttcgtcttatattatgcattggtcaattaatgatatggcttagcaatgatagtttagactttcgtatactccatgcttgaaatatggatgtgaacacaatgattactctcggatgggtgattatcggaaagtggattgcgtgggtgattatcagaaagcggatggagacatgggcaccaaccgatgtttcaaaacctttgggaaaccaaacacttaatcaaatgatttgttttctactagggtggcacagatggaatttggatggctctacgaaatggctagtcaccgaccttggtcagtcaaggactgacttctaagctatgcagtaaacaaatagagtacaattgtatttcttgaatgggtatagacccagtggattcagtaatccgagtggggcgacatcccatacatggttggttctgtactcaaattgttgtgacgttgcatccaagtgtcgtagtgatatcaatgtcaaacctaaaatgcaccatagttatatataaaactaggtgaaaccccgcacgttgttgcgggagcttggtatgataataataaattgaaataatgtgtaagatagctagacgacagaaacttgcataatttgatgtggtttatcataatttaaatagtatatagaatgatgatccaaatgtaaaattaacgtgatgtgactttatgagagaagaaaatgagggagatcattccaatgatagattaatcatttgagagctagaaacaattgagatgatatagcttaatgagataagagagaaataacattaactaattaagtgaggatgaattgtgtaggtatatagatattatacaaaatgatggagagatatattgaaatattttgataattacatggaatgatgatttaatatgcttggattttaaaagctctaaaatttaagtgaggatgaactatatatgcatataggatattataagaagtgatggaaagatatattgaaatattatgtgaattatgtaggatgataatttaattaacatgcttgtattttaaagctctaaaacttaataaattagcatgcttgcatgaggtttgagatgtaataattgttagtggatgtgatagctttgcatgttaagtttagtgggccttaactttatagaaagataggatgtaaccatctggatgcccgggtttgaggtctcctctcaccgctagctcgagttagggatgggcacttggagtgcatgagggttatagtgtcatgcgttgggtgcattactgactgtgagtaaatcatacatccactatgtgaataaaacaaatctatcgaattgcggtgctcgcgattaaagaatctccgagacttgtaatactcctgaccagccttagatattttaaacttgtttacattaggatttggaagctatgtggcctatccactctttgcatgcgggaaggttggcattggtgatgatatatggtaagttggatacgagggtaaaacgaacctagagaagcttgggaaggtgaatggagctctcgttgatggttaacaacttgaacttaacgttgttttcagttaaaacaactaagtcatagatttatgaattaatttgcgaaaattagctttatgcaaaaaaaaaaaaactaagccatccttgaatcccagtatacactgatacatcttgtagtgttgtcttgatgagtacgtttgtactcactgttgctcgtttacatttttagcattggagcaggttagaagcgaagaccttgctagcatgctcgcttgcttagtgggatgatcggagtggtagttgatactaagtcatgatcccaatcaacggtttgtgagcatgttgcctgggtctagcattaatctggatttccattgttgtttatgtgataggatgtggcattattagccttattaaaggtattaaactcttttagtttaattttattttgttatatgtttcttactggttacacttgtttttaccacctaataattgagggattgatatagggaaacttaataggtttccagtttcctaaactgggggataacaaggcctagcatgaaaaaatccgccaatgggcaccattaggccgcatttagatccttgtcctcttaccaccacttgaaactccttgtttgcctcacgctaccaccataggggtgtcgtaggctctccggaccttccattacaattgagacatgaagtgaataattcaagtcatcaaacaagtataatgaaatatcaaacgtctcgagagaggaatatcggagacattgctgggcctttagtctgccagctaacttcagtctgagatgtgcccgtcaaactactcgaaggcggcgacaagatgtgttacacattcaggagacttgacaaaaatggctaaagatctacaacatctcatatgtttttaactcatactcatgtgaatctagctcctaagatatgcactagattcacactttcatcttaaggatggttacacatagcaaacacaataagatgagagcaattaaaatttacaactaatttagagatacataggccgatcggccaaataaatattagataacagcggaagcttgactacccaatcacaagcacaccgactaggggtttaccccattaagttctcattctagaagaagcaatcagaacccacatcactcaaagactaagtctaaacctgcaaacaaaaggttatatcaacagcaagaacccacatcactcaaagactaagtctaaacctgcaaacaaaaggttatatcaacagcaagagtcagtacattaaacaagttaatgtactggcaagcacaagtcaatcataacatactacatgtaaatgtaaggcatatattcaaaggaaggcaatatgtagttcaatttcaccataaagcaagttttattttcgcaaatcctttgtaaaggagttgatgcttcaattaacaaagataagtttttaagtttgtaacatttagttcatcataattccatcatagtcaatctcttgatgtcatccttgacaacaagtcataatatatcatcacacttacacaactcaacacattttatcaatttcaaaccaagtcacatgttcacatttttaaaacatagtctatactcatgacacttcaccaaagcgctcatgaccatgagaacggctaatcgattagtttaaagaactcctgcagagtttgtacgggtttacccacataatgtgatagaagcccggaggctacactctagttggttcagtgccggccaagcaccccacactctacattatgagtgcggactagaggtcacaatgaagcctttacactacttagaatctagccttgcaccagcacgatatgtgttcatcctaggcatacttggaaatatgtctagaaccgttaagtggcgggcccacgccttaaacttaaggccgtggtggcggacacgacaggaacccaccacgtggcacaataccgttgtattggacagacttagtcacctaaactaccacatcggggtaaataggaagttcctctgaatcatcgactaattccttagaattatcgactaactaatacacaccggccaaacagaatgcaaggctagtcctaaatagattaattagcttaggccatcccatactagcacatgtggatgtacgaataactttaagttggtgacacaagttcggtccttacggacttgagcaaacactcccccctatcggtatgcaactaacaccatatgcacaccacttgccgcccaagtctaaaatcacattttacacattttagtccacaaatacccatcacattcattttattccagaaaaggttcatgtgtcaaaatcatattttaatcataggtggaatgagcatttgcatatttctaagcatggttaagcaagtagttgcatatagagcatatataaacccatttgagcacaaaagagtgtactctaaccatttctaggggttcaagcagcaaggatcacaattattcaaggtaaggaatgcaacaaataggtaataactaccttatcccaattttaaataccgatatagtctaagttcatatgcatctttgcaaacaaatattttcatttatcaaatcatgggattcaatgtgttcaaaggatgtgaggagaaaacttgccttaatactaagaaatgttagcgcctaatccactccttcaccgattatgcaatgacctaaataaaggacacgctatgcaattaaacaccgaaataggtaaaaatccaaaatgctctaaaatgcatgatttgtacacagtgtgttggtactggtttaaaatgaatttaggtgaaagaatttctattttatcactttttatttgggagttatgaattttagaaattatgtcggtatataatagtataggtttaggcaatgctaccaagtatttttgcaaagtggtatttattagattagacttctcaggggtgtagagatgtgttttataatactaacacatttggtttcacaatttttagagttattatgaattctttatgcattttacaggttataacatgttataggtgtatagtgtcctacatgcacatgcctttggtatttgaggttcagaatttattctacttttgttgcgatgaatgaagcaaataattttgttaattaatctatccttagttcacaagtttagggcctttattattttagttcatattttataatatagaggggttctatatggatgactttataaatatcaacctaggaattatcatttgagctaagttcctctaagttttggtgaatggggatggaactatggcctcactggtctatcaagttttatttaggtttatttagagctaagtgcatatatacttatacatatctatgtattaccttaacaacactatgtgtttaaattcttatttcactaagttaagattttgagctatgttctctacaaaaggtgtcaagttttattttactatattgaagctcactattttctggttctatagaaactttcttcattccaattggactaaaaatgaattttctacaaattttacaaattaaaggctgctctatgttggttattccttacataaatatttagaggcttttattataaaaaaatatatatttttattttaccaattggaaatacatgttttggtgatcctacagaacttaagtttactcaaattaaagctaagttgaattttgtatgaatttataaagtttagcttatctaaaactagtcattttaaagataatagttttagaggcatttgatacaaagcaagtgattacttttatttcagctaaccagagagtgcatgatgatgaatttgtagaatttgagtttgtcccaaaacaagttaaattaaattttctatgcattttataagtttgtgtatgtgttacgtatgctttaccttagacaaatttttgagacaaagtttgaacagtgagtgtcaagttttatatttctaaattaaatttcataactttgtgaatctatagcgactggaatcatctcaaaatgagttatatttgattttatatgaattttcaactttgagtgtttttctgttgaaaatataatgttttaagtgtttttcttttatattctcagattttagaagggatgggtccacctgttagtgagagatcaatatgcaaaaaggcctctagggttccagagattagatcgtgaggtccctagaacgtgttttaaccaaatttattaggaatcctcgagttttacagtttttactaatagattcttggtcccacatgtcaatctaacatattttacattttaaaccttacatgttttaaaatatctaaacgagatccctagcgcctaatgacgtggggcccattcgtcagcgagtcagcgcctgggagagacagggcagacagagcagcggcggcttggcgagctcctcgcctgcgccggcgatgaacggcggccgatctcgtgatgtgaccaaaagagaagattttcctaagcttcttgcgcatctatccgtggttgtctcaaggttagaggtggtcggaatcaatggtgacggcggtgcgagcggcggtggttctcggggtggtggtgcatgtgtgcatggaggtcgtttagaagcgaatgcaaagcatgcatgaggtcttcaagactacagggtgctcaccgtgggtcaagctagggttgtcgaggtcttggcagcagcgtcgacttgcggaacggctcggcgacggcgctcctcctcaggtgaacggcgatggctcgaacggtacgacgagctgctaaaagtaggcatgcacgagggctgtgaggtcatagagatggtgtctgcgcgaggaatcgaacaatggctcaccggagcggcaggaatcgaagatcgacgttggcggccggagttggggaagaaatcggtgatctcagtgtacaggctcctggggtcgagccgatgacgatggcgcagcggcttgctccgggatggactagggtggtcgggcgacgatgatgccgaagcggcggcgttccgaagctcccgtgggcacggtcgcgttccggcgtcaccactgcatgtcaagaggagagattaggtggaatggatatggcattgataggaggtttcagatcgggaaaggagtcgagacgaccgcggcacgatggcgatggcgacggtcgtcgtctccacggccgccggcgagaatgaggatgacagagaggcagagggcctttctccctcggcttcttcggctctagagtgttgaatggtgaagggcgactgagttggcggagttgaaggtgaaactcggcgtcggcacgtcagctccacgcgtcgagcactccctccgccaacgatctctctctctctctcgtctgttcaatcggctggagcggtggagaagtggtttgacagagctagagctagctctagtggctgtcaggtggggcaaggacgaagtatactagtaggtggaagggagaggtgtgggtaaatacatgggtaaacttgattttggatgaattttcggaattattttctcctctaactttgtagcttcatagcttaatgtgtggatcagattaagtagtgttgattttactggaagtagatgtttatacttagttgccattttttttggttgcacttaaaaattatggatagattgatcacagaaattaaacaaagatcggttatctaagagctagattgaattttgaggaggcttaaacagaggaataaaattctagaaaaattatattgagatatgataaataatatagtatttatataaattatttacctcatatacttttatgcattttaattcacttttgggtgaagtatggttttagccaataaaggattttaattagtctactatgtgactgttttgattaatttatttgaggtatcaacttgagtgttaatatctgaccaaaattacagtgaatagtttgtgctaatcattgtctacataaattttcccatgattttatcttgtacaaaatattttagagaattaggatgaccttttctttgtatatgagttccctcttcataattgcatctaatattattataggaattactttaaacttctttcgaactgagaagatgatatttgagtaaatattatgtccacatattatcacccaagattaactataagtttatttagtaatttaacccttttaagttatgctcatgggacctattgtaaaatgcgagaccaaaatccaaatgcacaagggactcgagtcaaggcatgcattatgcacatgtatgctcatttgcttggtggaatttatggtctaatgttaggaatgaaaaggttttattttgttgtcaaattttatttatgcaatggtttagattggtctcacctaagttaaaacggaaatttttggctctcaaaattgtaaaagtttgcctatatctattttgtctagaaatttttaagtcctaaaatttcgggtatgttacaaggggggagctcatcggcggttatgaatgaggctaaagtatgagacagagagagatagagagagagagagggggggaatgagaacggatttgaggatggtagacgaggtgagacggtaacatgtggttgtggtgattgctatggccaccttatcttttccagcacacaggtgacaccgccatcttcaatgttggccaagaggcagcgtccgcatcatcgtcatcaccatcgcaatcctcattgatcttcataggtgagttcgggggggggggggggggggagg

SEQ ID NO: 13407 - DNA, 7721 bp, Oryza sativa
tggtgggggaggggggcgcaatggcgtgaggtcgaagtcatcgtggtgcgacagatgcacgcatgctcactgctgccacggtttcgtcgttgacctctagcttcactaggcccccatgctatcctagagtgctaccgcctcgtcaaggtttgcctccacctagatttgactccgcaatttgcttctctcttatggcagcgccaactcacagaggctggagccgcaagggaagctcgtggaggacgcttgatggtaagcggttgaacttgtacgtgtaggacctgggggcatggttgtgcaactggcggtgaggtgggctcatggccaatggaggggaaggccacacaagaggaggcgagagaagagagagtatagaggaaaagagagtgtagagtttctggtatgacagtaaattgaacttttgtggtagttgagggggaaaaatattcaaacttaacccttttaacaatgagtagatttgcattggtcgttactgccagattttgttttaaagtagaagagataaagacgtacttatccttggatggtctgcgacttaattaggactctccaaacaagcaccaaaggggatattattcaaatgttgcatctgcacacatttatcgccttaccctagtggcctaatccacttctgctaccacaactatccattcatctaaaaaccaaattagaaaaaataaatacattctgacagaaaaggaatatatccaactaatgaatgacagttggaagataaataaaacgataattgagtagaaaattcttttagaaaacaattgagtagatagaatattaataactacccaatttggttcagccttctaactctatataaacacgcccacaaaggcatatgtttcaacccccacaccaaaacataataaggtttgctttggcctttgcatcattatatatatctcctcccatggcgcatctcaagaaggatgctagggttctcttacttacagccattgcagtcatggcgatgatcttctcaccttgtaacgcagaaggtacaataatctattctcttcagatttctatcttgcactaatttctaataatacacaaaactgtaaatactacaaacatcttatattcaaacacaatgatactcaatttaaaaataatggagtctttttatgcaccattaatttatttcttatatctatgtataaaacgtactccaacacttatttatcctatttacaggcataaaattttgtttcagcctatgcatgcatttatacgcaaatatataacatactgatttagtggcattactacacgtaactactcggtgtactgagcacctctaggtgttttaggtcacattaatcgtaataatatattacataaaaatttagaggatccctgtaagttttgttgtggattcgtcactgctgatgctattgatattacagttgcagacaagtgctacaccgtatatagatgcactcttccagcatgcaacgactactgcatcaagctgggtgtacataacccacaagtgacatgcaagctcagcttcccaccctccgactactatgacacgtgctgctgcggcacgtgggacgacaaaagcgtgggcgcacgccgtctgctgtcccgttgacattataaactagccgtgcccccccgcgcgatgcgcgggcatcatccaagatctttaatcataaaagaaaaaaaaagcatgattgaaaacaacatagcttgcaacagtgctatacaacaacaactcgatcagaaaaagaatatcacgatagaatatcacgatgttctaaattttgattgatgtaatcgtaccataatttttttataatcaatgttacactaacaatgggtatctcggtgcatagtacaattacaacaacgtgagtaaaataaacaacatttgtatttcaatacctagctgtacccaggaagaccaatggggcgatgattaattggaaggatagtcaatcaaaactgtgtcagcacatcacaggtagtaattgcaacttatattgtacatattttacaatctatactaagacggccatgaaaaaaaaacaaatagaaatcaaggtttacttctccatgatccagaacctatgaatttgtagccagttctgcagatatgagagttcaatattcttgccagcttgtcaataattagcatcaatctactttagccaccaataaaagaaaaagggaagtagatccaccttttaaccttgatgaagagcatcaatatgttcttagtacatgatatataaaataatgaacaccatgcatatcccacgtaactgttaaaaatatattttcaacggaatgaaacagtttctaattttgtaaatcatgttgagtaatatgtagcatcagtatatatataatagcttgaaattacctggctggtggtcgtagaagaatcaatgaaaacgtgtatcaaaccataaatccatgatttacaaaatatggaacaaaccattaaaatgctatcacaatatttggttatcctgttagttaaggtccaatgcttgcctcttattgtgctctttgcaatcccagagaacgaaaatggctagtgagaaactgccaaatatatatatatacatagacacatacaaaaatatatgctatagtttaactgaataacagtttatgcatactacttggtgcaataaaaaatagagtagggaatgatgtttaccagtacaattaaatgatgatcatgtatacggagataaagattagacaacaaataagaattcccaaggaactactaaaataactgaaataataccaggaaataacaggtagaggaacaccaaagagcaattgccatgcagctggaacctacaagccttgaacctgaagtatgaataaaaggagaagaattagcaaatgaagcctcccatgtgaagcaagagcatttttgtgagaaaaataaatgaaatgaaatatgcagtgtgttgttgtgtacgctagaaatgttgatatagcatgatgggcatatgaatctaggtatttaagaaaaaggaaaatcacactgcacatatttgctctagtaataaactgagctgctcatagaggcacggggccatatgtaccaaaacaaagttgcttatgtgaggcaaggacgtagaatatgcatgtaattaagcgtatggcaagattatatgaaaaatagtttgtaggcgatacaatacagcaggaagaaagtgaatttgacaaaccttagtggagataggactgaacatgtaaacacaaacagaatgggacctgtggaaaacatatatgaatatattgtctgcagcttatagctagcacactaacctgaagctggagagtccggcaaaggctcctttcgtttatgctgtgatgtagttgtcgatggcccagaagagcatgacatcgtgtgaaagctcaatgaagagtgacaaggccttgctgaaacaataataatccaatgcaatatagctttagtacacatatacacaggatacaatatatctaaaggaaagtatatacatatgcaatatttggctagaagcactaacagattgataaattaagcggcagtaaatatactctcatagccgacgaaatagagcataagacaataagacaatgataaaattgattgaatatttacgaataggctggccatggtagggagctattttagcagcaaaacatgaaagaagcaagtatggtgccaataccttgatgtccccccaatgtacagcagctgtaacctctgccattgctggcttttaagacctctggtctagcatgcagtaacccataatgcaaatagctgtaaagaaatgtatatataagtggtccaatggctaaaaattttaaataggtaatgtgattcattttctacagctaacaaccaaaaaaaaagtaatagagtataaactgatcgttctatgtgagattaagagtttgctgtagaacacttcatagacattcgcgtgatatagagtatgccttgggaatggagagcacaaattataggccgaccatgaacaaaggaacatgtattagatctcagatatgaactgagtgctacctgcaagcaaagctcctgaatgagactcacaaagcaacgccaggttcaagttgtttggggacacacattatgcaacattttcaataactccgggggtgaattgatgtcgcttttcgatatttctgcactgaaatcaggcaagacctgcaacaatgctttgccttcattgcttgcaaccaaagaagtggcaatagtcgaaatgatttttgaatcaagagctatattctttgttatcatttcacgaattaacttgagaacttgggtaaggggacagagaggcagatcgggatagtggtggtggcgccgtgcttcgtagccgccacagtcaccgagctccggcagcgacgggccaaaggaatgaatccgcaaaaggcggtgccggcggcgacggtcgggcgtcgcggagggagacggcgtggcggcgactgccgggcgccgcgtgaggaagacggcgcggcggcgacggccgggacccgcgggacgaagacggcgccgtccgggcgccgcgggacgaagacggcgccggccgggcgtcgcgggaggaaggcggcgctgcggcgtggcgggaggaagacagcgcggcggcggcggcgagaagaggaggatttggggatttttggcagggaggcagcgaggatgtctaggcggtggctggtgtggtgattgcgtggactaaatatagcgaggacggaggggatggagggatggagcgatgaccgtgtggacggctggatggaatcaccagctggacatctgacggcacatgcatggcgagggactgtagtactgtagcagcatttctctggcctgagatgaatcgcaacactgttggtagtgggtcacgaatgatatgattggttgcaatgatatatgttgatttgatatcgatcaagaggtgattataatttgtgataattcaaccattgtgattaataaattgtgatggaagcgcttgtgcttttcgtatgaaataaaacaagtcgcattgcatttttcttttaattccactaaaagttttcgatttttggtgttcctaccattcaccctccttcttgtaggcttagttattattgttcgatcctgcgtatctgtttatccataattaagttttacttcgtttggaaccttcgataaataaggtttttgtcatctactaaacttatgactctagtagtgtatacttggggtggtgtcagagtttggtttcgttggccctcacatatgcatgttgagactatgttctttttacatgtttagggcctccttagggtaataaactaacattctattttttgtgtttatatgtatatggatgtgtacaaagcacaagacatgtgaagcaaaagctctagtaaatatctaaccaactatcttgtcgggatccacttattggaaacttgtagcgagttgtcctgtggttgacgactcgacttctctgctctagttgtctggttttgtattgacatctgaataggctcaaccttctatcgtggtagcggtatagaaattggggaaaatgttatgatagaataagagcaatcatggtagggcttatgttggactaggtctcatatccttatcaaggacttattacttatttgttgtagacgtactctattcttgtttgagtattgtctctgcacataacaggtatgtggtattcctaccgaggtatgtccatgtctgtggggttatacattggtagtagttcctgaactgtattcaaataagaaccacttgttttcactttcactatctcaagaccaccatgagggttgtaggaggctcaccgagctttctatttgggctagcgaagtcagggcagctccagcagcaacaatggtgcgatggtcagaacaacatacccatgagatgggaggctacactatggctttctataggtgcaaggaagtccacataagatcaatacaacagatggaggagtaaattccctgtatgcacctcaaaactgactcaatcccttccatgccctccaattttgaccaatcccctgtgtgccctcgagattttgttgtgttccctcccatgtccctaccgttaggcatctgttagttctgttagtgcatacatccattacattgtgagaaaatcccctgtgtacccctaaaagttcacctaattccttctgtacccctgaatttttctcaatcccttacatactcctgaattttagtttggatcccttccatgccctttccgctagttgaccgttagttgaccgttaaattcttatgaaaaagtccattttgccctttggtataaagaagcatataaattaatagagtatattgttgaagtatagaaatttgttatatgagactattatgtttatgagatagttatgcaccatattatttgcgataaatgtacttttagatatgacataaaaaaattaatacttatttattagttattaaaagattttttttagcatatgtgttatgatagtaataaacaaatctgttgtattactatgaaaacacatatgctacataaaagaacttttaataactaataaataagtattaactttttatatcatatgtaaaagtaaatttgtcacaaataatatggtgcatcacatactcataaatataatagtctcatccaacaaatttttacattccaataatatgcttcattaatttattatgtttcttcatagcaaagggcaaaatggaccttttcaaaagaatttaacggtcaactagcggaaagggcatggaaggaatccaaactaaaattcaggggtatgtaagggattgagcaaaattcagggatatataagggattaggtgaactttcatgggtacataggggattttctcttacattgtcagtaatttcaaaaaagaccaaaatgcccagcaaaaccctaggtaacaaccagcaaggcagcaacagtgagaaatccccaaataatatccaatctcttgtctcccgtcgacgcaggcagcgctgtgcgccgccgccgtcctttcgcggccgtcgctgccgttctgtcacgccctgaagttcccctttccagctttaaaatttgtaaaataaatcgtctgaagaaattgttcaatttaacctagagctaattcctcaaattaataaatgcaaataataatcgaaatcgacatatggaatttttcttgggttctacatgtcaaaatatgctaacaggaattttagtggaattttcagagccttggaaataattttaaccaattaaaataagcaaagtgcaatattaaatccctgggaaaatcctttttcctttttatcttttcttttccctcctttttccttttcttgggccgccggcccatttcttcccgcgccggcccgctcctccctcccactcccaaagttcacccggcctccctctccctctcgggtgctgacaggtggggcccacctatcagccctttccctaacctctggctgcccacgcccgcaccaaccgccgccgaaaccaccgcccacgccgccacgtatcccgctgctcccgcgcccactccacgccccgcgcccacgtcgccgcgacgccgcccacgccctcgccttcccgcccgcgccgcgagcccaccaggggtggattcaaattttgaatcccctcccactctct

SEQ ID NO: 13408 - DNA, 2156 bp, Oryza sativa
  unsure (1)..(2156): unsure at all n locations
gacggtggcagcgcagcgagacgccgagccggcgaggacgaacgatgacgacgacgacgaacaccggtggagttcggtcgaaggggaggcgagtccgagggcgaccttgccgctgcgatgccggaggtggtggtggtgcacacgacggcgcacgggtggaggaagggccgaccggggaaattccggcgaggtggatggagaggccgacacagcacggcggtgttccggcgaaattaggggcgacgccgtggcctggccagggaagaggacggcgttccggtgccgggagaggtggtggcgacgtcggccgacgcgcaggagactcggcaaaggcggccggaggcggaacagtggcgacaacaccactgttgccagcgggggcgcacctccgggggtctccacgtgaaacggtgggcaggccgggggagaggaggctgctgcgacgccggggaaggcgacggcacggccagccggcgtgctgacgcgacggcaggggcggctggaggtcggccggcgccggagagagagaaggagaaggcggggagaggtggtgcgggcacgggaagacgtgggaggaggctaaaatgggagaacagaggatggggattccattttataggagaggagagggagccggccacgggagaggcggggaacggcggcggaatttgtgccggcagccatggaaggtggccggggttggcgcgtccgttcccggcggttgggggcacgaatcaagggggaaattgggagaaaatnnagaggaatcaatggggattaaaaccccccaattaatttcagaaaccatggtttgaatcgcgtggattttgaggagaattggcgctagggtttgcacgggagagaaaaaggaagaaggccgggcgggaggaggacgacgacccgggggtgggacccacgcggggcgcggtcagcgcgcgtgacgggcgcgtgcgcatgcgggaggagggcggctcgggcagggggcgcggcttgggccgggcggccggcccaggaggagaggagggagaggcggcccgggagagagagggaggaggagggagctgggccgaggggggaagggaagggcggcccaagagagagagggggaaggaaaaagagagggagaagatggagactttggccgcaggccaagggagagagagggaggactttgggccagacttggcccaaaggaggaaggaggatttatttttaggtttttctttttaataaactttgataattgttgttgttgcttaataaatatttccggtgctctgaaaattcaagtaaaatttgagggctcattttagaccaaggagaatttaacaaaaattcttcgggccacattcaaatttttcttgtacgtattttagtgtttgccaatttcttttcgaattttaattaattctattattccttttagaaaatgatttttattttgggatgaatttatcaggacgtgacacctaagtacttcaggtgtggttgagcaaaggagcacttactaattttaacaaagagttggtactgctggagccttgccaaaactgccttgagatgggacacatgttctgtcagattttgactatagatgagtatgtcattaacaaaaacaagaacaaacttcctgatcatgtcagcaaagattgtatccatcagcccttgaaaagtttgctggtgcatttgtaagaccaaatggcatcactttgaattcataaagaccctgatgtgtcgtaaaggttgttttgcattcatcctgctccagtagtcgaatttggtggtatccagatcttaaatccagcttagtaaaccattgcgatcctgccaattcatctagcaattcatccaccactggcatgggatacttgttcttggctgtaatgttgttgagggctctataatccacacaaaatctctaggtcccatcttttttcttcacaagcagaactggagaggcaaaggggcttacactgtgttgaattatgccttgttgcagcattgtcttgatttgtctttcaatctcatccttctgtgttggggcatacctataaggcttgatgttaactggttttgcatcaggtgtcaatggaatactgtggtcaaaatccctgtgggaggcaattctatgggttcctgaaaaacctgctgaaact

SEQ ID NO: 13409 - DNA, 17325 bp, Oryza sativa
tttcaccacacttgaaacactctcccctagctcttcttgcagctttcagagagtcaaacctctcttcccacttgggtttttcttccaacttcttaccctcttcaggaggtgcacccaaaatgcctttcccctgatatggagtcttgttgaaagtcttgtagctctcttaaatgtctgcttcgctggtgccttcttgttcatttcccccaaaagctcctcctgtgtttttgcaagagacaacgcagcatcaacagaacgaggcctgtgcagcttgattgctgccttaatttctgttttaagccctcccacaaattttgtaacaaagaaagtctcatcataccccttgttatacactagcaccttatgcataagctcttcaaacttgctgtaatactcttctacactacccatttggctatgaccatctagttcctcaaggtgttgctggtacctatccctccaaacttactatgcactgctacacacagttcataccagctttcaacactatgcatttcctcataagtctgcaaccacaaagcagcattccccgtgaagtgtaaggtggcaaaggctgaccaagtttcatagggcacatggtacatactaaagtatttctcgctattggttttccacaatttaggattattgttaacgaccaaatttggtaatatcagcatcggagatggagattagattgaagtggaatcgaagataagggttctcgcggaaacagagtaagaatcggctggagtccggattggctacgactgagatcggctaagtctgagtcagactgggttaagtgatacagccgattccgacaatatgactcgtatacgacatcgggtttgagttgatgtgcttcaagatgattgccgtacatggatagagtcctgagaaggcaattatatttattaattaggatattttatgtaaattccttagagataaatatgtgcaaaagtctgccgcaaagacttatggtatcttagagtttgttagagataatagttgtgtccgatatggacatatcttgtaattcttgggtataaatagaccccgaggcctatgtagtaatttacacacgcgttcaatacaatctcggtgcatcgccaccctttttacttttgttttgtttcgacgagttcttgctttcgggttgagctgcatcggtttcgatcttcaacaagaggtaaaacttgttatggcggcttgcgttctcgggattagtgcttccatctgtatgatactctaatcttgtctatgtaattcgtcgagttatcatatatcttatataacctctgacaatatcgtcatctaacctacaatcggctaacatctgttaatagaaggcagccgattaggttaaataacgatgttggcttagattatataggatatctaccactctatgacacatccagcgacttgattgtctagatattgttcttcttttcatacttaatgctgcatcagttgagtttgatctattaagtcgtgcttagaatttcaatctctagcctgccttctggttgccgattagggtagtatcggagtttcagccgatcttatctgatttaactacttttaccctatatgcttgactgatatgttaaatcagccctttatattaaatatcttgttgcatctaaatatattaggcttctgttttagtatattctacttgctttaatatcttaatatagagtggtatcggagtattagccgatacatgctagatctatctgatcggctatgctatgaatatatatataatctcattattaatatatatttcgatctaagtgatttatactgtctcggcaaggtgaccgatctatcccaatcatttgatttaagtatatatcgatataaggattatataccattaatatctacagccgatcgagtagatttagttctgatttgtttattaatacttgctgatcgatgtacatatgacatcggcctaaagataaatgatatgtcatcggctcctagctaatcggctatcgtttttggatttaaccacagtttctttgtctttgtttcttgttgattacaagatcaaatcaactggcacgctcatacatccgaaggtgagttttggacctgcactggagttaagcagatctcccaagcctcgtgttttctgtcaacaattatcaccatcaaattttgggaaatcagttttaggcaacctagaatttccaactcgtccaccactctgagatcccggagccccacgctcagaactctccccaatttcaaaattaactggcgaattgcgaaaaattggcttacccttcaccagggttcgatcctgaaccgaattggctccagaatcaaaaccatggtgatgttcttctccgcggtgcccatcgggcattggcgtcgccattgctgatgtcgcctggggccttgcttcaagatccgtcacgcgagcggcaattccttccaccgtgctccgcaggtccttgatccctgcatcaacacttggaatccacttctcgagcccttgcatggttcccagcaagatgttgatgttggtggtgagctcggtgacgcgctctcccaacgtctcgatctcttcttccgccgcccccattctctgagtaagagttgcttgagatttcttcctcgccaggatgcgcccaacctgagctctgataccagatgtcacgaactctcggattccggcgaaacgctcggagattgaaggggaatcaggttcgcgattgaggaatgagaggaggagtagagcagaacagaggtagacgatgagaggttgttggtttgagtttttcttattcgataaatgctttatagctcagctcgccatataaatggcagcacaacgcacatgtgtctgatgccaccgccgaaccagcacggcacatcgatacacatacacgcaactggcccatctgcggcccatcacagaatacaacccaattcaaagaatcaccgaagtatctaataaggatcacgacaagccggtggccgtggggcgtacaggaggagccaagaggactgtgctggcgagagagagagacgcgcggggcgaagaccgcaagacaacggcagtggcgcgaggaggaagatgacggtcgatgcccctgcttggcacggcacagcccacttcaccagctgtgcaacgacgcctttacgggatgtgccgcgcgaaacatttgggctgcactatgggagaggagagaagtggattgatatacacatgaatcttcatgctaaatactccctccgtccctaaatatttgacgccgttgactcttttaaacatgtttaaccgtttgttttattcagaaacttttgtgaaatatgtaaaactatatgtatacatagaagtatatttaacaatgaatcaaatgataggaaaaataataataattacttaaattttttaataagacgaatggtcaaacatgtttaaaaaagtcaacgacgtcaaacatttagagacggagggagagggttttataaaaaagaaataagataacacttcgaattgtgtaaaccaaccggactaagatctgcaggggtgactgttgttgtactcattgccaccgacatgtgagcccaaatgtcattggtagtgactgcacagtggtcaccgcactggatcctacccaataaaccaacatattatgtctaagtgccacttaaaaacaatttgattgtgtcccattttttttcaatttagtttgtattgtattgcagtgaaggttttacaaatcatattactcgacctatttgcactcactacacacaattttgtatactatgatcaattaactaggcaacattttaaacataaacatatgctcagcatacaacattcaatggtctagaattagcatgttgtcccagatccctgcccatgctcttctggagtggtaagacatttggtggtccatgatcgaggtggagaacagtcccccatgcgtcatctgcagtcggacaaaaaaaaaactgcatttaaatttcaaagttgcgtgatacgggacatctctaaatttaaagtacactttcaaatatacatttaaattgcaaatatatgtgatactggacgtccctaaattaagaacactctagtctagactagactagaggtgcgataatgatgtcagagtagagacttcaaataaataacaaatgatgccaaaatttttttttacaggggctaattgagttgggtcacgatttaaatctcatcgtattcgtacctcgtttgcaaagcaggcagcagagcaacctcatcaactgtaatagcttacgctctctctgtatctgccatatccaccgtgagcactctccttgattatctgtaatcacaagatcactccggttcacctatttctgaaaggatagctgcatccacattgaccaattaaacaatagtaattgatggtccaatcctagctatatactacagagaaaacaaggattaccttagtaagaaggaacttggacctgttcaccgaattctctcccaaatatttttgtggattactcgaacagtgactttccttatgtaattgatcttcagaagatctttacttggttccccaccttttcgccgaagcttctctatgagatcctcgcttacttgttcaagatgaagttcctccagagctgctaggtgctcaatgccatcaggaattgtcatcagttctggacagtcacgaagtgttagccttgcaaggctttgcattgcactttcttctatttcaatttgtctgagatttggagcatcccacactcgtaatgtccggagtttcgggaaggattctgcacaaaaatgcagtttctccccttcaaaagctctcataaggtgaagaaagcatagaccatgcaacatctgaaggctgtaaagagagtcttggtcaagctttgagaatgccattaccaacttggataggttgtggaggtgtgataaggatgatagactctgatggattgactccttctccagctgccccttcagttcgagaatcgagagagttggaggcaaacgaagtgcttccactttcaacacttgttcgtcatctaacgctgaaatcctcaaatggacaagatggatcatcttcatgatagagttgcataatccagaaaagtgttcagttcttgtgttggcaacaccaaggtttcttatctctgtgaaaacaccgaggtgactcaaaattgtttcatttgactcaacatactgaagtgagtgcaatcctgtcaagtgcactatgccttcaggaacccttgttccagtgaaaactgcgactttgtacttgtcctctaaaaataaattgccaacatacaggtatcgcaacttccggagcttcgctataacttttgggatagtcgataatccagcattaaacacatccaaaacctctaagttctgcaatcgtccaatttcctcggagagaatttcaataccagtatgcctaaggcacaagaaacgaagattaaacaagttaaatatctcattcggcagtgacttgatacgaacacgtgacaaatccaaagtagacagcatgttcgaacatttcaggaaggaattcaacaggtgaatgcagatatcgttattgaaaacatacagtgcacggagatgatgagtcgcccctgataaactcaattgttcaatgtctgcacattggattgataagcgacgtgctccctctactgaaaatgttctagttccatcaaaaattgtacagaagcattcctcgtttgctttggtgatggcaagaatccggataatatcatgcattctacaaccggtcactttcccagccacattcatgtccactacctgaagtaggcttcgatttacaagttcattaaggtatccctctgcaacttcttcaaatgtcttattctccttttccggtataaatccagcagacatccagtgccttgttaccttacccctttttattttataatcctctggatataatgcacacagcagaaaacaattcttgagattgtatgggaggtcctctaagctgactttcaggataatattgacatcaattatcacattattcgtcagctgcacctccaactcattatacacatcttcccactcagaataagtaggggttttgcacgataacaggcggccgatgcatgcaattgcaatgggcaaacctttacacctgtccacaaatttgtgagctagagtctctatatctgctgggcatattttctgttcatgtttccaaaatgcttccttgcaaaacagttgccatgaatgctcctcttctagaggtttcatttctattatacaattttttgttgctagcaatgctacctgatgatttcttgaggtaataacaaatcggctgtttttatccataggaaatgcatcccttatattgaaccacacatcaacaccccaaacatcatcgagaattagaaggtatcttttaccttgtaaatggttatgaatattctccatcaacttggtagcattggaaggtatgccaaattcactagtaatatgcttcagcaaatcctcaacttggtagctgtttgagacagttaaccatgcagtagcatcaaagtccactttaatagtgtggtacacatgggaaactaaagtggtcttacccactccacccatcccccaaactgttgtaatcatactactctgttccaaatcatctccgagccaattcaacagcaactccttattcgtcttgatccccacaaggttgtcttctcttgcaacataaaaggcttcatatttatattttgaatgatcagtgctcctcctagctgattcttggtcaaaacctctcatgatgtaccgaacattcctcctatcagctctttcaagcttggccttgatctcatgcagcttgtgcgcaagacggtgccaggtcttaacatgggtgatcctcttcttcatcttggctgcaatccctccatgcctgtcgttcagcttgtaggtgaactcatcgacgacatcctcgatctcgaaagtgaggccccgcattttcttgacgaaaatgccggttgtctcatccgtgtccttgaaccgctcaacgccatggagaaaggcttgcatgctctccagttcctccttgacctcatggatctcaccaaagagccttgcaagagcagacgcttcatggcagacaattgatgaggcgaagctagctgcctcatttgctaaggcagaacccaacttcccaatcagggctcctacaacgccttcagccatggagttatgcttcgacctgagagttgagagtgctagctacttcaaagttcggtagagccagtgttgacaggaggaagatgacacagtgagggggcgcttttcaggactatcaaataccaaatgcgaatcattattgaggaagtttcgtagacatttcctgaacaattattcaaaaggggtatcttctattcaaatgtcatataccccagtctttaggatacatggagacgttatgttaaacttcggagagtattgtgctccattcatttgttcagtttacaaatgatatcattttcagtgctctgacgtcttgacaaggatttaattttcacttggctaaaccgtggtgacgtggtggtcggcatgcagaaataagcaaatcaatggtacacaggatgctctttgacggcattttcatctacacgttgctggaatatttggctgcagggtaacgacaggattttcaataatagtttttactccttagtaacaatagtttttactccttagtttttactctttttagggatgccgtacactgaaagacgaaaaaaaaaagtaacacaatagttaaaggagcatggtagtacgtaaatatttttagaggcaccaaaagagacaaattaaagcaactaaaaaatgagaagcctcgatcccaacctgagtccatcatgtgatcggaagggcctcttgtctggcagcaagctagaatcatctgtttggtattgtcactacaaaaaaaaaaagaaaaaaaaaagaaaaagcaacattgtgccagctggggaaaccacatagatactagatttcccagccgacgcccagcagacggcacgatgaggcagaacaaaagtgccagtttttagaaccgtcacttttgagcttccatgcatataaaaaaaaaaggccagttcaatgcatcggcttgattcgagcggatgcatcaagcggctcgagtagctcccgatcgccaacacccaagaacacaatcacataatcaacattgaaaaaaacaaaatcaatatccaatgccatccccagataccaccgtcgcctctgctcccgtcatcgatggtgaatgcagtcacccactgttagttgattttatcggctaatgccggttagttaggagaaggttaaaatcccaccggttttcttatcctaacaagaaacaaactaagagataaatctgttttgtgtgatcggtacaaaatagattcgaattttagattgagataagccctcgagccccaccagtgtcgcttatataaagaaagagaaggagggaggcagggtgacgactcgactctctctaatctcaaaccctaaatcaatcgcccgatcgattagacaatggaagaggttcgtgaggtatctctagaagaagaagaaagaagaacagcaatggcttcaaacacaggtcagtagatcaattaatttccacataagcaagaggtgatcatgtttaggctaagactcaatgaattaattggattaaattccaacattgtgatatcagagcttagcttagccttcatgttccctcataatcacatgatccctgtgattagaagccacccttacaaagttcaagattgattcggcctgaacaattttgaattagattagattaatttttttaagtcttggttgcatattaagccatgctatactgttggtctcggtcaacagtagaagaagcaaagttattgaagaatttaatttcgttgcttagtagtagaatttaagagaagaagaggattgggataagcgagattgaaattcccaattctcacactaggaattcctagactgaagctaagctttcggctagcactcagcaaacaagaaagaggataaactagattgaaattccccactattaagcaaagggaataaacaagattgaaatttcccgaaattcccaataaggcggagcaaatcggcccaaaatccccaaaattcgaagaaccctaatttttgttttaagaaccctaagaccaaaacctgaattaaatccaaattaaactcaagattagggttttgagttcgggaatttaccggattttgaagcccctaaatccaccggaatttttccgggaagcggcatcgccgccacttcacctccttgcggccgcgtcggtcttctcgtgcgcgtgccatcttggaccgtccctcgccgggaatgggaagcatcagcttggcgtcgcctccttggcttcttccccctcaatttcctcgcaaggggaaataaaattgcctctatgtcctatgtatgctactcttgaaattttcttgtgtaagttctttgcaagaaatagggacatgcttaatgtcctgattcaagaaagtagttaaataagaagattaatagcattattttgggttgaatcattatgaaacgttgtcgaaattatggccttatttttcggccatatttctaggggagaatatacgtctcattaaggtcgagacacttcacccatagaaatttttgacatctatcattactgagatgataattcgctaagaaaagctaaagtaaaatcaagtgattcaagttcataaggtattatgcttccattacataaattataaaatcagtgggagctcatcaagagctctaataagagaagattattctaccttatttatgactcatagctccattatgtggatgctagaattttgtatctcttaatttgtgacttgcacaattaaatatacataacatagcttgagagttttgttatggaaagacaagtcacatatagggtgcagacacaagaaatccatttgtggacttaatcaaacattgatgatgttttaaattccgctgtgtcattagtgaactaagcttaaacaagaatgaggagaataattattctataatgatggaagtaagacgtctttgaatttgtgtcattgtcgcttatgtcacataactaggggagtttgaaacgtctcatgaggtagagatattctttcccttagattttaatggcgttgtttagctttaagtgaaaatttcactaagttaagaaattagccaacaaatgatcatttatggctatgtttacccataagcgacctcccatttcctttaagaaatttaagacactaatgctaaaatcaaatgaagttatgagattggattatggtgctaaacactaaataaagcttgttcaccttattagacattaaaaataaacgttcatccaaatggttttcgaaccatgtaagaataaattgagatggatgaacaaaataagacattaaagtgttcatctaaatggttttcgaaccatataagaataattgagattgatgaataaaataaagaatttagtagaagtttctaaatgagtcaaaatgtttaggctatgactcaattaattaattggattaaattccaacacccccaagcacgtggtggcagatcgacaagccccgagctcgcattggtggatctgcccaggcccgtgctcatggcgacaaatccggccaccctagtgggtggaggaacaggtgtaggaaagcacggcgtacaaagagcgcaccagctagagcccgcgccattcaccgtgccttcaaaccatctatatcgaagaggtggaatgaagagggcggggggggggggggggagagaagggagcaagtcggtgaaaacacgtgagggggagaggatacgctcgagataaagcgctcggctcctcttccattcactcgacaaaatttctaaatctccggttcggtcagtttatgtgccggattttttaaaaaaaccagcacacacatttataatggtcttttcatcttgtggattatgtaagcgtcatctagaccaaaatttggcacctttggttcccggtaaacagcaatagcgaactcttgggtgaatacaaacatttccatgttcatgtacggtgtagatcagaacatctccggtctgagattggactgcgaactttctaatgatttaattcattttggataatttttagaccaaattttaattaagtgatttgaataatcatgcacagtatagtgcttcaatgagagagggagaccaccttctcagggattgtagggtcccccggagcaaaggtaagttagttgtttttatggatgcaaaaagctatgttgttccgtgggaatcttccattgattgaatggattggttgggtatagctattctttagtctaatatgtaaaattatcctttagtaaagtcaaactatctgcagcgaggtaattttagataatgaaaccattctattatctctactattataaaagtttaagatgtttttgcataacttttcgtacgtcagccaattccgaatcggtgtacgtctgggtattttgccttgtgtttttcgtctccctcggatcagcttactatccgattaatttccatatccgtaactgcgctcgcgtatgaaaaagccccgcctggcccaagctaccaactgggcagcccatgaactgctcctgtcaggcacaagtttgcagtccgcacaccacagcacacgtgcatatgcaaatcgacatcttaggccaatctgccgttgtcctcaagtcagcccgtgcatgcacgttgaccaagtcattaggataagcaccagtaacctagaccaagccgtcctcttgtttatctttactattataaaaattgaaaatatttttgtcggtattttgttatgttatctgtgtttgagtcagtttttaaattcgtgcgcgtttgaaaatatagatccatatttgagttggattttaagcttgtttgcttttgaaaatataaaaggagttgtataagaaatctctttaaaaaaaactcgcatgctaacttaagatgaaatacatactcctcattgcagctcatgattttctaaaaaaatatatatcaaagagaattcctacagtcaattttgccctacctaaaccgtataacaataacaaaattaaaatagcatttacccgttgcaacgcacgggcattttttctagttactactaatgcagaaaaatacgacctctctatacgagacaagaccacccctccggactcagcagaaccctaatacctcagttgtcaaaaacaatctagtacttgttttttcttcatgcctagggttatgttagtagtaatgtagttctctttgttgatacgtttgttaatcatctgttcatttccaccaatgtaatatactccctccgtttcataatgtaagtcattctatcatttctcacattcatagtgatgttaatgaatctagacatatacatccatctaaattcattaacatcaatatgaatgtaggaaatgctagaataacttatattgtgaaatggaggaagtagttctcttcgctgatactacctccgtttcaggttataagactttctagcgttgcccacattcatataaatgttaatgaatctaggcacatatatatgtctagattcattaacatatatatgaatgtggacaatgctagaaagtcttataatatgaaacggaggaagtatgtcctaaaattcatccatgcaacttcacgagagcatgatagctatcaattctcatatactagatgataccccgtgtgttactacatactattcatatgtgcaatgcagttataaaatgttaatgcatagaaataagtaatattatgaacctataaaacatctcacatatgaaaagtaaaatacttcttatagtgatttttatagcatactacactaagtggtgaatgaatgttgagttgcctcataataaatgaaaaataataaccgttaatatttaatatcctattggattaatcatgaaaatgatccaatggctcttgttttgtggatgatgtggctcaatgcatgtttaacttttatgtttagtttttttgccaactatataggatatatagattggtgagttctcgccattctgacatactgtgaggtgtcatattttgtacgataaactcggtttctcgataccttgtaaaattttagttttggttgtattgctacttaagacttaaggaccataaacttttctcgtatatatacacacacgcaagcatttaactcaggaaaagttgaacgatttgaagcagcggatgtacaataatttcaaattgttctgatttaagcaaataaagaaaccagggccggcaatcagtgttgcattagtctccgtcgaatgccgagtagatgatcgacgacttgtgaggccaggtgtctcgttgacacacgaagcaaggacaccctaatatcttagagaaatatattctgcaaactactccatccgtttctaaatatttgacaccattgaccttttagcacatatttgaccgttcgtcttattcaaaaatttttgtgaaatatgtaaaactatatgtatacatataagtatatttaacaatgaatcaaatgatatgaaaagtaattattatttgaattagacgaacggtcaaacatatttaaaaaagtcaatggcgtaaaatatttagaaacgggagagtatataatatgcgaatggggcaaaatatattattgcacgagataacgatatgtactaggccagatgttaactgcacataggatgatatttttaaactctcgacgatttcattcatgccagcgatcgaagtcgacctatattttaactaggctaatttaatcatgagaaaacctcacctaatatgattcaagttgcacaaaatcacagtgatattgggacgtgacatataacttgcgtattatggtcataaagttttacaagaccacaccattaatcattttgacatatttctatatcaaaatacaaaaggatagatataacatttatactatatatggataaacatgccataaatttgagatgtgattaattttataccttaaaatatagaaaaattatgaataatgcggttttgtaaaactttatgactataatatctatggttttgtaaaactttatgactataatatcttcaacattggtttgaagtttatgaattcatcaatataggaacattgggacaagctaaacctcaatgagagggtataatgccacatacacgcatgtattggacctagttgttgcatggattgtgtaagacaaaagcattgacccatctaaaggttatgcgaagttcgaactgatttgaacagaacaaacatcttcttcctaaagtcattctctttccttctctcccctagcccccttattccctgcagtgtgtaaatcccatatcttttttgagaattacacagtacaacgcagacactcacaatgcacgcacactcatccctatgaatgcacgcacgcaaccctacccctatgaacatcttcgaagactgggcggcaaatcctgaagattgacgaagtcatcacaggcgcctcgttgtcgacggcaaactcctattagtagagtttcgtgttactcatgttaattatatggtgttggcgtgtggtcagttctacaaagagagtttaagatagattcagaccaaaatacaaacttatgtgtttcgaaacctttggttcaattgttatttcatatgaagcttggaacgaaaatgtattgtggtgcaatactaacgagggtttattcatcagaagagatgggcttctgcaagttaaggtgttacagaaccactagttcttattttgatattgcatttctccgactaaagggtttcgggaggtaaggtggggatgttgtataaccgttgattcttaatggtagcatgtcacacaccaatatgttatctttaccgaaatagagatgtgagacaagatgtaaaatcaaggagttgatttagatttgtgtgatgaaaacattggtggtatgcgatattctttatgtgaaagactggtctcttgtgatgagatttcggagtttaatagatgattggttttgtcaagtgatggttgctgttggccttggcggtcagactggccgggtgccatcagtcataccgcatgttatgcggcagtcaaatcagcgaacctgacggtctaaccggcgggattctattcgatgtcagtttcaggttgtcttgtcggttttggatattacccattttgatgtagatcggtctaacaggagtagatgtgccggtctgactgcttgaagacctcctgtctaactagtgtagttgctctagtttgtccgcctgtcgccgccgctggtctgaccgccatggagccgtcggtctgaccgggccgatgacgtcgatctgaccgcccatgtcccaccgattggaccatcgcacctgagaaaacacaaatcgaagatctctcaaaagtagattgaactttattacttctattcgtgtttacaaagtgcaataataacactcctctcaaaactctcaactaaactcgaaaccctaacttttctctaagctcaactccccctctttctatttatacctgaggtaagtagcataaagccacgaacccaacttgtacaagaagtcctataacttaggaaaactttcgtacaagaaacaatcttttgaaactccaatcacatcaaatttggacttcttccaaattcgactccacatcccatatgcacacattatctccatcgtataccatatgaaatcttcaccaaccacgcatattgatatttagcctaagcatctcgcatgatatcctaatcatccagacgtcatcttctcccaaaatgactcccgatccatcaccggcaaacactctccggaggtatatcaagacttacccacacatgaatcaaccaagaaaccatatctgagcacatgttctctccaacttgagtcaacattagcacacaattgtatcacatacgcatagtatcgatctagaagtcataaacatgaaccaatcatgagtatccaaataaacaacccgaaactgaaactgacacagagccggccggtcagaccatcacgccggctagtctgaccggcctagtccatccgatctaaccggttacacaatcagcaacccatttcgccaattatctccaaatattaaaatccaatcatcacgcatgctaattattcatcacaaagtaataatcaaacacactttgattctacagttttcttctcttacaaagtcatatttaccttagttttatctttccatgattaatctatgttgtctaccttcttttctttctctcattgagccatatcacctcaagcttatttttgaatgatcaatctatatatgatttaagtggttataaaccacatcatcttaattgcttatagatttctctcagtagtcaatcaactatgaaaattataaaaattacataaagttacgtcgtctagctaccttacatgttatttatactattgtcatacaaaacttccgtagtaacgcatagggtttcatacagttatctaaatatcaatgatcatccaaaataagctagaatcatttctctagcaacgccatgtcatcctcaatgagttcacttttatgttcatagagtacaatatagttgcaagctaataagttctaacttaaataacaaccaatgaaattatcttgaaccttatccacccatggttacaaataaagtaaacattaatgatgaattaatagctgtcatctcgagcatattcatttaatttctgtcatttttagtcttccgaagtactataaataaacatattttgaccctgccttcctaccctcaattagtcactcaagttttcacaatggtttgcaagattgtaatagttgtctacgtgttcatattcgcgctcctcttctcccatggtaagtattcaacacttgttaaatcgtcgtttctacccacagggctctcccatgcatgatataatatatcttctcccatgcaaagatatccgcctatgtaaatatattttcccgatgggttcttgatgcacttgcaaaaatttaagatttacatagtccctggttgtaggcagagaggaaaactccgtgtaaacataggtgcatgtacttttataccctcatcaatcgatatttaattgatgcttgttccaacacaggaatgtcgctcaacgagcattgcgataatg

SEQ ID NO: 13410 - DNA, 2927 bp, Oryza sativa
agcaagatttagaagggctatttaatagcttggaggatccaaacaaggccatcggtacgatgctcgatgagcattgtgatcagggatggagctagaattttgagtcattggggtcagacctgtacaatatacaaacgttgtgtttggaaggtatttagtttgggagcattgtagtataaagtcacgtacactagattcaaaaaaattagcttagaactatgagtggtttaagattatttcagtgaggtttagtttaagattatttcagtgaggtttaaattactttatttaaaactatctaagaatttgtgagtgggagccattgaaaagttggggctaacaaacgcttaggctgtgttcgggaggtatgtttctcacctcctatgcatgcaaaagggagcaacgcattttcttataattaattaagtatttactaatttttctaaaaaatgaattaatatgattttctaaagcaacttttgtattttttatttggcaaaatatacaccgtttagtagtttgaaaagcgtacgcacggaaaacgagtgagatgagtagggaaagttaggcaaagaactcagccttaattccttcggcaattttttgtttgctaatttaaaggcctaatgtgtagtagttgattactagcaaattaaactactaatctaattgcatggatcgatcggatagacacagtacatagctaaaattgctaacttgttaacagatcaaatatggtaaagctggctgggcaacgatccataacctacatgttagatattaattaatatgcgctgatacaccaatttaattgggactcgggagtagtgagtgcataaattttcaaagaactgagcaaactgttttaacgttttcctctgtgactgagatttctgttcggcaggcttcagcttctggggtcaccgcctacaaaatgctgacgaatacacagggttggctaagtccatcagggtcatctgacccagagctacgtacaactgtggatccgcccctgattgcgataatgaacgtgcacccgctccaactggctgtccaggaggacacttcaactgtcgccaagtttgtatccaaaacgggtacaagggtgggtattgcctagataattgctagcaagagaaactgcaggtcggccgaagcaaattgctccttgaacatgcatgagaggatggatgtagtagtacgccaccttggaaagagttgaaatttcatagaagattttttttttctttgtatcttggtatttaattgttggtttgtttgtgattgataaatccaatttttgattcttatgttgctagtcgatttctcaaacggccgtgaaactagctaagttttgagaagaattcataaagagcaaagggtcatcgttcttttcttccatgccttcatacttaatgtgctctctatctttacctgaattaaatttgaaaatatactgttaattcaatttgttattagaaatattcgggatgcaaaatctttcgcacaaatataccatcggtctcgcacaaccattgcacgaaaataatgttgaaatgacgtcgtgaccggtatcgcgcagcggtctcgctcaagcaaacagcgataccactcaagcaatcaacgctatcgctcacgcaaagagcgataccgtgccttgccgatttaattagcagttaattatcttgattagcgattaattagttaggataattaaacactaattattattagttaattgttaattatgtacttaatcactaatcaaatagatcccattgaacagtgtcgctgatggcttctgcgagaccattcggtctcgctcttccattccgcgagaccgcacggtctcgcactgctgccgcgcgagatcatgtctcgcgctttcgccgtggatatcgtccacgatgtcatccccacgtcattttcgtgcaacggaattgcgacactgatgatatatttctgcacaagtttttgcatcccgaatattcctaagaaaaaattgaatgaacagtatatttttaaatttaattcatctctacctcactcagtcattgatagtgttggcaaagctagaagatgcagcctgtggaggggttagccataaattcaagaaatccatggataaagtttgtcaaccactgagaaaagcggtttagggaaacctagggctggatatcgagctggctcggctcggctcggctcggctcggtcaggctcggtaagataacgagctggctcggctcggctcgttaaccctaacgagctaaaaagctagctcggctcggctcggcaaaaagctcgagctagctcgtttggctcgtgagccagggacaaaaaaatgtaaaatgtaaactaccatacatttcaatgagtcatataacacatatttatccatcatgcaggctagcagcaagcatcatgcgcatacacgcaatagagtacaaattaggtccatcgtccatgtctccatcacatattcatctatcaactatcatccatgcaaattgcaaagtacgactacatcagctagacaggaagggcgcataaacataactacataagttaacatagcagaatgacacattgtttaagttccatcattctgtatttccatgcaaacacacaaaaggcatggtcagttaacacttctcatccatggtaaaatgtctctccttcagtcctcctccctttcctatagggtcaataatagtacaacaaacagcactgtgttaacaagatgataagcaacaacaacaagccaacaaataacaaaaaaaggacaataagcacatatacccactagacactaattgcttgccaccacgcattttgggaattcaatagactcaacatcatcttcaccatctccaatctaaataaatatagacaaatattagtatgtcacaagacaaataaagtcaaac

SEQ ID NO: 13411 - DNA, 154 bp, Oryza sativa
gggctcaccggcacgcgacgaacggcgggctccgatggcggaattcgacggaggaggggtggacgatgtagccctcggcgatgcgaacccgaagacgacgacgatgcggctcggcggcggcgctagcggcggcgagcggcggccggaggagtgg

SEQ ID NO: 13412 - DNA, 8408 bp, Oryza sativa
  unsure (1)..(8408): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcttgactgctattatttccagctaatctaatatgtcaagtttcagatgtgaacaaattaattttagtttcgcagttgcttattatttggatggagtatttggtgaatctaaggtctgatttggaatgtacaaatttaggacaacttctgtggaaattgaactaatttacacgaaactcttgaaaaattcctaccttttctaaaggaggcctaaaaattttggactcaaccacctcctccccaaagagataacattaccttgatttttacaaccattgctttctcaaaatttcccagttttttatttcatattttactcccatgtttatatttctgggtcatgtgcagcccattagggctgaaagcagcaggcgacctccctagggccagcagcactgcaggttaacagtaccattgtggttatcattcatgcgtggttactgtttacagtcggtgttcaaattaaaggtagaaatgagatcgattagttagctacttcctctgttccgtattataagtcattttaggtttgtcctaagtcaaacttctttaagtttggtcaagtactaatattttcaacacagaacagatgtactacaataatatattcaatggttgattcaatttgaggttgtagatgttgctacatttttctataaaattcgttaaacttgaagaagtttgacttaggacgaacccaatatggaatggagggagtgtttccttaaacttagcgatatgtgccttaagagtcaagttatcccatctgtatgaagataggggttatatcctctttctcccttgcccttgtggtgcactgcctcaatggcattttcatgatacttgggtccagggacaccttacttggactgagggttctagtcccagcatgctcattatattatatataaacgttgtacaagtagcaacgatcatgaatacacaacataactttatatatggttgtaagtaaagcatgcaataaacttgtaaccattatctgttaagtttcgttgtaaataattggactggtgcatgagaagttccaccattagaattgaatatatatcatttcacatttagtttcagggtcaggcactatgtacccaactacccattttatagttcattatgttgagatttcagcagtatgccaagctaatctccaaatttattcagcaggtgaggtgaagaacacaattagatagcacttcccattgagaaagtatggcagaagctgcagtagtccaggccctcatcaagattggcacgacttttggagacgcggcattgcaatcgctcaaagacatcataaagaaagaagtagctctgttacaggaactaccagagctcgcaaaatccattgggagggaactggacatgatcaatagcttccttatgcaagtgcgggcgaagatccacagcactgacaatgaagttctgaaacgctgggtggtgagagtacgccaggtggcctaccatgttgaggacataatagatgagtactcctacaatgttgctctgctgcaggaggaaagctatttaagtagaatgatgcgtgcgacctactatggtgtaactttccatggcattgctactggactgaaagatgtacaaaatgatatcaagcaattgtcggatactaagacaaaatttgcagagttcttcaatgagttacatagcaacactggtagtaacacacaatctcatctatcacgtgatagatccctccatacagttaaagaaggtattgttggtatgacagaagaggtagatttactgaattcatggttatcacccaatgatctcactagagtagttttatctgtgtggggtctgtttgggctggggaaaacaactctggtgagaaaggtgtatgaatctgtgaaagagcagaagatctttgactgctattcttggattgaggtaccacacgagtacaacaatgatgtaatgttaaggcagttaataagggacctatcacaagaccaaagccaaatacctggaaacctggacagtatgtatggcagccagctggttgatatattatgtgtggtgttatccggcagaaggtacttgattgtgctcgataatgtctgggatgccgatgcatttcatggcatatcaagctttttgatcgacaatggtaatgctagtcggataatcatcacgactaggacaagtgatgttgcttcactggctcaagacacatacaagctcaagcttaagcccttgggtgatgaggctgcaatggaactattttgcagaagggcttttcataataaagacatgagatgccccccacacctgaaggatctgtgcgaacagattgtgagaaagtgtggtggcttaccatcggccatctatgctataggcaatgtgcttgctgtcagagaacagacagaagtagcatggaaaataatgaatgatcagttccagtgtatgttagaggacaaccctggcttgggagaagtgaggagtgccctgagtgttagcatcttgttccttccaaggcatctcaagaactgcttcctctattgcagcttgttcccacagaactaccggttgtcacgtgaaagccttgtgaagctgtggacagcagaaggattcataacgaagagaggaagcagcactctggaagaagttgcagatgaatacctgatggagctgatccgaggaagcttgttgcaactcctggagacagatgaaattggcagagtagccttctgcaagatgcatgacattgtgcgtgacttggctctgtcctactccagaaaggagatgtttggcctgagtgatggagacctccaaacagatcaaaaggaagatgttcgtcgcctgtcaatatccaagtgcaacaagaatgtgggatcaatcttggagtttcctcgccttcggaccttcgtcgctaccaatggaggcgcagagtcagacctgttacattctctcatacaaaaatcgaagtaccttgctgttctggagctgcaagactcacccatcgacataattccagcaaatattggagagttgttcaacctgcactatcttggattgcggaggaccaatgtgaaatcacttccaaaatctatcgagaaacttaccaatctggagactctggacctgaaatacaccggggtagatgtgctgcccaaggagatctgtaaactgaagaagctgaggcacttgttcgccgagaaactcattgaccgtaatcgccaagtgttcagatacttcaaaggtatgcagctgccacatggattttcacacatgaatgaaattcaaacccttgaaacagttgaggcaacgaaggactccattgagctgctggggaagctgactgcactgagaaccctgtgggttgagaatgtgcatcgcgctgactgcacaaagttgtttgattcattgtcagaaatggagaatctctcaagcctgctcgttagtgccagcgatgaatatgaggtccttaactttgatgcattcagtccttctgagatgaagctccagaagctcatcattagaggctgcctcgagaatgacacatttgacaagcttatgttcaaaaaccttggctcacacatcaaatacttgtcactaagttcctcgagactcggcaatgatccgttcccgctcctcgcaaagaacatgaagaacctcatctacctgagcatcaggaagtggtgctgtgctgaggaggtggctctccgtgaagggtggttccctcgcctgacaacactcttccttggtgacatgaagcaggtgcacactattgtcatcgagccgtcagcggttgagagcttggaggcgctgtacttggtttctctgacggctatgacagcggttccgacaggcttggagctcgttgggtcgctcaggaagctcgttgtgtgggggcagtcagacgatttcaagctggagtggaagagggagaactgggaaacgaagctgcgccatattccggaaattcgcatttaattgatcaagaactgcttaaaatatggatggattatatcttgcatgactactgaatcggtctctggactgattcctcctgctttggttccacctgagtgtgatttgtttctctttgtctgaattttacgtttgtaatatgtctgaagttactgaacttctatgatgtaatctaaattctgaattttcttgtaccaaactaccgattcttgtttgtgtactacatatattgcttcttaaggtccgtttggtatggctccaaactccaattcctagctcctaacttcaattctagctagaacactcttataggagctgaagtgggtgtgaaagtgtttggataaattggctagcttcacgccaccacgttccttgttagcatttcatcgaacacctagttggcgtcgccctgccgctgccgccaccattcaacccgcacgccgccgctcacccccgtcccccgccgccggcggttagcccatgggctgccgcggccgccgcacgcataccaccccgttgctcgcgcaggtctacccgcacgcatgctcgtccagccgctcgcgcccctcccgtgcgccgcctgcctcctcggcggccgccattgcacacgcgccacgcctccgctaccagtgcgcctgcagtgaggagagagaacaagagtacaggggtgtgaaagggggagttgagtggtatttttgtataaatagactaaaaaataaaaggctagttggtcttttggggtgaagtgaagctgtggagcagtaaaaacccagatccacccccatagtaaaaattagtggagcagctctcccaactttgttccaaaaaaatagtgaatctgtaccgtttggcacagcttcagctctaggtaagttggagttcggagttataactgtatagtgtcaaactgggccttatataaagctgtgaagcttcgtgttataagacctaacaaattttgattgttgcacctgatttatatgctacctgttgtttaggctttgttaatgtagttaagtgagaatatatatatatatatatatagtaaatttgtttggtgctccaaggtgcccgggcaccattgttgaaattgagcatatacccaattcaaatgagtatgaaactttttcaattacttaggtattaatattaactactttactaactagttcaaaacaaatttgaactgaatttgaacttgtttttgttagattttgattctaggtatatagtatctatacatataattagttaggtatgtaatcatggattatgaaataaagttaaatttgagttgttttgttgataagtataggtatgaatcaaattattataactaggtatatactcacaatttgaaaattttgaaaaatttgagtgattttgtgcatttgataccatggtgcccgggcaccatggtgccccatatgagtgtcatatatatatatatatatatatatatatatatatatatatatatatataactgtgcttttgtgaagcacccccgcccaaaaaacctgatttatgaaatttggtcttgaataaaatcctgaaactttaataccacacgtattgctttcagatcgcctataattatcagttactgatggtagcttttggagtactttcatttgtctcgtttctgcttgtacctgctgcagtcttataataaaacccccaaggtccttttgaaacaaaggatttgcagataagttttgtaggatttaaatcctactgaaaattttccattttgactgctcgtggattttagaggaaagttagcaagtgctttaaccttgtatttccgcggcctgtttaaacatctcgtatttcttttttgtgttttgtaattctctattttgcatatgcatttcttttgaaagtctttccgtttctatattttctcaatacttcaatccgaaggagtcctaaaataaaattctgaaatttaaatgcaacttatcaatcctacatgagaaattctgttaccaaagtacttactccatataagcttcacataggacagaggaagtctgttatataacttatgcaagtttttcataggaacagcattattttgcattccaagattggtttccctagggctggacggaaaactcgaagctcgttagctcgctcggctcgtagcaggctcggctcgactcgactcggctcattaggataacgagccgagccgagccaagattttagctcgttagtataacgagccgagccgagctaactcgcgagctgctcgcgagctgaacgagctgcgctttctggactgcaggccgcatccacctgtgtccgcaggccacaacccagtagcccaaaagcccccccagcccacacgcacatataggagaaaaaaaaaccctaagcctcttgcccttctcacttcctcagtcctcagagtctcacgcgtggccgcacaggcacctggccgccgcaagcttgcggctagggttactgcaacagcgccagcacgcgacgcggcgcgccggcgccgcgaccagcgcctctccgtccgtgagtccacgagcaggtccggttccgatcctcactcggtcactcatctttcctttttcctctagatagatctacatttgctgattgccgaactgctactaaactgctgactactatgctccaggtccaagccctcagtcggggtcgcagccatggagggtgagaataatgcatcgccgcatcctccaagtttggagtcgaggagtaagcttcgtggacgacgaggaacaagcactcggtcttcatcgaatcccactgtgtccttggaagtggtggtatgttatctaatttaaaattgctagttcgtacagtatagacttgaatgttgatttaattattgctatccagagtgctgtccagattatttagttacttccatgtagatgtagataatgaatttatccccaaaaatgaagaatgtcacacttaattttaatgcaatggcaacgattcagctatacattaatacatgtatatttccttatgcagccattggagaaagtttcagaagatgaagacgatgataacagcttcgaccatagggatgatatgtctgaaagcctacctacagttgatggtggaagtggaagccagaagggtgatgatgagtttgatgatggtggatcaaaggctaagaaggcaaagacaggagggaaaaaagctggtgttacagtgtctcccaagtgcaagatagcaagaggcaaaagagctgagtgctggaaacattttaaggttatcaatgtcccatccaagaaggagagaggtgtcatggtgacaaaggcaaagtgtaagttctgccatagaagctatgtgtatcatccaggtggtgctacaacaactctgaaccggcacctggctggttgcacacaatatcagaacaagttgacaaaggctaaagctcaaggtacactaaactttggtccagaagatgacaactctcttattgttaatcctactgagtataatcatgagcacactagagaactgattgccaagatgataattgctcatgagtattcatttcggatggtagaacataaatggtttaatatcttgatgaaatggatgaatggtaactacgagtttattggtaggaagtctataaaaaatgaatgcatgagggtttatgaatctgaaaaaaatcaacaaaagaggagtttgaaagaggcataatcaataagtttaaccactgatttatggacgtctaatcaaaaccttcagtacatgtgtttggtggcacattatatagatgagaattgggttatgcaatgccgtgtcttgaactttatcgaggtggatcctccccacactggaattgtcatagcttaggctgtttttgaatgtatggtagaatggaaaatagaagacaaggtcacaacaataactcttgataatgctacaaacaatgatactgctgttacaaatttgaaggcaaagcttcttgctagaaagaattcagtatttgatcctagttacattcatattcgttgtgctgctcacatagtcaatttggttgttaatgatggccttcaaccaatagataatttgataagttgcttgaggaacacagtgaaatactttaagaggtctccatctcgcatgtataagtttgtggaagtatgcaacaattattctgtcaaagtgggcaggggtttagctctggatgtta

SEQ ID NO: 13413 - DNA, 953 bp, Oryza sativa
cctaaatagcaagattccggagggctatttaataaccctccggatccaaacagggcctatgttgaatggacgatggtgtagatgttgaagttaaccatgtttcaaccataattattaggaccggaccggaaaacaaagcggccaagcctcggttcagggattttctggtccaaccggttgaaccgtaggatagctttgtgatgtagttcttttattcaagggaaggtggagggttcgaatccccatcccaacctttttccccccattttctcaactctctctcctctcggttccctcctgccatccttctcatcatccacgtgcggacccaccagtctagaggccctggtttcggttttttttcagccagaccatcgatctggttcaatcctaataattatggtttcaacctagtcaactagagaagcaaaatctataacctttagactagtagtacaaagaggaatacccacataagtgaaggggaagtgcccggtgaatagctaaagtcgtcggctaagttttcagctttatcatggtacaaattaaacggaaacatgcattaaatatgtatcatgataaatataataaaatcaggttacaaacttcatcacaaatatttgtgaaaattcactttcagaccagtagaggcaacataccaacccatgatgatgatttcccaatcattcaatacactggtgacactttgctctttatgaattcttctcagaacgagctagtttcacggcagtttgaaaaatcgactagcaacataataatcaaaatttggatttatcaatcacaaacaaaccaacaattacataccaacatacaaagaaagaatatcatccctgaaatttcaactatttccaaggtggtgtactactacatccatcctctcatgcacgttcaaggagcattttgcttcggcggacctgcagcttctcttgcca

SEQ ID NO: 13414 - DNA, 641 bp, Oryza sativa
tagttcggaacaggatttgttttatacctgtcagagagtaacacaaaatgctgattgtcaacgtcttccagtgcatttgccaacaaccttctctctgcatcaaccatggaaatcttaccccataccacctgcaacaaaaagtaaaacaatggcaccatcacctacagcttcaaatcactacgataagctgaaagtaatcttcatttttataatgcaagctgttaatcttcatgagcgccgtaaaattgtataataccttttcactgcgtatgtctcgatcaataaataagggactggcatgttctggtttctcccttgaggcatgaacatatatggtatatcttccctcatgaccctgcggaaacaacaagagaagacatggtgaattagcactcagcaaaaagaggtggcacaagaattaggatatcctttcaatattagtagttctgggcaataaacatatacaaaagaaaagtcagagaaagtgatagtataaatgttgacaaaatgaatgcaattctacataagcttaattatcatgaaaaccccacttctaaatcttgcttcttagctaggtgcaaatgggcatgcccgtaatactaattacagcatcaacttaaaaatttcagtgtgcttcagtc

SEQ ID NO: 13415 - DNA, 1011 bp, Oryza sativa
aactagatatacttttatgttctaaaaaatgtggtctgcctacatagcatcgatcaaagaagtcaaatattttaagaaaaaaaatagtacagcaatagtaaaccttataaggcaaccttatggtcgtttcaaagacacttgcatcgtaatccttgtcaaagcttagtgaatcggccacccagctggcatcatgaaatagacatcgactgaattagagtatgacataaatcataagaagatactccactctgtaatggagctataaacaagcagattagagaacttaacaagatataaataataaaaaaagtgctaaacaaaatatactcataaaagccatttatcacatgaatagatgaaacaaactgaatgcctaaagaagtaatcaagaaattccgatttccctatatcacaagggataaagagacgcattcattgctaaaagcctaaaatacctaaatgacaaataagtttactttctaaattagggaatgccatattttaacatcacggaatattaaaggatgaagcagacacaggtttagtctgaagtattgaatgttaatatgagaaacctaaaatctaatagaagtctctgtcgtgaatggaccaaattaaagcgcatgaggaagcattatgtacattctgtatggtgaaaaaatagttaaactcactctctggccctctgaaattcatcctttaggcccattatatacagtgtatcaagtgagtccacaagagttgccccgagaccaccaaagctattgacaccattctttgattgtggctggaaaataatttgaacaaagaaaaatacagaagacacttcagagctcactcagataagttagaagggcaatagaaataacagaatgttgactaaacaaacctgaagttcatccattccccaggcatacttcacataggaattccaagcatgggccatagcctccttaaccttttctctcctttcattattaataggatcaatttctacaagcttttctctgg

SEQ ID NO: 13416 - DNA, 2585 bp, Oryza sativa
tcaggttgtgaagcacacctcccaacatgacatcaactaggaataaaaattgtactgattaaatagaggggaagcatggagaggtaatggaattgcattccgcacttctcactaaacttgagcagctttatttgcaaagctgcaggattgtgtaattgttgcagaaaaaagtgcaccagcaacgtttaccatttgttcgatgcatatggttcattacttctatatatgtccgaaagtgccatgtcttggatcatgtcttacattttagctgcctacctttaacattatacaacttatctgcatagtctgataaaacatgtgcctgcatctatacaccagttaacttttttggggggttggggactttgggggagggggggggggggttaaagaaaactttatgttcactgtcaagtctgatactgtcactgtgtcacacacattgcaaaaaagttttaactcaattaatatcatcattatttcctactgcaacaagagtcaatggcagatacttgccccctcatttatctcttgagaaggggtattgattatcatgatccatctaattatgttgagcattatccattgatacccattgggaaaattaactagactactagcattagctagtgtgtgaaagatctctactcaatgctattgtgaacatctctcttttaggcttttaattagccatctaacctgttagtaatgattaagtacatcgctttattcagaggaaatgaggcaggaccaccgacattgatcagttctcttttttaggggatacaacactgatcagttctggcacttcaattcatggctacatcaatctgcgatgtacctttctgcttctgtcgtacgtgtttaacattttcttttacatccacaatctatgtgctatgacaccctaaggactactgtggtaatcaggagcctcgcgaggaatctttcttgtgcgcagtgatggtcatggtttctcttggcttttcatatgatcataaagcaatacaagacatatatcttcattttcttcaaaaaccaaggattagcatatgataatggttagtaaatggtaagatactaatatactttagtctgttatcaactgaagattgagcctgtatccaaggctccattttttttttcttgcttacaagttcatgcatgtccattgcagaaggaacagcaagatgttgaacatgtaatgtatgcactaatgcacatgcagagctgaagagacatgattctgaggtaataagtcagtctttaagcattgcatacttactcattcgtatgtatcttggtggaaatcgtcggcacaaacaagctacggtacagatggccctcgaggatgctcaagagccaaacgctagaagaagagagctaggtgtagccaaggacagacttgccggctaactccaaggcgcttcagcaaagctgagattcccccaataccaggagccggcaagtcatccttggctgcatcccgttctcctcctcacagtgcatggcaacccagcagaagctgcctcagtggttctactgcatactgaacagtacaggtactcttcctacttctcttcttccttcccctaccatggctgcttttctatcatgtggtttgatctgcaagcgtgcattgcaatcgggaggtatggcctgcatttataggcacaggcacaggcaagttgggcttggaatcatatggcgatcactgttcaatggattctttattataaatatttcatcaatcatagagtttgccattttagggatgtgatgatgactcgcgattggttggcctgatttccatttttaaattgatatagtgggccctgaggatgtggcatcctctcgatatgggctgttaggctggcatgatcccctcgggctgttactggggagcctcattggttggttgggactggggattgagctgttcgcctgttcctattggctgctcgcacgtgagcatgccttgtgtgatctcgatctagtgagttttttttgtaacaacacctcaacagtcctctttgtaccccagtgttgccagcaaaagccaagttaattacctctagatacacacacattgaatctttggatatccatgatcttgtaagtagtactctaccttcaacctaactcagtacaaataaaggcattgatcttcgatcatctttataactccattatttgacaaaagaacctagctagcttttgttatattaatttcaatagcttcaagctactttttcaggcatgcatgtgccttcttttgcctggaaatggatgggagcatttggttcatcccgcatataagaatctaatagttacatcaacagatttatggtacatcaccgtgacatgcatgcttatgttaattgtcttgtttttataagaaatgtttgttttattgtacttctattcgaaccatttatcatatccgaatgattttgttaacatagtgtagctgtgaatatagttatggataattaaaatcatgtttgaatagctcatattactattatgctcaatatcgtagattcaatcagtagatgtgttggaaaagacatgtgcgtgctgct

SEQ ID NO: 13417 - DNA, 15995 bp, Oryza sativa
atttcaagcaacacgcacatttttttagcaagacatatatacacaaaagcttgtcggccgatccagcaaaatatatacacaaaagcactaactagctcctagtagggatgcaagcgggtcgacccacgaatctacttatatgttaaataaagagtaatctgtgggttttcacgttatggctcggcttgccgcgttgtatagatgcaagtgggtcaattaataaacctatttataggtcaaattagtaagtaacccacgagtcaacccgcgggttactcactaattttgcctataaacgggttcgcgggttggcccgcttgcatccttggctcctacggagttagtagtgactcgcccactgaatctctgactgtaaaagggcagggcattagtagaataattaatattactagatccttgtgttgcaatgggctgggacaaaatagaattttgcaacaagtttgatagttgtttttaaggtttaatattatatatttgaattgaattgatgcataagactaccattatccatctttagagcctagtgctgaaaatggtgggaaaaaaacaaatcctgtcataaaatgagaggaatggatagatgaaagttgaaacatactaggtccactggaaataaatcccataggtctgctttgcctttaactgggggtttgttcagcatgtataacacttgacttcctagctggtcacccatttggtaaggacacttcctatcggaataggtcatgatgtaatcagtaccaaaccagggttgaaatgttaaggggtcttaaggatttattctatttccagaggtccaccaggcaaaattattgcacttgcaccagagatgaatgaaatatcgagaatgattatgttcacgcatgtattctttgtgctcacttaactagaaattctcttgtgcctagtagtgttttcctaaaaagttgtcctaaaaggcattgcacacaatttgatggtagcatgtagaatttggggaaatgtggcactcccatgcattaactttttttgtcgccaaccttagtagaagagattagggcatgcatttccatgcaatacaccattaaattatacttgttacaaatttacattgattatttaattaaattttctactagttcaaaaatactgttgcacaggcactagcagtttttttcgccgggccggcgaatagccggccgatgtatattaagagtaagaaagggaatgtacaatatagcgcggtgcgtcaatgcaccaccattacagacataaaaagaaagctaaaatctcacagaatgagttgctacagagtgacacatggggctaacaagacctgcagctatccaagtctcccattcatcccccatggcagaaaagagctggggaatcgttgcctcgatcccttcgaacacccttgcgttttgctttttccaaatcaaccaggttactagcagtacagcggatgtttagatatcactctagctataagcttccccagttttattttattttactccttatgatttatataccaattctatggtggtttctactactagtagaatcaatccagaccttgtatcttttctcatccaatagatcatgttagtttatcttatcacctgaactaccgatagtagaatattttttctactgatagtagaacttataaattaatgacttagacgataatattggtcgtagaatagtaccaaactaccgatagataccaccgtaaaatactcacaattaattatatgtagttagcttctgtaactcaaatcacttcggttatgatgatctatagaagagatatgtgaacttctctacagaactgcaaaataaatatagatagaaaattaggatttatgtcaagtgaatcattttaatgttattttgaagctttgataagtgaattctaagacatatatgatataacaatttctgctttagtgttcgcatctatgaaaatagaccaagtcctagaactagaagagaactctttgcattattcttggaaggccctatatacaattaatcaagaggggcttgcacggtgatgagaactgatgatacttaccgtggttattgttctcttaccatttattcttgccatatacgggttgattgggacaccagtacaccactggtgcaccaccatttggagcatctgccgattggagattttggcaccatcttctttttaatgggaccattctgattcgataccctgcgtatctcaattggattgtgtggtctctccgtccctcctcactcacagtgcgacctgcacatgtaacctttttatcctttgcatgttttcctaagtgattggtgggaaacctcgtaggataagtgtccttaatagtcatttcattggtatatgtagagaactgtagacctataatgtctctcactctcactcgcagggacgcaggcaacatagccttagctaatgatgaaggatttgctggagttagttggtaccactttcacaaatcaagcacatcctcacactgggtcccgaaaattctgcaccggcctctcttagggtttctatcagagcaatgtgttcttttttagtggcagagagtagtgataaggatgatgataactgctagtgggcccccgtgccgctccaggggcaggggcgacacgggcggcgaccaccgccgccttcctccctcctccacctcgccgccgcccgagcagaccgccggaaaccgcgtggctgcgaggaaggcggcggcggggccttccttctccctcgagggcgcgggtcggtgcccacgaccccgaccagttgggggcggcgacggtgcggcggcatcggcgtcggcgtcagggcgttgggctgggcgcgcggaggcgacagggtgcggaacagctgggcggaggcggcttggtgcggaacggcggcggcggcgccggatttggcgtccctcgccagatccggcggtccggtctcctcccgggacgatggtggcacccaaggaggcggggaagggagatgcaggcggcgggaaaggtggagcagcggcaacgcgcgtcgcctctccagatccgggctgggggagtggtcggcgccgaggaggtgcggagaccggcaggcagaggcagcgtcacggtggtcaggcgacaacagcggcggctcgctcccgccgtggtcgcggcgccgccgtcggtgtctgtcaagcgttggtgttggcttcggtaatgctgcggcggcgcgctctagctggtcatcccctgtacctggctggatctggccgtccgcggccggatccatcgcctccacgccgaatggcagctggtcggcgggacggctgcgtgtggacggcaagcgcggcggcggctcgctggcggccagcctcctgctcggcagggggcttctgccggtggtgggtcttgtcgttgttgatgggcggcgatgtgcggatgtggaaatggcaggacgacggcttgtgctggcgtgaagcaggaatggggcttgatgtccgtgacggtgacttcctcattgtcggccgagtgttctccctctcttcggtttccccccttggccggacccttttctagtcatggggaatgctagggggagggcggaggctccggcttgctgtagaagtttgtggcggatagatggcgtttcgagggtggccaagggcccgtcttgccattggttacaatcaaggtatgattgcttctaagacgtcatgaactattctgcggccatcgatgtgggggtgcttgtatgggtgatgtgaagatgctggcgaaagccttgccgtgcttttggcgggttcgacaacgacggcgcccgtgggtgtcgtttccctccttggaggcgttgtcatggcactctttcatatcctcacaaatctctccaggtgaaaaccttgttccgattttcggacgagtggcggcggcgtcacgcgtcgtatcctccttgggggcgtcgcttcggagaagttccaatgcatcgatgactattgatggtccttttcggttcaatagctttcatattttgtgttcggcgaggcttcccttcttgggtccgcttctttcttgtggtgggcgacacgctcttcggttgtttctgctgatgaagtcgaagttgctcactgatggggtgcggcgacgcttggcaacgatgacatgttgcagtctcttccaaggagttctggtgctggccgtgtgaaggaagtggctcctcagtggcttggctgatgtctattgttggatgccggagccgcttttcgctttggcgattttcgtcttcagtgttgttgcggttgtgaagtcggcgctactaggtcgctggggcggctagctcggcaacgataacacctcttctgcgatgtggaagctgttgtgtcgcttttgtgtttagctttgtggcgacgtcctgcgattgggctccgccgtcgttgttagttgtgtagcggtgggtttgtaattaaccgtgcagttgtatgatttttgggcctagttttccttataaactgggccaattcttttcttctaaatataaaagtgtggaactaagttccgccttaggttttaaaaaaaaaagataactgctagtgggtagcatgagaggtggatcgatctgatggaaatagcaaaaggtagagacccggacctggatagattttagtggtccaaacattctctttcagctagcgtatcttttgtgtgtgtgtatatatatatatatatatatatatatatatatatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtataggtatgaatcgagttattataactaggtatatactcacaatttgaaaattttgaaaaatttgagtgattttgtgtatttgataccatggtgcctgggcaccatggtgccccatatgagtgtcctatatagtaaatttgtatatatatatatatacgtatatatatatacacacatatacatatacatatatatatatatacatatacatatacatatatatatgtatgtatatatatgtatgtgtgtgtgtgtatatatatatatacacacatacacacacacacatatatatatatatatatatatacatacatacatatatatatatatacatacatacatacatatatatatacatacatacatacatatatatatacatacatacatacatacatacatacatacatacatacatacatacatacatacatatacatacatacatacatacatacatatatgtatgtatgtatgtattctattgggcattatgcttttggacagcaaaagattgatgatttattgttattttttgggtagctttactctgataatgcattgctaaagtgctgatggttagtttgcatgcagccgcaaacaaccatatcaaagagagcgatataatgttactgacgagtgttatagaaaggtagcctggcatattctacattagtaggtcttgtgagttgctttttcttgttcaatgaaaagaaatcttacgacatatactacctctatttttttatttgaagttgattaattcaaaataaaactaaatcagaaaaaagccacgaggaaattagccatgcaactacatacatggtaaatcaaatcggtccgctaacgaagatttaatttaggagttggagctctataaaacatgccgtaaggctttgagctacttggcaagttattcagtgcatataaagcattatgtactggctattgctaccatatatcatgtgtgacaggtgggaccaaatattatttatatcttatatatttatagttaactattgtatgtttcaattgactataaatgatttggagctaggtagctatactattcaacttgctcttagtagagattaatgttgaaaaattaaagactttggccctttattaaatgaggtattggatagtaataaaaggacaattggggtaagatagagaaaaaaaatagtacttcctccgtcccacaatacttgtctttctagcattcaaaagttgtcgcaaaatagttatcacttggaagtactacttatcacatcaaccactttcaattcaaatatcttctcattctaccctcaaccaccatctcacatacaactatacattattatctccgtttcaggttataagactttctatcattgcccatattcatatagatgttaatgaatctaggcatcatacatatctagattcattaatatatatatatgaacgtgggcaatgctagaaagtcttataatatgaaatagataaagtatttattaagagatattatagtttttttctcttaaccttagtacatgctaaacaacctaaaatgacatgtattataagacggaggcaggattactactccataagtaaagtgattgatgggacaatcagtattataaaatatttatatttgtagataaattttaaatgttttaagtacttatatttatattttatatttatatttgtggatagaggtagtacctgatttgcacatgtctggttccctgtatagtttgctcgggcctcgggaagacatgctgagtgcctaaggtgagagaatctttactaaggtccagttcaatctgaattgtgccaggtagcctgtcgcatgtggagacagccaacaaggtgatatttatcgatacatgcattacgagtgatcagacagtagaatggacttctcgtctataataaaaacataaactcgtgaacatgaagaatgttgagttgagttcgttcgacggtattctttgggaaatggtttagccaggtctacaggtcattttggtccaaccaaggaagctgtaggagtaataatattttgacaaaatttgttctaggataattagcttatgttcttgctgctggaaactttaaaaacgtgacggggtctaggatactcataaacatagtaatttactgagggatattgtagccattattttattatttatgagcaaatagagggaaccctgaaaaaaagagatgttttttttaatttgcccctcgagacaacaggttgtaatacaattgtgtgtggtttaaatcagacctaaagccatattcccctcccaatgccctcaccgaaacttagaaattggtggtagcgggaatggcggcagccattacaagctattgccacatgaacaaacttgtcttttctaaatattttttactccatttggcttggaaataatataaaatagtagttgtggtgtctcctagcacattaggaggtttttaggtgtcctataaatgtttcacttttttaggtgttcagtagcaaaggaccatatataaactttaaacgtcttgtattaattttttcctcgtatttttagttcaaggatatgctaaagaaattgctcatagtgctagctaatgatgtcccaattaaatcaaatctagatattacataaaatatgttgctaatttctattggaattgtgcttgtggtgagatccaaataatatatcttgtggtgttgttttctcctgaagataaagatgaagatgaagatgaagattaggattaagattaagttttttacctaaaacgaggtagtattaacgtatgatgattgagttttaattattatataaacttaaaaaatagattaatatgatattttagagaaactttcatatagaaagttttttacgaaaaacaccgtttactagtttaaaaaatatgccaaaaaatcttaatcttcatccactctttttggagaaaagaacaggacattgctcctttgcagctgatgcacattgcacagctaggcgcggccgcgcggataccgttctgccctgcaccactaggccggccggcaacatgttcttcgtttctgtgatcgtcgggactcgagaattggattctccctcacattaggcggacgaacaagccatcccgtccatccaaatcgctggatgcgacgctgcttgaccttctcgtcatcattcatcagtgggctgtctaaagcggttttcttcgtggagggctttcccggtgctggctgcctttacctttcatgagacctggacacatcgaccagcaaggtaaaggtacgacaaaaggaggtgagcaacgttcctccactagcccacgtgtcctctcctgtggctcccacgaccggggtaaccgtgtcacgctgtatatatcctttagagcttaggtttgacactttagtgagactacatatagagcaagttagatggtactagaaaagggaattaccgttggttttattttgaggctgtgtttagttcccttcaaacttctaacttttccgtcacatcaaatatttgatatatgtatagagcattaaatatggacaaaaaaaaccaattacacagtttgtatgtaaattgcgagacgaatcttttgagcctaattatgtcatgatttgacaatgtggtgctacagtaaatatttgttaatgatggattaattaggtttaatagattcgtctcgcagagttatagaattggttttattattagtctatatttaatacttctaattagtgtttaaacatccgatgttgctgtatctaaacaggccctaggttacatcgtttctctagggttccctttttcttgggtttctttgccgggtcggccgaaggaaatatcatttttctaggtgtcttttcgttttctgagggggcgctccgttgcactaacctgtgctgctttgaactctgttggctcgtcctatttctatgtgcgtgagctgctgatttctctgctctttataaaagtcgacataggtgatgacggttcatgggatttagagtcgcacgtttgttttttttttttaacaaattggagggtcatgcatacacgatactgacttataaaatagtatacttaagatttgaaggcttaacttcataaggtgcacggacgtgttttgaccatcacacatggactttttgagacgcaaatattacgtatggaactaatattaaataattagaaggggtaaaactttgaacccaaatcgtctaacccaccaccttgtagagctagccgaaagatccctatgcgttttttactttttgagattaaatcctaataaaaatatgagcacatgtgtcaaatttgagacctaaacctaggtgaccttgtggatagattttataatcaaggattatgaacaactgaattatgcccagttgatatccattatattatatatggccttatcgttccgctgattagaggaataggccaaacgacatatttacaaacgaaaaaaaattgaattttttatatatgtgttctcaacgatttaaaagcaaagattgaaaataaatttcgattcaaaatcacaaaatcaactccaaattaagattgaaaatttaaattttgattgataagtataaccatgtataagcgaaacaatgatgcttatattactttgggaatcttgtagttttttaccaagctcttttcacgtggtaatgtcggctgcatgcaatcgcactctcagataccctcttttcgtttggtttcttaaacagagcacttgtatatttgatttactttcttgtgaatttcgtatgaagcacttcctcttcctcaaaatataaccatgtttaggatttaaaatctgtaccacagtaatgttttaggcagtgattccaattcaaagacgaaatatatgcagtttcaatcaatcaagtggttggcagaggaatttaagcaattttagaattcaaaatttgatcattgagtaatcttaatatttgccaaacaatttagaaatgctcatattttaagataaagggatgcttatattttaagataaagtcatgataaagttccatgacgcatttattattctttttctttttaaattggagaggcacttcaaatccaagagaattgctcgtatttacggctactttttttttcagtggtaggcaacgacgtaaccatcatagtgactagtgagatacggtcatttcgttaattttaaaatatattgtgcagtcttttgagatatttataaagatatggtatgtgtgcacgtttgtgaacacctgcgtttgtcttgtatatttttgaaaaatggtactaccgtgcaatggtgctgttggtgcaagcatgacataaaagcacatggcggtgatgagctcgtctcaaggtgcgcaaatgcaaatccatccaacagccaaacctaaagatcagcgtaagcaaatggcccaaagcccatgggcttcgtagagggcgcggcccaatcttgacccattctgctactctaggccctcccagccagagcactagagcagtgcagcgcggcggcgactcggcgccggcgtcgcctccgtggtggagctcgccggcggaggatgcctccaccgtcccccgaccccgctcctcgccgtcctcttctgtcagttcctatatcctatcatccttgtaggttacgattttttttccttccacatttcttcgaattttcttataatcatggtgcttagttagggctcaacacaatgcccatggccgatagacgtttacgcgagcgagcactggagcgcgatcctttctccgttcgtgtgatgaagattgttcgcacactgcacacggcctaagcgatgtcgataaatttctccctttgcacttttgctttgccaatcgtgatttggccaatcggctcgaatcaatgaactaatgtggaatctctaaaaaaagcttgataaattcctccttttgcagttttgccaatcgtgattcggggtcaatcggcccgaatcaatgaactaatgtggaatctctaaaaaagcttgcacgctctggtccttgtggcacgtgagcactcaagcttctcctcatttcaggatgaactccttgagcctccccaggaacatcaccaggataactatcagcttaccctcctcggtccacctgccgacgaacccgtaggaagcatctttgcaagtggcatcaggcttcaacaacttctggcaactgtatcctagtgagtagcctacattgccgaaagcgctgtggaaataaaatggcgttatttctgtttgcttgtaagcaaccaaaaaagaaaaaaaaatgacaggtcgtagatttgatatgttcttgcaaatttaattatgctggttcagtggttcttagtgatcatactaggcaattcggattttcagtgatgtaattttgatgtagccatagtttctgttatgggcagacaaaaaaaaaaggatgtgaacttgcctgattatctcaaaaactatgctgaagatgttgaaatttagtggatcagaagaaattgacttcctttctgttatgcatgccaggaatgtgaacattgctaaacaagaaagcttgttaacggtaaaattcctccacagtgctctgctaatcgagtttgtctttttatctgtcaagggctggttatcagcattggcagtgagaaatgaagcatcggaaggaaggtacctgcaagcaagttgattatctgttaacaaggagtaggaaacatgctgttccacataaaacatgttgtatgctgcctacttttcatttaaacccttgtcagaagttctgtcctatttgttcaaagtagtctcactttctctattcaacagtagttatttagatgcagatttgaagttcataactactatttcggtgacgtataaaatcgataaaacctagcaagctgcagtggtcatgaatgcatgtgtttagtaatcttcaaagttataaatgatgaagctatcaaattttccaacagtttctcctgataatttgttatgttcctgtaataactaatctaagtgttctactgatttagttaaattcattagaagacagggtttggaggagatactaacatgacgactgcaaatagcaacagagttgatggagaaagtgttgatatatcaaggatagattcaccggcttgtcttgtattaacactctggaataataatcctaccaatttctgtaaccaattcattccctctaagctctctgagttccactcaaacgagcaaataaacattacttgcagtagaatcagtccagtaacactcagaacaatgtaaacagaatttctcctcacatgcaaatgtttgtagccagtctccccaggatgctgaaggatgtaagcatactctgcttttccactgaccttccccaaaacccatacgcatagccgcaagagtggtgaaaacaaggtgttgcctgctagaatctgcgggatcactaggagcaaaaggacccagttctttctgaagggttgcatgttactatttagtggcgtgaagccacagtttgcgaacgaggacactgctgtgaagatgcaaaaggtatacatattgatctccttacttttcagtacatttcttgcatctgaatcaatccaaaagtaaataataatgatgacagaactggaaatgacagtagctacgaaataacctgtcactatgcgaaccaacacagcgcaaggattatatgttatgcttttgttttgctgtacctggttttgcgacatagtttcttctgattggccacattccgtaattttgtgatccccattgtttgcaggactgttgaattcaatgtccaagctgattgaaggtaaacttctctggctgttctcatttctgttggcattggcattgttgaagtagagccctagcattgatgtgaacacctctcctcccattagcatcagaaggatcagaacccagagttgcctgtcagataagtcttccatctctactgttgccatgctcgagacagtaagtgtagacacagaggtgaacaataggtccaaatcctttggacctggcttaccctggggcttgagattcttcagagcaaggaaaccagcaaatgagattatcacaaagtaaacgagctgaactaccaaagggttacttttgcaaaccagaaaactataagattgtttgacagaacttgccacacatctggctctggaaatgagcttcatggacaggaacccacagagatgctgagctttctcccaatagatccgaggcacctccgaattcggtaacaggagcttcatggctatgtatagtttgatacgcttcaaggtatctagcactaaacttggtggatgcattcttcaacaaattttttgggcttatagaaggtggtattggagttggcaacccatagtgtgtttcaatggcatatttggtaggtttctaatattgttggtacttgtgtaacgctgcccaatgtgaggatgctctgagcttaatatgtaggatgaaacaatcaacattggtggtgtgtactttttagagtcccaagtgtttggtctatatttgtagcaagaggagtacgttcagttcgcacaacaatgatgctgatggtaccttagttagcatattttgtggctgtggaacaagccaatccagggatttttggtactccgaaaaggactcgtggcaatttttcctacaacaacactattctcttgattaaaatatttcattttttttttgttacagattggtctatgtgattcccttcttcctgagcagtcaaggaagtcgctacacttgccagtgaagttggtccatgcatctgtgtgcagcagctgtaacctatcgacaattcgggacctcatccgcactggtaaaatgtacaagcattaacactagtgtcactgaatgtttttttatattcttctctctgatctgaacagttcagttcagaccccagttcagtcggaatggatacagcatgcaggtgagattggcaaacggcaatggcaactgatcgatcgagcagccgaaagcttcgatggaccactgtttgagtgatcggacaataatgcagtggatcacgcagcaataattgagagaatttttttcctttgggctccccgatttagtggctgggagagctcatgtgcggacaattcaaatccgtcagctactacgcgttggtttgtgctttgattggctcaccatctcttctacttctgtatgtcttttgcctcgctgaaaatctcagctgctattgagctcccaattgtgccactgacaggtacatgtaactgtttcttaacgacattgacgcgctcacgcgcatgcgccgctgcactggacacgcattgcacgctgccgcttgctttctatggacttcagttaaagcttgagcgtatggctgaagaggagtaagagaaagtcagaaagattttatctcgacttgttagcacgtttttccaaattattaaacttacctatcaaatggtatgtttcgttgaaaattgtctttgctttaaaatatcaaataaatctatttttcatgtttaaaatagggagaatagctaatatggtcactaaagtttcgctcctgggtcattttagttcttaatattttatattgtccaaacaagtcctttaaatttgtcatgtgggctaatatagtccttggtcccaccaaaatcgccacatggacatgccatgtcaccttcctatgcaaaatctatatgatttgtccaatttacccttacgcataggaaaataaaaaacaaaaggaaaaagttaaaaaaaatatatggtatatgcaagagcaaaaatatacctcaaaatggtgaaaaaaggaagtattttttcctatggttatgtctaattcacccttatatttatttttctatgatatacgtaagggtaaattggacaatttattatagattttgcatgaatgatgacatggcatatccatatgatggttttggtggacccaaagactattctaggttttatgacaaaggttaaggatttatttagaccatttaaaaggttagggactaaactgatcctacagagaaactttagggactaaagtagctattatctctttaaaataattaaaacttaggacctgttcagatagatatcatttcaaaccataccaatttttggtaaaattgtgaaaatatgtgcatctatttagtttcttactaaactctgataaataagtaagaaatcctactaaaactttggcaatattgtcaaattgccaaaaatttggcaataccaaaatttggtaaggtttattttggctataatccgaagagaccattaattattcatgcactatagttcaactttaacctgttttttccacagcggttttaaactgttcaaccagcattttgccaggatatttgacaccctctcaaggatctgaggttggtagagagaatggatttggctaacatggagtaccggccagcatgtatgacagatgtggacacggctatttgatcgatgataggtaacatgatgtggaagaaacatgatctttgtttccttctgctgatcaataatctttgcgtatgtggatgccgcccccacgatatatggacgcacaactagcagtgaacaaaaaagttcgaagctgatgactccgatcctctcgaattcgttgttttaataagtaagctaagttagctgctcataaattgcccggattgattttctttacggaaaggctaacgatatattgacagaaaatctatctctaaatcttgcagattttgaatcactggatgaactttgcgattcgtgctccaggccttatcctccaactccggcgacctcctcttcttctccggcgccggcgacaccctagactccggcagaggaccctacgggttagggtactaggttgggatgggggtgggagggggagggggaagagagaggag

SEQ ID NO: 13418 - DNA, 1180 bp, Oryza sativa
acccgggatcctaacccgtagggtcctttgccagagtttagggtatccctggcgccggaaaaaaaagtccccggagttgaaggaaaaggcctgaagcacaaatcgcaaagttcatccggtggaccaaaatctgcaagatttggaggtagattttcagtcaacatatcgttagcatttatcggcgaaaaaaaatgagggccttaaatgtgttgggctgatatatagcccacagtttattgggcccacttgaggaccaaacattagctctttaggcccattttttaggcccagtcgttggggaagcccgacgatggcgagcagtccgccgcaacagccgacgacggcggcgggaggcgccggcgttcttcccgccgccggcgcgcgcggtgcccgtcgccctggacgcgatcctgtcgcggcgcgtgggagctcggtttcccgccgccgacgatgtctccctctgcccgcctcgccgcgccgcgcctcgccgcgcatccgaggacggggacaagcccaatcaatgccctgccgtggcggcctcgccgccggccacctctgcaacctcgcttctcctggtagttcccctctttccatgctctgcatttccctgatctgggtgcccgtgtttttgctctcgtgctaatggctagcgaaatcaaatcccaatgcgtaatgcgatacgatacgcgttcctcgtacttttcccctcggtgaactgatcacggaatggattctcgcttagcccattcgaggctctcgcatcgcattcatgtaatatcgattgaattcctaccgaggaattggatatcgagacgaatttcgtttccccatgcttagggtgatatgatgatatcaactgattgatttacagtttacaccttcaaacttttttgcttataatgctcgtgatcgtacagtttactccctactgatgtagtgatgtttaattacatggacgttcaagattttcctcctgtgagggtgaactttttaaacctccccaggaacatcactaaaattatcatcagcttaccttcgtcggtccacttgccgacgaacccatatgaagtagctttgcaggtagcatcaggtttcagcaacctctcgcagctatagcctagtgagtatcccacattggcgtatgcactgtgaaagaaaattttgcatcattgcttggaag

SEQ ID NO: 13419 - DNA, 1579 bp, Oryza sativa
cttcagtgtgctaagcattgttgtcgaagttgtcaggcaagtcagactaaatggtttcttacctgagaaaaaaaatgcagaccaagtaaattaacaatttatctgatgaaaacagcaaaacacaaagtaacacttgtcaggtatttctgaatcttaataatacacaatgaaaatagtaatgttttctttcgtggaatctgacggatctgcccacatttgcagtgcatatggaaatgtggggttctcaatgggctacagttgcagtagacagatcaatccagaccatctctgcacagataaatggactggtttcgtagggagatggagcgactctggcaaactgatactcatttttgtgatgttctttgggaggctcaagaagttcagcatgaaaggaggcaaagcctggaaacttagttagatcttagatgcagtaccagctgaacattgcaggtccctgagggtaggaaaaaagtataaagatgtactctttctcttccgtttgtttgtatattcattttcacatagacaggaaccttccactgtcatccttgcacaaagctcaccctccactccaagtgttggcagtttcagatcaggtgaatgaaagttcatcacaagaaatcaacataggctaattaacctgattcacttcacatagagatgcttctgtcactggctccctgcaatgaccatttattgcatccatgtaatgctagtaaaaggccggatgtcattgtgatggctgcaatacttaaatacccacatgttaaaagatatgtagatgtctatcaagtggtgatcagttcatacagtacgtccagaagtactttcttctgaagcaagggcatctagaagaacctgagagctgagatcacaaagattgaaaaaacactagattgcttatcctagtcactacacttttctgatagaaattaaaaaggacacacgtgcaaccaagggtgcatcagtgaaaaaaagagagaataaaagggaaaagggaaagaaaatctccactacacattgtgcattctggtacacttgttcccactacagaagatgttgattatatagcaataaagcaaacaatctagtatttgtggaatctgaaagataaacctcagctacatacaaaaataaaacgaggtaacaaattgtaatctgttataataaatatataaatgttcaattaagtgaatgcaaaggaaaaccaaaattagccataactttgataccagaatcttcaacaatggactgaacagcaatatgcagtagtaaattcaaaataatggttactataactaaatttcagtatcatgatacacaggtgaattctattaggaaaacagggacaaatttgtagtccaaaactagttgcacatgcaacattactgatttcagctaaagaagaacacaactaattttttacaataccgtatgataataatagattaaaaaagagtgaattattgaggcagagcaggtttacgtgtgaagacaaacagctaatctaaattgaggatattcttatgactcaaaaaatgtgaatgaaggattctaattgctgacaatcatttca

SEQ ID NO: 13420 - DNA, 1110 bp, Oryza sativa
tgtttgcagctccttagtcattattatttttgctcagattgactcagatacaagacaactcctgaagagtaaagatatcaaaatatggacgttttccatcttcacagcagtatcctcatttgcaaactgcggcttcaccccggtaaatgataacatggcaatattcagaaagaaatccagtctataacttctggttaccccacaggttctagcaggcaacactatattatcgccactattgaggttaagcatatggatcttgaggaaggttagcagaagagaagaatatgcctacatccttcagcatccagaggatactggctacaggtatttgcaattgcagaagaattcagtcaacatggttctcactgttggggggctagttctgctgcaagtgatgtttctttcctattttgagtggaactcaagtgccttaaatggaatgaactgatttgaaaagttggtttgctcattgttccagagtgtgaaactgtgaatacaaggcatgctggtgaagctgtcattgagtccaatactagttctatttgcacttgtcatgtaagtattccctataaacatttcataatatttattattttgaagcatttatcaggactttcagaattttatcataaatatggcacaatcaccatcagtaactgcaaaggataaattaagcacataatttcagaacgaaacaacataaacaattatgagcttaaaatcttcagatattttttggttgaaattgcttagttatcttaataaaggaacacaaaactagttcacttgttgaaggccagccttatgttctcgcaagagtttcagtttaaatgaagttctagataataacatggaagtatgaacactgtctcggtgagaaacatacttgtttactacagctaagtcagcaatttgtgtactcgaaaaagaaaaaaaagcagataaatgcatagaacaaaatcaaaacaaccataaaatcctgcactatgacagaggtcacaacatggcggacaagaacagatcccacaatccagatagtcaattcatcaaaaaaatagaaaagcatgctaatacccacgtaaacttcaatgacaacatgccattaac

SEQ ID NO: 13421 - DNA, 284 bp, Oryza sativa
tacacttgactgcacgctggtatctgaggatcctgctcccccagtcccccgcgagcgagcggaggcggcgccgtcgctcgtcctccgccaccgccgccggggccgatacccatccatcccgcgccgcaagcgagtgcttccgccgcatccatcctggttgcacaccctctttcccatctttctctctctactcacgcacctaccgaattcgcgttaaccctaccttctgttctagaaattttgccttaaccttactactaatttcttcccaaaaagttttgggg

SEQ ID NO: 13422 - DNA, 412 bp, Oryza sativa
  unsure (1)..(412): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagtcagttgagccattgttttcatcttattgtcgcatcatttacagagaatataaccaagcaccagaatgttcttgcacgtcacctgaaagatcaaaccttagacaagcagagctgcaactccttccctgaattatttctcaataatgatctgcttttgaacatccgaagatgataatccacccaagggtgactttc

SEQ ID NO: 13423 - DNA, 2122 bp, Oryza sativa
  unsure (1)..(2122): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgcgtgatggggagcgttagctatactagcgtcgatcacggtattatgcagtcacgtgcgggtggaactgcggatatccgagcgcatataccactttgcttaaacctccatcgatcgatcacaaggttttctgctcatccagctatcggcctagctaacatcctagtcttttaataacaatcaacttaattgcaacgccttttggttttgtgcctacaagaattatgtaggtaaggaggcactagggaggcacacccttcccataaaattttagttttaaatatgaatagtcgagattacattggcgttcagatcacttatgttatgttctcgttcttaaaatgaaagcttcatttttttagctactacgttcatctgaaacttcttaacccaatagcatgtttagtttgattttacactaatgcctaggatagttttcatctccacactttctagacatataattgttcatgtttatagatatgattaaactttctttaaggacagaggggtactctcttgtgagtatttgagagtagagaattagagaagattgagaagatatacaaacgagatacttaaaagttatattaatatatttttttaaattaactttgatatattcgtttagctattcgaggaatgtgtatacaaaaaacgaaggacttttccatccaatctgcttccacctaacacaccctaatctgacgtttgttgcacgatacacctccgctgggccacacgaaaacgagatacacacatcctgcggagcatcaacgtacgaacggtcgccgtacgttcgcctcgcccaaccggcacgcagcttgcggggacgcccgaaagaccgaccgatccatccatccatccctcgtccccggctccccgccaccaaccgcccgggaccgggaccgtgcccgcagcagcagctggtcccgcacccgtacgtgcacgagcgcgacgtcgtcacggttgttgcagccacagcgcccgcccgccccctggtccccctgatcccggcctctcccggccgcgcgcgcgcgtaccgtgcggcgtcgtgcgtgcgtacatgcgtgcgccgtaaccagcagccgcgcggatcgatcggtggcgcgccccacgggccacgggtcggccctccttttgaggttgtaaagtacgccgtgcttatccgcgggcacgtacttgcttttccccattttgtctttttttctcttaccatgggacacactactacaggacgattttttcgtacgatcaaaatagattttcataggtaagtagtgggtgatccacatgagtccttatcgttttgtgagaggggcttgtccctctctcccaaacaccccaccccctaaggtgtatgcaaacaaaaaaatatgtatttttacatgtcggtaaaataaacgtgtacggtgtgtatgtgaaagttgtacttttaggagaaacgaattttgcaagtgcgaacagtctagagggaccctcgtccaggaaaaaaaaatcttttctaggtgacagtgagtgttgtaatagtgacagtgggtaaaaggcgtgcgaagtgatgggttcgtagtacaaacaatctacagctcttttttttggataatgatctgcagctcttgttgtagtactacgataagcggataatcatgcgtaggaacgaaacaaaaagtttcacgcgaaaaagggatagctgtgatgttgaggtttggccagtgtaggccacaaattttgacaatttaaccctttaaaaaatctaattttacaaatgaatcctcatcaaaacttatttaaaaaataacccttttgttcagcgtcaaatcgt

SEQ ID NO: 13424 - DNA, 6567 bp, Oryza sativa
tttttatttttcccatagcttttgcttcacacgttgtttgcaatgtgactgtcaacatacctgtctgttaatgtcaacactaacatgatctggaatttttgacagaccattagaccaagggtgacatggacgtgtgaaaatgtcaggcaagcaagcaaggctagctgtggactatactattgttaatccacgctggaagcttcacccgaatacggcatgtggaaagggatatggttaggtgtgttaagttcacgtcaaaattgaaagtttggttaaaattagaacaatgtgatggaaaaattaaaaatttgtgtgagtagaaaaattttgatgcttgaaaagttgaaagtttgaagaaaaagttggaaactgaaccatgccttacttacactcttctattgacctaaatatcttgtccatactgtaaatgattttatccatgtattattatatttgtgaattctcttatattttagacgtagatagtagttgtagaaaaaatgcttaagagtttgcacgtactgctaatttatgggtcaatctgggtacgccgtacgcttgcttcttcacgttaagaattgcagcattgttcctggagaaggaaaatggcgaaaggccgaaagttgcatcgcatgtgttacatgcatgcatgttttgttgaccaaagcttccgtccaagaacgtgatctcagttttcgtttccatttcaagcgaagaggccggggccctctgtcactgtgtcacatgcatgattttttttttcgaggaacatgcatgatttgttgaccatgcattaggcctaattaatcatgctgccagaggaccagtggtggtggttgcattgcatgtatgtagctcaaaaactcgccaattaaaccaaaccaaattgctgaacttgttttcagaaactggtaatcagtacaagacgtgagatgcacgcgtgttggattaagcagctaccgcggtgtaaatcagccagcaacacagtttggttaggacaaattaaaagattctgcaaatcagcgcttatcttcaagcgcggtataagaagttcacacggttgatcccttgtacagcttctactgcctctcactgtctggacgatatttcccacgtttgggcagaccagactctcaggaggcgacgacgcgatggcagctggtcagtgcatctgtgcatgaacgagcaggtttgatgccgacgcgcagcatgaagaaattcggcgccggcccgttgttgaggcgcgcacgcacgtttgatgcaattgatgcgtgcccgtagtccgtagagagagtgagagactggctgaagcgtcaccgagtccacccgctgtcttacgtgggagcgttgtagccgcaattggcaattaaaaggcacagctctagattttaaaattataatattagacttaaaatttatatgttaaattatagtagtttgaaattttatatttcatctaaaatatataaatacaataattcattcaaatgttaccaacgaaatcacgaatctaatatatggatttgtgaagctaaatcttgatactcgtctaaattcataccccatcccaaaataattttatttttcaccgtcttattatcttgaaataactttatctttcaagcaatcattgtatttgagtttgtgaaaatgagaacaaatgcattaggactagttaaagcaaaaggcaattgcattgagatttgattaaaaaaaagaacaatagttttttattggtacgtataagatgtgtgaaaaataaaagagtaaatttcagaaaactgtaactacagtgacaaaactatcgtttgacaaaactatcgttttgctacaacattagtgacttgtttcagtttgctgcaacaatagcaaaactattggtttgctataacattagtgacttatttcagtttgttgcaacaataacgtgggaaattatcacaaaactacaaacttttacgtgctatactgctacaggacatgtaggtgacaaactgtatcagcatatcacgaaaagttacagttttgtgataatttctcatactattgttacaataaactgaaatagattactaatgttgcatcaaactgatagttttgtcactaatgtagttttctaaaatttactcaaaataaaactattttgggaaaatattttgtgatagagataggtaccataaatccataatggcactcaatcaaatggtttaacccatatatggatgctcacccagggggttcacaacattcgctacctctcgaagggctaggcttggagcatcctttttctcgtagcaagagtctagtggggaagtaaaatgcaatccgtttttatagaccgtgtttcaaaatgtcacaagtcgggccacgtaatgaaaatacaactccacggaagcccccgtgtaaccaacaacatatggacactgttagatttacatgacagatcaataatgcagggagcgcaaacaagtacagaaatataaactttcatggggttattggtcttcgatttatactctgaagtttcaatgtgccccagaatatctcatcgtgctctacctataattccgttgcctaaacagcctattgccatgactttcagcccttatactgctacaggcagaatcgctgctcctgtcagaaccttggatcaggcaggtcaaaaatcagagggcagatgaaaaattcctgtgctctatggttcaaatctactcttgtttcccctgcttcctcccgaacggtcgtaccgtcggtgttgcaatgcctactgagtgggctttgctattgtcatttaaaggaccaattcgcaatgggtgggcttcggtattgaagacccactcatcgaaggatatgactgatggaggagagaacaggaggtataggtacttgagagtctctgctaggaagaagctttgcatcatgttatccttctcgccagtattcacctggagaccaaaatatttgacaagaatttgtgtaagtcttacactagcgctcagtgggaatttaagtatggatgctatcataaaaacaattaaaaaaagcttacatctctcagcccaacgtaaccagattctatgcgggagttcttttcaaatgcctggaatatgtcccacccccagtcttggtatgttttgttccccgtaagacgccacaagtacataagtgattcgacagtctcaggtctcaggatattccatgatgtgcccacgttcatatcctaaattaagaagctatcatttagagataaatgatggaatagtacgtgattattatagagaataaaataagagctgccttgctacctgtccagtatggaaaaaataattctccccagccaactttgtaggagttgtttggtagaagttataacaggtccgagcaagctaagaagagaacaaaaaattatatcaacaaaaaaccatgtctgtaattgatcgatttggatatgagttgactatgagacttcatacacattaaagttcatagaacgaaaagaatattagacatgaagataaaaattctttaagtatctagttaacaaataaggatttaagactttgaatatacaaaagtgagaattcctaaaggacttacctctttcgcaagattcataatttcttcagccttttcagtctcctcatagccagaggcccccagtgccagcataccaggggcaaaacatgcaagctcatccatctgtgctagtcacaagccgaaccagtgagaactcccgagagagaatgaaagttaagtccaaatgatcctcttgttgattacagccaaccaaatgggattatttaccttgtcagacaatgaaccaccattcttctcgcaaatgtagtagtaattagagggtgtagtttttttggtcaagcttagtaggccttccattgatgtctcccacatttgtctagtcaaaaatcatataaacagttatcaacatgctaaatgaaactgtatggaatttccagtaaaagaaatcagtgaagggaatatgaaaaggtgaaaagtgaggcttataggctcaaacctgtaatgctttacatgctcagttttattcccctggacccaaaccttgagcaagtactcgtagaagctgaaccacaaatgtagttagctccatttttcaatcattctacactcactaaaattagggtatgcaacagaaaatttatgaacaatccaatagagcaagttgcttaaaggtttgcacaaattaacatggaaagtactaatgttaatcacagaaggaccactatgttttcaggaaggaaatagcttgtttgaataagtgagaatagaagtataacctatctcccattgcaccaaatgtaattgttgagtacgacgcagttcctgaatgagggtttatgtatatagggagtaagccatcgcttgggtatatcttctgaagctgtctgatgacattctctgcctaaaattgtattgtatcaggccaaactgtgagttcaatattaagaaagccaaaaagagattttcaggcaggatttaaatttatataaattatatacgggcagatgccattttttgtagggctttgcttacgcacactggttagcaaaatattataaacattaaaagaaaaggcagtaataaataagtacgggccaacataaaccaatgatgtaggatacaaatttacattagggatcaaagtttttgatggaactcataccaattgatttgatccatgcaatagcatgtcaaataaataggataaggaacaaggttatttaggatctataagtaggaccaatataatcaaattgattatgatttggatatattttctatttccaacttataacagccttttctttgagacactattttattcttgaaaggagatctaaagcaaacctggcgtcatctgatagagagaagtcagtatatatacttaacccacaatactggggtcaagctaaattcaagaacttttcaggggaagaacatttgtatatgaagaaggctatgattttgaaggccatccagaaaataaaacactttaaatatgacttatgaactatcacaaaaaatcatttattcccgcagtcatgatttgagtacttatgtgtgtcacaaaaggaggcatcaaggagatttggttccagtggttatgaccatagcatcaagtgaaaaagggatgcatgcatgcacatcaacaacaaagggaacaatcaaagtattatatatgattacaaggtcctttttgcttgctcaagagtcaagagccaggtggttagtctcacgtcgtggtttggtttgtgggtcgtggtcattttatctgtttgtgtttgtggtcgggtttgtgacacgcatggttcctagaactcagtgtgtgcgtgtttggttttgcacgcgtgttctaccccctcttcttcttattcgaggaaggaaatagaagccatgttttgcacacaactggttgcacttaatttaccaagataattgcataaaactggcaggatgtatgaaatatgagtaatctgtagaaccttttgttgatacttgggatcaccagtcctctgtgacaaagctataaattcaagttgctccgtgccagaatcagcaaggatactatcaccctgcagaaacacacaatgtacatggttcaccatccaaagagagagaaaatagtttcaggtcaaatgcatttataaacaatccattgagcaattattgatgtgtttttataaagattatgcagctctcttgactattcgagaaaaaagtgtttttacaaagatattggtaatatcacattaaacttctaatttgatcagtttttttaaaaaaacttctaatttgatcactgtggagataaggggctgaaacaaattataaacatgatgaattaatcataaagatgtatgtgatgacatgtgattcaatccctcgaatgaaaacagagctctaaaggaacaacaaagtttgcatcattatgaagaaaaatgggatgctgtgaacatggttaaaacagttagctgtaagcttcagtgtgcttagaaggaacactccatgtaattgactaccactagcaaaatagaatctattactcacattggtccatccaggattatgggctcgtccatgagctaggttgattctattataagggataccagatggtgtatcccaagcaggtagtagacggtcagtaatatctttggccttctcaagaaatactttgtcaccagatagatcatatgcactgaggaggcctccaacaactctgaatataaaaataaaacagaaacttagaaaaaactagatatacttttatgttctaaaaaatgtggtctgcctacatagcatcgatcaaagaagtcaaatattttaagaaaaaaaatactacaacaatagtaaaccttataaggcaaccttatggtcgtttcaaagacacttgcatcgtaatccttgtcaaagcttagtgaatcggccacccagctggcatcatgaaatagacatcgactgaattagagtatgacataaatcataagaagatactccactctgtaatggagctataaacaagcagattag

SEQ ID NO: 13425 - DNA, 6238 bp, Oryza sativa
tgcaagtagttcatcaacaaggtaatattcctggagctttgaagccatcaatagtggagaactaaatcataactgcgatatctttattcaacagaaaatcgttgaatctgaactgcaagatattttcctgtacaacccaatatctgccatccgtatattcatttgcatttactagcactagactgagctgttcaacaagcagcatttaagacaacctcgcaaataccctactccctccggttccattttaattgacgttttggacaatgacacggtctacaagatacatctttaatcttacttttctattataatatatataataaataaatgcatgtttatttttattatagtactttaaaagacaaatctatatatgttgttctagttcttttaaaccaaatatttttaaagttattaatggttaaagttataaaagtttgacctcaaccttgtccaaaacgtcaattaatatggaaccggagggagtaccttgcactttcacaagtataatttaaagccattcatctgtagcacttcagaatgaacaattcaagatggtgacgaggcacctttcagatagcataccttacatttgtacttttaagttctaaattctacaaggaactcaaacaataagagtgaacagaggaatatcaaaagtatatgcatactccaggagataagatatgagttgactcaaactgaaataaaacatgccaacagcccaacagacccatgtgattttcaaacagaccaactaatccatgttttcttatggtttacagaagagctagattgacttgataaatccaaaggatgaaaattgatcaaaatatacattcatgactcatgtgtggtatccttcaaattagctgattacttacaagcctcaatgaacaagtgggaaaaaacaacctaaccttaatttcatcttgtcaaacttaaattgacataacaccaactacatctctgacatttgttttctcctcaaaatacataacactataggaatttgtgatgatatcctcctctaaaataatcacaaaacagaaatttttagattttttagactacaccaatctcagtgagtatgctgtaaactaacacatcaaagagcataaaataacccagttctccaaatctacaccttctattagtcctaaaacatagaaacgtaaaactttacttccacctgaaataaataggaatagttcagaccttcccatttacttaatttaacgagaaatcgagactacgaaaatctcactgtaccaagagtggccgagtacctccactaatccttaaactaacactgaaagagttcgaacattttaaccgaattatcatcacagctgagctaaccagaatgcactccatgtggttgatttgcaaacttccagattctcgtcccaccagtaatccacagaacacaacaaaaacgaagactggatcctgaatcctggaaaaaccacactctgctccgcaagcgcacatgtcccaaaaccacccgcacaagctctcgatactcagatccagcgaccaatcatcaccacaacaaacaaaaaaaaaaggaaatccgaagctaaggcgggcagcaaaaccggtcagatccccgccgcctcaacccggatcaggggaacttcaacgggtgggagaggaggcgcgaacctcgtactcgcggacgagcgactgtcgatcccagaaggcgaaggtggcggcgacgaagacgaagaagaggagggcgaggcgcttcggccgcttgaggtaatacgccgggttgaggtaccgccacgcccccgacgacgacgaggaggaggaggaccgacgagccatggacggacgccgcccgcggggaggagatcgccggcacccgagctcgccacctccggcgaggtctccggcgattcgcgcgtgtcacgccgccgcgtgggatgtgttttcgtgtgtgtggcgtttgggggtcggacctcggtggtggctcggtcgtcgttgaacggggcctactgccggtaaataaccacttggtcattagagcaggtataatagcatatgctataaaccagctgtaaacatattttaaggagataaataaagagaaagaataacagcgcgctacagatttatagctagctgcagcacggactccaagacgcaaggtgtgtatgacaggtgagaccaggtattaatagtgtactattttactattgtatgaatgagctattagattgactatagataaattagagctagtagttggctatactattaaacttaaacttgctcctatacactgattttccccctttttaacttacagcattcctctttttttttcttttgaaaatacttcttgtccttttctcgtaacaaattgatgttattagctcattcatgttttttttacatagtagacttaattaaatagtataatatatcaacactatgttaaattaacatgtgtaccattttcggccgcttgtgtttttttaagtgaacaacgccccaagcaatgtgatgtttctatcaatatagtccttcaattttgtattataagtagtttaaccgttgtggaaatataggctgatttgatttgatgccctatcaaatcattggtagtgctaaatcttagttatgttttgacactatcaatgttttggtagatttagactatatgaattgtattagctatggcaaatattgacatcaatccaaacatctacaaactactatttaaattgccaactatttggttgggcaagttttagcatcaaaccaaaacagccctatatcccatgaacgctaatcagagatttccgtgtgagtgggggcgttggcttgcattacattagcatcatagcgtgaaatcccactgtttcatgaagaaatgctagcgattgattaccggtgaacatactcgtttctatctctccattttagtttttctacataaggcagagcgatagaaacgataaactttttgcctctccattttgattttatgaacgtagacagcacgccatgtgtacaggtgggtaggagggatcaggtacaccaaattggtcggatggagcacgtttttgacgttgggtctcacgcttcggtcgtcgcctcgatcaactttccggctcaaagtgctctgcaacagtgcaactctacactgttcgcatcacgggcccgcatgctcgacatgctctgcacctttggtgcatggcaacctactcctctcacaacacaacgaccatacatgcaaaggaagtagcaaaagcagcagcagcttacgatgttatcaatcggaagtagaagctctcaactactagccatcacgccgttctcaacaacggggagcgcgaagaaaaacacgggccaagtgtcattttcgaccaaactactagcgccattcttgtcagaatcttcacggacgttcagagctaagaacagggacattcacaagcatttgtcacagcctacagggccgtgcagattaatgaaagatggggaatatacagcgtacaggttacccgaagtggcagcattcagtactatttgtcaccaatccttcagaagtgcaccggcgacgtccttgtaactgacctttttcttctttggagcaccagcagttggatctggggctggaaccccggtactctgtgtggagcttcctgcgtgtggtgccggaacaccagaactggatgcagaactcgctgaggcctgtggcactggagccacgtaactggatgtggagcttcctacccaaggtggattcgtctcagctttggcttcggcaaccctgttaccaacgtccgtcttcatctggccaagcgatggaatcatgtccaggagcattgcgtgcagcggatcaaccatctgttccatcttctcgcacgttgcgctactcgttgtttcagcggtgtctcttctaagaactgtttggttgcgttcgtgttttgggctgcttggtgtctccgtggtactcgatttgattcctttgggctcctgctcatccaatgtgataagctgggcacctggaggtggttcttgatccttgtcatgggcatgttcttccatcttagagatggaatctgcgttcaacttcttatcatcttgacctgtttcaccaggacctgtttcacgatctatctttgcaagccactttcctctttgagcccttgatcttcggaccactctaggagcggttggatgtgccccctggtctctgtcactgctatcttcttccatcttagagatgtaatctgcatccaacctttgatcatcctgtcctgtttcaccaggatcactttcttcagattgaccataatcgattttggcatgctgttttcctctcctagcccttgttcttcggactggtctagcagaaactggtctttgtcaaagctatctacttccattttagagatgttatctgtgtctggtatttgatcatctagacctgtttcaccatggtcactttcttcaggctcaacatcatctatttttgcatgttgatttcctcttctagctcttgttcttcggactggtctaggagcaggctttgcagttcttgaggcactactggatggccttccccttttccttggtgcatgcttaacatgagatgtatcagccttctcattttcctcaagcttgtcattacaaggctgaacagtttcctcactgaaaacaaaacagaaacttcagtaaaaaataaaagatcgataacaataaaaaatgcagatattgcgaatgctgaaatacaaccatcccgcatctaccttcgttcaatttctatttcttctagtgtatccggtttaaggctgtaagtggtttcaggcagccttgtttgtttttccactgaatcttccaaccacttgttactgacaacctgcaatcttttgtcatgtagataacgcctctcggcaggagggaggctgcataaaccagtattttcataagttttcaaatttccagctgtcagtgtttgaagaaagaaattcttctatcatagaacagaccaaaaaaaaattaataaataacctcttgtacagcatgtcaaaattgtaggcttgtagaactgaaactataatcaaatgagtagcgggagcaagaatgctgcacacttgaccaccatgcatggtaaggtcctgcttcactctcttgagtgcaagatcagatattacattgtagtccgcattcctccagaaaagaagagcatcaatgaataaagaatcacattacatgaaagatgatattgaccgcaaataaaacttacaccaagggtgcatgatagaagtagacacagcaaccctggaagaagcagaatctctcatctgcgcaatacttctttttgtagtggtgtaccatgtttgaatcaacaacagctctgtccatattgctgaaaatctgaacaatgtacaaagaaagaagaatcaccaaaatgatcactgtatttagtccttatctattggttctctacttggataatatttccgagcacaatagtagttttcagacaaacttcttaatatcaaacttgccaaacttcttagtaacaaagagtaagtagcttatgaaaattgggaaatatttttccaaatttatcgttggctgttatcatacaaaccccaacagggaccattggatgaattttcgtatgtttggatggatcaaaactatggagattaagcagggaatccctcatactagatttctagtctcatatacttgtagtattgttgattgcacagattttaactacaggaataccaatttagcacccagaatgacatatctggcattatgaattacagccaaatgcatatacgagataagcatttgctgcatacaggaaaaagaatttacctgcttgaggtcagaaatatcaatgtcccagtagaaatagtcggcatatgagtcgatctcttcaggaaatttgtgccttgcaaaatctgcaagaaagaggatatacctgcacagtgaaatgagttagaatatttttgacaagaaaagttgatgaaagaaacatgggctgtaagcaagggtcaaacttaggctgcaaatgaagaaggcgtttttccttgcaacagtctaagatccaggaataatgaatgatccttccctgccgtgtggctgcctgatatttgatacctgggaaaacacaagagaataacttgaactaaattactcaacatttagaataagagaaaacataaggtttctcaacaggataaagttaatacct

SEQ ID NO: 13426 - DNA, 1027 bp, Oryza sativa
agttggagagcaaatcagcatgttgtacaagaacaaatctttcccgagcataagacttttaaagatagcaaagcatcaatgtttatccataatttgattacctcagatttgattgttcgaatatcgcttgttatggatattatgactgacctgcatttagtgatgcagtatatcagatgcttcctgaacctgacagattgtctagcaatacaccaagaactcccacataaaacttacttatcagggctttctatccaaacatctggcctctcctttgaatggtttgtcacttcataaaatcttggtggttttttggggtattcatttttcctgattcagaaatagccaaatatgaggggataaagtgtccaagttcacacgctctaaggaagtgcgtctgcaaaattgtgataggatgcaacagaaaaaaacaaacaaaaaggtacctgaaatgaggcttcaatttggtgacaagagcgtcaagctcttcatcagaaagaccagtaccgactcggcaaaaagaaagaaatcttgcaaggaaaaaaaaacattaaataggagacataactcttgacctgacagagcataactattaagactaacattaggaaaactgcattcccgttgttattaagatctccacacgtagttttccacagacaccgccaagtataaaaggagatggtaggggaaaagggtgttcttaccttttgggataactattgtcgtcagaaggcactgcaagaccaactaaaaactgggcaacctataacaggttaagaatggtcagcacttttttatagcattcttcttgaaaataagaatatcaccaatatatgctcccagtaaaacaagaaaaatgcagttttttgtccttgagtggttaggacagatacatgcaaaaaagtcttagaaaacatggtaggatatatagcacccttgcagcatagccctaatgtcgaaactggaacaatagataaactgtgtaattcaagataagagtatgtacacacctctcctcctcgac

SEQ ID NO: 13427 - DNA, 13338 bp, Oryza sativa
  unsure (1)..(13338): unsure at all n locations
tgtagatatgctgtccaaaatcaggaggcaaacttgcacttgcagatgtgatttagcttttcaacccttcaaggaattgccaccagttcgtgatcctgattatctaaaggactagtttgtaatacatgcatgtagataagcaaaaggttcgatcgaaatgacaaaggggagaaattaaagtaccaaaaagggaaagcctggagaatttgtcctgcacaagcagcaaaaacagctccctggtaacaacaagcacatacagttacaatttacatgatgatgcacaccggacagaacttgtttggaggctattgcatcataggatgcaaatggtaacattaaacttcacatgatgcaaacagaaataaactccatgtggttgaacaatctattattagtaaagcgttacatgatgtgcttcggagcttgtttggaggacacgtagcactgtaatatccccttgttttgtgcttattaaaattccatttcttacctccttcaatgcaatagttagagctcctaccccttttggcatttttgctgaaaaaatatcatcatcaaaatgcattaccaggtgagtcaagtgtgttaggttctaacgtataaggcagatctctagtattcctttgctaaaaaaaggaagatctccagtaacaccttttccagtcttactagaatgtaatcgtacataatagtacctttttttgcccttgcatggaactacagaacaatgcatgcaatttatagtaacacagaccatttttttattttatttcgcagcccatacatatactaagtctaaggatgttctcatgtgccatatatgtgaatagcgaataataaggggagatctcaccatttgacaacacaatgctccagctaagattggaatcctaacaaccttacaaacaagtctactgcagtgatgattgtatatgccacgacagctaaaccacatcatatccgatgctgcaagatgtcatatatataaaacggaaagcaatactgccaattgctgctaaaggcaaatatgttagaagacttttgcttccactgaatgatgttttttaagaatgatgttaactacagctactgctgaagattatctcaacaaaaaaaaaagctactgctgaagactaattatatacacgacaacactactatatacgttgttatatgtacattatttattgcataagattctgctaattaggcgatgataacgagctctgaaagaaggttatattgaaaacaatagccattgtgtctctccagaaaaaggaaaagaaaacaaaggcataaagcatgaatttaaacatcttaagcagatgcctcaaaacaaaggaacctttcttttacaaagttgaccatataagattccatccacctaaaattcatcattaaattcctggagtttgaatcctgaaatttcattctccacctcaggttctgtaccttgcatgcctgttgaaggaaaactgagggctggtgccttccagttcctcatattctgttggcatccattttttttttttttgacgcaatgttggcatccaatttaataataataactgaaagatggctcatatatctagttcacagtcttgcaaacctttctcaatatggaacgaacttgtgctgtatatgaaacatgtgaataatctgggatcaactggatgattcagtcaaatttgccaactataaataaaactatcaacaggtattcaggaatctcaatgcaagaaagaatacataagagaaattaggattttctccactaagaagaaaaaaggaacctaagctcaaagcgaggtcaaacccaggtgttgtggagggtggagatgctgaccttccaccaagctaggctcagttacataggattgttgaattaccgaagtatgtacatgagcttcacaaaattgatgaagcaacaaaacaacctttctgtattcagagttgacactaattaacccagtcaacttggcataataggaaacaacatgtattggagaacataggtcgcaataacaaccaaaactaaacatttctgtgccctgcacatgtggctacatccccgttgcagaaatagtgaaatccaacatttgcagtattcaataatcatgagtgaagtatacataaagttgtacagacatgcaaaaaggaaaatgaatgccagattcatcccacacgtcaagatccaaacaaggcaagttgtacttgggacatgatgaaccattcacattggttcttgtcttcttttttcctttacttctagatcaaacttgatattgaattgcaggtttgtagaactttgtatactacggtaatgattttagtagcaattttcaaatcattgcaacacagggcattcgatattgggtacatgaattcccatgaaacagaaactttctttttaaaagcatcaagcacatttttattataatagattggaaatttacattgaggacacaaaactgcattcaaattgaaagtgtacacaaattttgccttgtaaagtaaacttatatatagctatatcttttgtactatattgcaaaattactgaagaatatatatattgtagttgcctagaaagtcataacgcaatcaaaatagatggaacaatccaatgttttcttcttcttcttttttgcggcgaagatggaacaattaagttatgattacattttcagaaagaatcttcaatgaagcattcaacaaatcaacttacaagcagtcaagcagaataaactagcaagaagagcttctaacaggactgcaaaaacccataggagtgattatatctaaatgacaatgcaactgaaaacaaaatcttaggatggggagacattaatgtggtgtttaaatgtttcattgacaatatgacaatgacaaaaggaattagtatgtgtcaaataataaattctaatgcacatacggaataataagaggatggcacaatttttttttttgggagcagcttagctctagctaattactgggttgtttttgtgtggtcaccccccacctatcctatcttcttactgtttttagagaatatgcaggaattgtgcttcttcgctttgagataggaagtgagataggccaatcctgtccatcaaatattccaccataaaacaaaaacattgcaggaaacgaactgaccatttctaatatgtatagagaactagccttgtatgcaacgaaaaataaaataaaaacctataaatacaattcaaaagaacatgctgctagtatcttaagatttttaacaactggagggggaaatatatttttttgccaggtcggccagcaaggccgaccaaatttcattaagataaacaggggtacaagttacaaaattgttactttgacaatggttgccgaaagcagggcgagaattgctaaaaggctcagttcttaaaaaaattgccaaaaagcaatccgcatgcagaaagaaaaacctgatactagtgctgaaaactagccattagcttcttttaaaaattttgcttgcgaggggaaaatatatgttacctgcgaacaccacattgccaaaggtgtttgttacctgcaaacatagtggacatagcgtgtgcgcgcgcacacgcaaccagacgaaggtgaagcaagctcgttgaactgtactcacacacacaccccaaagaaaaaaggtaacacatgatatatactccctgctcaacagtctgctttccacgttccttgaaagctgagagcatgctcagtctgcatggcaatggttgacagtatcagcatggagcgtacatgtgcagagcccatatatagagccacacatggactatggtgatcagaagaattcagagctgacaggttgcacgttgcaactagcaacaggatgacatgtagtaagcactaggcatttctagactattcgcttgtgcattacacaggaaccaacctactctgccataaaaaccatgctaacgagaacgttcaccattgctcaaactgacaactgaagccgaacgtacatgcagcaaaacgcacaggtaatgtctgggcctccgggcaatggagatacctggaagacatatctaaacaccctccgcagtttctatgtgcattttgcctaaaaaattgattctacctatcccgtgagaccaattccccacgagcgctcgctattcatcaattgattgaagcgccctcgtaaccctcagtaaaggttccgatcacctcatctgaatactggactggaatgcgtaccaatcaggcactcgacaagcgcacacgcgtagggttcgatcgcgtgctcacgtggtgcgctctccccgcgccttgacagatcaaccggttaaacccacaaatccaactaaccccacacgcgtaagcaccgcgatcgcgcgcccaattcaccgttcacgcgtccggaaacggaacacctagcgcacgtccggtcctccggtgcgagagaggatgtggctgtggagacgaagggtgggagacgaacctgaacctggagaatccaccgcgcccgcccatccacctgctccttctcctgcgtcggcgccccgctcgaggagtggttcgccggctcgcccgcccaccgcttccgcccgctcaaatccggcggccgcatacagaattgggcatatccccccaaccaaatgcggcgccgcggatttagccgcgccacccgtacgccttgaacccccgaccaccccgcagccgcgtggcggcgagatccgggaggagagggcgcggcggcgcggcgcagcgcggcggggagtgggggtttcgccgcctcggaaaggttcgagaggagcgggaggtttcgggtgggcggtggcggtggcgatatggcgcgcggggtacagtggccgggccgccggggggctcgagacgtgcgtgtaattaatggaggagagagacagggattccttctccatcctggccgttgataggatgatccgatggctaaaactgactagacggcacgctctacggttttctctgcaaggcagaggatactgttcacgcattgtcagagcctgtcaaaaaaggccttttaggattttgggctctgccaattttgcgtaaaggcccataaaggcataaagaaatattatttgaaataagttcaccggaggtccctcaacttaacagcgagattttttgagatcccttaaccacaaaaccagaaatcttcacccctaaactatacaaaaccgttcactcaaggtccctagacagtatatatgggtggtttcgctgacgtggcatcctagtcagccaaaaaaaaatttaaaaatacgtggggcccacatgttagctgcacattttttttcttctccttccttctccttctctcctcttttctctcttctctatttctctttagtgagggaggccggcggcaggcggagcagcgcgtgcggatgcgggtggcgcagcagagggcaagcgcggcagcggagcggcggcaggcgcaagcgcagcgggccgagcagtggagcgcaagcatggccgcgggcaaagaatcagagggcgagcgcggcggcgggtggagcggcggaggccgagcatggcaccggagcggaggtgggcgagcgcggaggcgcatccagcctaccccaaccgaccaaagcacgccctttgccctcgaccataagccccgccgccaagtcgccgtcgccgtcgccgtcctccccgtcgtcgtcgagcggcagcgatgacttcgcggtgctcctcgacgcggagctcgagctcacctccgccgctgactcggcctccgccggagacacctccgccgtcaacaacgactatgaggaagacccctcccaaccttccctccttcctcctcgagctccctcatgccggcgccggcgcctgcagggatgggaagccgacagtgctggccgttgtggtcagctcgcttgccgcggcaacgctggtcccggcgctaaccggctgatgcgtctgcggatcgatgccctggctcatgagcttgcgcttgatgtgcgtgttccacctgcagaaccaatcaatcagcaccaagaacacaagaagagctaaccggagcagatgacaacacgttgaaatttgttttgcttacttgttgccgagaagggcgtggaggttgatggtgagctcgtcgtcgtcgtcggtgaagttgctgcacttgaggtcggggctgaggtagttcatccagtggaggcagcagctctttcggcagcggagcaaccccatcgccttggggagggagagagggtcgacggggagagcgcgtcgctcgcccggcgggcggcgacggggcccgtggtcgagcacccggcacgttcgaacatctccgacgcagagctcgccgtcgcgccggcctccacctctcctcctctcccgccgccgccgtcgcgtcgaccgcctctctctccctctcccgccgccgccatctccgctccgccaccggccacctttctccccctcggtcgccgtgcctgctcgagactcgagagatttcggagagaagagaagagaaaaagaaaaaaaacagagaaatgtgggacccacaccattgtctcacttacatgtgggccacacatattaaatttttttttgctgactaggatgccacgtcagcaaaaccactcgtatatactgcctagggaccttgagtgaacggttttgtatagtttaggggtggagatttctagatttgtggttaagggatctcaaaaaatctcggtgtaaagttgagggacggcggtgaacttattccatattatttcatggtttcggaagctacgtattgttgggccatagcccaaactgctgatgttcacactcaaatttcgcatcaaatctcttgtaatttaggaaaattcggaaatctaatggcaaagttttgcggcggtgctcccgaagcttttcgtacacgccacagcaggttactgtagtagcagctatcacatcgttctctgacgtgtcgtcagctctgcacgccgcgaaggccacgtgtacgcgcccggatcgacacgtgtacagccacgcactagaccatctcgaactcccaaagtcccaagctctacgcaaaacgcaaaagcatggacgaatcaaaaaaaatccaaactcttaaaactcgcgtcgaattcaacctggtccagcaaaaacaaagtctcgatcgaactctgatgaagaaaataggaatgtctctggacaaatcgtgacgcgacccagcactcgcatttgcatacaaaaacctgaggcacgctgatgccaggcaaacctgacgaagattagatacagcagcagatcgattctacggcgaggacagcgagaagtcgatagccgcccatacgcggccgccggcggcgagcgagcgagcgagcgcgccatggcgaaccaccgagctgtgatcgcggccgtcctcgttttctgcttgtgcttcgttcaggtggcccggtgcgatgtggtcgccgccgccgtttctccgtcgtcgccggagcaggcgcaagagcttcagatgctgagagccaaagtcgcgtcgttaggtgagtcctgttcttgtttatttatatactcgtattttgaaaatttattctgtttgcattgttgaatatcgcaaaagatatgatagatcaccatggttttgttgctttgataccatataataacttggagctaccaaaaagttcaactcgttaataagagtcgttataggacaagatgatagtttggttgttccattaaccggattaacactgtgcaatggaaatttacctgattcattgttgtttactgggtgaaagaattacgttctttgggtttagaggatgagatcagtgggaggaaggaggagaccttgcagctggagaatgttgtcagggagaagtcagcacagattgcggcattggtgagcgagctagaagttctgcaggtgaattttattctgttttttcaccttattgtatgaaattctatgaattactctcttgaattttaactccgtatgctatattaacttttttggtttggaaactgtaataattaactgacaataacggcataaaatacatgactgctagttgaactctcccgtttagaaactgttggttactggttgactgtgcaacattacttagtagtccctccgtcctaaaatataacaatttaggtgtggatgagacgtattgtagtactatgaatctggataggctcccatccatccaaaagttttatattttgggacggagggagtaattaacttgaattttagaacaatgagtttcgagtcatagttaacatgatcacttcttgaataggaccgctcattatcagtgactaacagaagtggcaaactggcacttgtcataatcatatagtataacctcagcttagactaatcttttttttcggaactcttattcctataaatgttatctcgacttttttctttttatgctgttgaatcaggtgcctaatgttgctgacgatgaatcagtgctgaaggcaaacgcccataatgagatgcttgagaaacaggtaagataatcatgatttcaaaacaatggtattaattaagcctgacaaaaatggttacaaaactgacatacaactgtcaggttctgaggctgggtagtgatttagaggaccaagttaagaaaggggaatcactagaagcccgcgctagtgaagcagagaaaagtttgcttgagcttactcagaagttggaccatgtaagtactataagtacgcaatcgggatatactgtagtgttcagctgtttttcacatgtttgtaacgtaatttctaatttgtatcatacaggctgaaaagataaatatggagcagaagaaaaaaattgaggagcttaaccatagtcttcggcaagtccaggttgatacaaaaggtgtacaaatgaaaacaacctgaacaatctaatgtgcttatctgtgctttatgtggtttgctcaggataaactttttgaagtggagagggaagcaaagttgaaggcggaagagttgatgaaggtatgcaaattctgtcatcttctttttttcttttgtgaggtgtcctaataaaaaaaattgatgttctctttggtgcatttctttcttattgtcttgttgtggaatgattcatagatccgtcctcctttactgtactctgtacatctggcaaaggtacataagcatttgagtttgttttcaggttcatggcatgtggcttccacattgggtcatggctcgttttgtgtattgtcaggtatagatggattcactggaatgttaacgttaacgtagttttctacttcaagttgagcttgtttttgtgcacttgcaggacttggcttctgacaaatggcagctccatgggaagcctgtgcttgatgctctggcgcagaaggttcgtttcatttttttttacttaattaactattcctcaaatgtttctaaatgattggcttaatgtgtcaaccggacagatttctgagaaccttgcacatgctcaaacattagtggagccgcacatgcaaacaacacagaatataggtttccgaattatctcttctatagacttgttaggagtaaaaaatgatgtacatcctatagactgatggccttcaaacaacttcttttcattgttgtgtatgacactatactagattttttagtgagcgtaatcggtagtcaagttcatgatcatgttttgttgaactgatgcacctcaattcacttttaaaccactctgacttgcattctttttttctaatgctaaagaaatcggttcctgctgccaaagcacatctcaactctctgaaaaaaagcaccgatgtatacgcatcggcaatagctaccaggagtacccaagcctatagagtttgcagagacaccatccaaccatcaatggccaaggcacaagaatttgcagatcactattggcaggtagcaatgcacacacccagcagccttttcatctcattctgtggttaacctactaaagtctcgctcaatcactctgaatctgaatctgaatgattttatccttctaggaatccaagaagttcaccacaccatacatcaccaaggttgtcgcagcatctgaacctcgtctgtcaagagtatgtgccgtcctcgaaccttacacgaggcctgtcatatctgcttggagaaagcttgttatgtcagcaagtgtaccccatcgccaggtaagcctttctaaccagttaaccctctcacaattcttttgctcatataactcagggatcttgtcgatgatgctacacaggttcagaaaggaatcaaacacttcgtaaacgataacgggctgctgaaatctgattcggccgacaggttcgcatggttcacggtaagcttcttcggtagtgtaatctccctcctcaattacgcatcctttggaacacatgaattttacacagaattttgttcataccatataaaaactctcaataatccccccattccggggggcttttgccatgatatgcaactctcctgcgcattcttggaaaaacaaaaaaacaaacagaaattagtttctcatgctcttccagatctcaccgttttgagctgtttacactatgcaggcatcagctttggtcgctctaccgatgttctacacctacaagatgctctcagctgctatatggtgagatgagacctaacctaattgtcagtgccttcctaactgaaccaacattctggagtggtgattcgactggttgccggtttagctaactgatggcgctgatttgcaggaggaaagctgtggcagcacagggcagtggcggcacaagatcaaaaaaagcctcgaaccgcaggcgcacacagagagtggacagctagacttctagaagtgttctcaagttgagacattagtactgggacatgcgtttctaaaggcataccgcaaaatcctttatattttgatatgaatatataataggaaactacggatagactgaaatgcacgcataaatcctgtacatatgacgttcatgtgtcatggttgctgttaatatggtctgacatggtgtatatatggatttgattttttttttaaaaaaaacacactgtacgcagccgccgtatgtatcatatatacgcataaacacgtatgaacgtacataacatatgtaccactatgtttttgaagattcgactcatatattttaagataatgaaattatcgtatttatctcgttgtcgatgtatatcatctatcactatcactggaaaaatacggatttggattttctctgtctatgataataaggttttggtttgtttctaagtttgggctcgattggaatcgatcaaatcgaagaagagccggcctcacgcgcgcaactacacaagaccaaggacgacgacggggtcaaatgcgttctgttttggtgaaaacggaggggatgatggagacaataagaatggatttattggtaggaatacgtgacgtgatattatagggacactttgagattgtctgttgggaggtcgtttgttttttttttcctttcttgggtttttttccgtcaaaacagttttctatttttagaaaagaatatagataaaaaagaattaggaaatatagataaaaaagaattaggaattaaggatgcgtacgggaggatgggttatattttttctagggtaaattggaaccatgccattataattttgcaaagtttgagatatgtcatccgtatctcaatgacatgtagaacccacatgagtcaatgacatgtagaacccacaatgggtcagtatgacatatctcnaattttgnnnaattataatggcatggttccaattttccttttttttaacacctaaaatgaaactgaattagcacatgattaattaagtataataaaatacttaaaattaaattaatataatttgttttcagattttctataaacgattaaacgagagtcggaaggtgcagcagagaacggagccagagttttgtaaaaaaaaaaaagaaaataaaatctagccgtcatatagtaaaatacaagaggcggtttttttatttccttttcttccgtttactcgtcgcggtcgcaggggcggggcagcgttgccgcgttcgatataaaccctccccggcagattcgcgatcggtttccgactcctctctcgcgccgagcccgagctaagctgcgcgccattgtagctagctttgatcggcgtcggcttgttggggggaaggggcttgtgtggatctcgcggcggattcaccgagcgattcgcctttttttccgtttgatccgattcggttcggttcgatttcgattcccatccttttggtcgcgggttctgggatctcctccgcccgcgcggcgtgcggcgtccgatcctgcgccgctgccccggcggccctcccatctcggttcgaattcgagctgaaggtattcgttcgttgttcttctctcgtagcccatccttcccctccctcccctccgcgctcatcgtgctgtagattttgatatccatctgggcttggattgagattgggtttatttttttgccccctccttccaattattaaccttctgttcccgattttcctgtacgtggtgcagcactaatactagcaatttgtaaatttcccatgtcaggtccgctccttaatagtgtgttgttttttggctanagcttatcttcttgttatgatagatagcgcatgccttcttccgtgttggatcataaagatcgatttttttattttttatttttttgctgtttaagtgatgcattcgtcataccttgtcgttcttgttatgtttcttgttatgatctactagcacccatgctttccatgttggaccacaaagatccttttttttttactgctgtttaagtggtacattcgtcaaacaagcttcttaatgttccaacaccattgagtggagcaaaaaaaaaagaggttatcgtctgttgaataccaaaactcatgtaatctgatgcccctttactgttgtgtcaacaattctgaaccaaactgtaactagctttcatcggtaaatattaataagacacaaaagatggagaaaaaccagacaaagtatctcccatctttttgtaacatgggaacaacattttcacaatagcaccttttattcattttgcagaagaactgatagtagcaagaggtgtcccccctcaattctagctctgaattgcaggaaaagctggtaaaatcttagggtaatgggagtcaagccttcacagtgaagatttaatagatgaaggcacaccaattgtggcagttacctatcaaggatatgaagtctgctcctctccctcgcggacgaacttctccgaaaaaacatt

SEQ ID NO: 13428 - DNA, 1420 bp, Oryza sativa
gccaacttttgttttttgaacttttaacttttaaaggaataatcctcaagatttccttttttttatggaagttccttaaatatctttggttcaaagccatttcaacttgagcaaaatagttaccgttttgatgttttatctttgccaaaaaaaaaagtggtttgtgcctatattttcttttattttgttttgccaataattgttgtcacatgaaagaatgcatttgaacaactgttctaaatatttcagtggttctcagtcaagcgtcagcatgcattgatgataattgcggacagtctttactatactaagttcaagcttcattgtaaggtaaggtcccaatttttaaaagcgtatctgcagatattgtcacataagcctattaaggttggaatatatgcactgtgtgctagacttgatttatactatacaattttgttaaacttcagagttatgttccttatatctctgtacttattcccctgtaatttgacctttgatgtttgtcatttagacgttatagtgtgttattttttttcttgagcagttatatatgttattgaattatcttttaccgtgaggttgcacttaatattcgtctgtgcaagttttgaatctaaaaggcaactgttaccttttataggccctataggtgtttgtgtgcatctgtgttgatctttatgaattgctaagaattattgtactttgataacgcagatggatttttagtgcggctctttttccatagtttaccataataataacttagagactctgtgttgtctgctgcaaatattggcgccgttgtgcaacatgtctgatgaatgatgatctattctttgctcttttgcagcctgggatggaagatggtcgcaactgctatgctgacgagcattatttgccaacactattccatgtcagtacacaaattgacttcatatgatgaaatttaaccctgttacatgttgaaaaattatatatttttttagtaaatttaaaaaactacttcctccgttttaggttttaagatgttttgactttggtcaaagtcaaactactttaagtttaactaagtttatagacaaatatagtaatatttacattacaaaatttgttttattaaattaataattaaatatattttataataaatttatcttgggtcgaaaatattactatttttttctataaacttagtcaaacttaaaacagttttgactttagcccaaagtcaaaacatcttataacttgaaactataacctgaaacggagggagtactactagtttgtcgcatcaatagcatctgattttatcagaatgctgcaattttctatatttgacaagtttgggcccacatatcatacacaaataaagtactcatgctgttgcaatcgggctcatatgtcatacacatgtaga

SEQ ID NO: 13429 - DNA, 25842 bp, Oryza sativa
  unsure (1)..(25842): unsure at all n locations
gggagtaccaattaatagctttaattaaccaaataattacagttttttgaaatttactctatttttttaaaggaatgagtaattacatcatcccgtaaaatccactgcagcctttttatattgtgtacttgtatttgtgtcaaccagatgatagatccaaatggaattgccaactggtctgtgactcatgttgactggtctgaagggaagtggcatccgaaagcttatcgggcaaatgatgttacatacgagcttctgaagaatataacagtatgttcttcgtattactgtttatcattaataatataatagcataattcataatcttacttttaacactgtgatctttttctttgcagtcaattgacatgagctaccatatcaccagcgatagcaaggtacctctctctctctctctctctctctctctctctctctatctatctatctatctatctatctatctatctatctatctatctatattttgtatctttattttgcagtcaattgacatgtgtattagctttattttatatcttttgaaagtcatatattttggtagttaattcccatacttgttcattgatactttgtctatgacttatgatccacatgaatttaggctattttacatatcgacagtaggaaggtgttatctctagaaatggctatgtgaaattgattatgcttctgagcacctgagatcgtgttagttacattattaacctagtgtaaatttgtaattgctatgcaaaattagcagtttctagaaaaaagggtgctattcccctgtggttctctagtcctaaagtcagcaaaccaccaaataaagatactcctactaggcttgtattttttttttagataaatgccaatccactgttcaaatgatctctttccttccatcttccatgtgtcaccgttctctatatgaaatacatttttacccaacatactttttgtgattcataaaaggcactaatgcattttgcatgcctgtgcagaaagtggttacgcagaggccttgcttatggaatggagtgaagagaccgtgttacttgtttgcgagaaagttctaccctgaatccataaaccgcctcatgaactcattctcaaattacacccgtttttgagttctgcagagttgcatgggtaccctacactaaaaaaattcctccatactagtggatatataggagatattctgttacaggaatctttgtaaattggaagagaacagcagatttattaacaatagctggtataggaatagggagaggagaaggcatacgccgcagcattagggtggttcagatctccacggtcaggccattgccactcctgaatacaaatttctttaggttcaccttgttttttgctagcctatttctcttgatttctagctgcagattctgtcatgtacatgaagcttattgtataactaggggagaagtcattattgaggcccatttttattgatttatccataaagctttggcaaacctttgtcttatcccaattgttcatgtttcgcgctgactcacacattcctacgctttctaacgggatgattggacaacgctttctaaccggatgggtggacagattagtcacgattgcttaaaaataaatcaaatattgggtataaattaaaaaatagcttaaaatatacctcctttattttttaataaaataagtcgttgaacttttttcttcacaatggttgacctncnnnntattcaaaaaaaattacgtaattataatttattttgttatgagttcttttatcactcatagtactttaagtgtgatttatatcttatacatttgtataaaatttttgaataagacgaatggtcaaacatgtgagaaaaagttaacggcgtcgtctattaaaaacggaggtagattatcttgattatgatgccgttgactttttaataaacatttaaccattcgtcttatttaaaatttatatacaagtataaagaaatttaaatcatactcaaagaacatttaataataaatcaaatgataataaaataaataataattgtatttttttaataagacaatggacaaccatatctaaaaagtcaatcatacaattaaaaaacggaagtagtgctatgtattgatgtaaaaagtttttttaaaagaaaaatcatactttagtgtagaacgaataatccatatatctataaattaattgaatatctcgtggcatgctccgagctccagttttttctttaaaaaaacagggaaatgatttcaaattattcagaaaaaaatctgcatgaatattcttttttttttaaacaaaagaaataggcaaggcaggcttcagctatcagcttatcaccacacacagacacagaaggaaatgtcggcttctgcggcgcccacgcacatccgcttctcctccgccgcacctccatcggccgccgctctccggcggcctcgccgccggtgcgccacgcccgtccgatgctccctcgccgcagcgccgggtctccgggcgccgcctgagctcatcgactccatcctctccaaggtgatgctgaaacatcatctctctgctcttcttgggtgcactctttccggattcctagcttctgctcagtgctcggtttatgcaatcttgtactccacattagaacacatttcttgactcagaaattaacgagttctggtgttccatagtactaattttaacctcaattagttttttcttatcttacaccaaaaaaattcggatttttgtataaatcctggagaatattccttattattggtttccaattacttacctttttccttctgtcattttcagtttcttgtatatatatattttttatttatcagactcgtgcaagtaaacctccgtcagcaattcatcatgttaatttgatgtcttaattgccttaacatgatatcaacaggtgaagggaactgaccgtggagttttgctgcccaaagatgggcatcaggaagttgctgatgtcgcactacagcttgccaagtactgcatagacgatcctgtcaagtctccactaatatttggaggtattgaaagagtgaaattgccccaattctccaaataatatctccaaaattgattgtgtcactgactgacaaccagtaaagtaacaacgagcattacattgaggtttgggttgtattacaacactgtaaacctcatgccatcctgactaattttcttgcttattgcacttgacctgacctaccagagtgggaggttgtgtactgctcagtaccgacatcaccgggagggctctaccggactcctctcggccgcctgatattcaaaaccgatgagatggctcaggtggtgcaagcgcctgatgttgtaaaaaacaaggtgtccttctctgtctttggtttcgatggtgcggtatctctgaaaggtaaaaaacagacaccatctgtcaactcattctctattcagactgggcgtgacaaatctgcacagcaatactgaatgtgatctcatgaagttcttgttatgttgggcatgacaggcaagctgaatgtgctggatggtaagtggattcaggtcatattcgagccaccagaagtgaaggtaggctccctggggtttcagtatggtggcgagagcgaagttaagctggagatcacctatgtcgacgagaagatcaggctgggaaaaggatcaagaggctcgctcttcgtcttcatgagacgatgatatgagggcagcaggcaatgtttgtaccatcatgtcctttgagaccacaagagggtagcaccatagcactgatgctacgacaatatgtttgtgtgtacaatactgtattctgttgtaaaattcagaggtcatgttggctagtagtgttcttcagacctccgaattagagattgtattgtcatttccaatcaaaatgacaaaatgtttgtagtttttgtgattaatgtgatggttaaattgtccagactaatgagcatggttatggatttttggtgaaccctgcaatgaaattgctgctcctagtatatactgtatttgccagaaggtttcaacatttttgtaggcaactattggtaacggaacacttttggatctacgagcaccgtcagatctcaattaagaggtcaagattgttccaaacttccaagtgcatcagtatagcggatatgccgcctccggcctgcagtaacgtactctatggagacagaacctgtacagtcgaaaagtcgcctctcgagaaggaaaacgccttcttggaaaaaccgtcttgttcttctcctcatccacggcgagggggcgtcccctcgagctcgcgggtctctcgtctcctcgatggcggtgtcgccgtggagctgccgctgtggggtcagccgctcccccggaaagagcagaggcgcaccggcaccttcttctcctggtgcagtacctccccgctccaactttttcttcaccattttgctatcgcgagtctaagtgtctaattgtcctagaattcctatttcttagattgttttgtgtatgcttaatttatcatggattttgtggtggttttgataattctgagctaaggttcctactcttactttgggtgtgtgcagacaagagatccaagtactcggcacaatcagtggtaaggagtgcaaaaaattcccccctttgatgttcgtttcttctcaattataagtatttagttttcgcttttattggtcactgcgtacttgctaattcctcgaaagctggaggctgctggctgatcttagtggacatatataggcgagaacaacaggaaactgcttctgaaacaaggattttgtatcagtagattcagcactatatctgaacattttttctgaaagtgctttccatgtcacagaactaattttcccatcaattaaatgaattagagaaatctgaaggggttgaaaccttctgccaaatacatagttttcgtaatatattctccatatgaattgcatagcaaaagcaacggatgaatgtctaataatgtttggtgtttgatatctcttgtggtcatgtttgaagagagcaatgcctatgcgtgtgctaacagttggaaagaagaggtctcgaggggcacagctcattgttgaagaatacaaggagaagcttggttactactgtgatattgaggacacacttatcaaatccaacccaaaactcacaaggtaggatactctatagtcgattcatattcattcccaaacgctgtttatattgtatagtcctagatattagtagaaagggttttgattggtagctttacacatcattccattgacgttggtagaattgagtttagttctctcaaagtcaaatatattttactggagggagtagttattttttgttaagaagttgatcactgatgctgacctctgttcttctttttcctttcagtgatgttaaggtgcaagtggaggcagaagacatggcaatgatgctgcagctcaagcctgaagacttcgtatgtttcagtacctccttatattctagagatcatatgtagttcatcttgtagttttcgttatctgtgtattagtggtttgacattgatgtgcatatttaggtggttgtgctggatgaaaacgggaaggatgtcacgtctgagcaggtagctgatctggtcggggatgctgggaacacggtacgctctgtaccttgattcataaatttttatacatatttgtgttaaaagttcaaacctgctggaaattttgagggataccatgtttcagtaatgtgtgttcttcaaacgttttaggggtcgtcaaggctcacattttgtattggtggaccgtatggttttgggctacaagtgcgagagcgtgcagatgcaacaattagactatcctcaatggttttgaatcatcaagttgccttgatagttctaatggagcagctctacaggtgagcaatgagcctctccatccatcaccgaatatgctttgataattccaatggggccactctttagtgctgggtaatctacgcaccaaatggcgttaggcaggtacaaccatggaacattccaaataagatagatcgatgtaacacatgatctatctgtgagtaatcatgttcatgcatatctatcagcggatagtcctgttaattctgatatcaactattcactaggggtcatttttttgcagggcatggactataatcaaaggacagaagtatcaccactagccactagaattgagttgcattggcgtcatgttgcgcacttgaacagatggaaaattggaagtgcaggacatggagatcgtaattcataaacgcatcagctttcaggtgtagactatagtggtcatgaattcatatttgtattagcattcatcttaagaccactacatgcacaaaacaaattacttacatatttgtctgcttggtcagatttggaggcttggagcacacggcgcatttttgcttggtgattcactgattctacaacaaaggcacaccagagggtcgaacattggttgtaatcaatgcagcgtataggcattgtagtccgtagattgtatagcgcagagatctcccatatatcaatttttcagcagtttagacaaatctttgttctgcttatactcgcgaaactgctattcatgtacaatgctttcaattgcactccaagtgagcacaaagcaacgaaaacgctttacaagaagatcaacagacggacagtttacagcatttcactatgttccaccgctcagtgcaaaatggtggctttgtgttagtcctgaaagcgaaaagtatgttataaaatcgagctatatcatgtttagcagaatttacaacagaagattatagattcttgtggtgagtagcaaatcaaacctcatacggtcatatctgctaggacatgacaatcaacaaccaacacatacaaacagttcaatcacattttacatacggtctgttgacggctgcagaatatacatacttctgcccatggaaagacccaagttcttcaagtcatatatagtcatattattctagatagtgaaagtggtaactcccagcaagtcatatactcatgccgcattagaaacaaaatataacaatagcacttggaagaaaacaatattaacaacgccaccattttttgttctataacaaactcttctttgtgctgctttgtaccatttttctgttcacgcctatctcacaataaacagttacattgccaatggaagattaggcagtgatgggattagctctagtcattgtgctgaaagccagggagaagtgatgcaacaaaccctacaacaatcaattggacctctttaaagacgcctccaagccaattgcgcctgttcccttctccatcgacttcttgctggttctcattagcagctgctgcccctggttcctggttctctgcagcttggtcattgtttgctgggtctgcaagatttccccctgagaagcaaaatgatattttataagaacaaacatatattgtcacttcaaaaagaatgaatattattttataatgcctgctaaatgtgaaatatcactagatgctgcccgttaaatcttgaatgagaaatataacttctcaatattgcctgacaatcagaaaatagcctggtatattagactaggaatctaggaggcaccattacacaaaccaagggatcaacaagacaggtggactaaacatccatcctattttaagtatttgtaacattattttgcaatatctatatgttcttataccatccaagtttttagaagtgctttaaactaacagtataaacctctattaaggatttggcagcagtagaaattttttttacaatgtctacatggtcaaacggtgaatctggtggttgcaatgatgcagtaggatatagtacaatattgaagtgtagtttaagatatctaccaggcggttgaacattgccatcattctgggcagctagcggagcacgattctctgggcgagctggagcctgtggaggacgagcagcagcacctcctgctcgctgcagccatcttagtaaaggtgtaattgcgccagtttgatatctgcaagagatggaacaacccaaatgtaacgacatacaatgaactaaacaaaacaagtcaaaaaaagcgattgggcaaggaagtaagcagggcactcacaagtaaatcactgaggcaaacagtatgagaagaaacagcctttgttttgatccttcctggctaaacagaaagacaactgctgctaacttgatgatcagggccaagtcaagctgaaaagcaaagtgaaacctcctcacaacaacttgtctctgagggccatgttgttgcctagcatcctgtgcttgctcttcaccagccacagcaccgacactttccctaacaatacaaaggatggtataagcaaggaaagaataaactcactactaactttgtggaacgcacattaatgttctgcaccatttctaggaacccccaaatcagcatgataaggcaataaacatattatgaaacagcaaaggtttagttgttctctcaaaaaaggtacggagtagattttaggattcactaacatgggcaataaatttaaacttttgagctgtcactcattattaaccaagtcagatagtaatggaaagttcatggcatcgtatagaaggcaagaatgtatctacatttgaggaataaggttaaacatcaatatctcattttggcatcaacatatctaataacataaggcagatgaatggagttcttcagcatgtgctgtggttcataaccacagacgcatgagcttctgtatacaaatttgctgagttgggcattaatcaaagtaaattcatagataaagcagcatgacatataaggaactcatgaatattttcgtcaattcatgggttgccaataggacaataaggtagatgaagtataatttaatgaaaaccttaagatattgtcacccgtgaaaagagctttgtgtttgtagtagtcgctgctcttactttacttacaaaaagccctaccgaaaaaaaaaactaggcatcccgatctcaaaaccctttctaattttgttccagatttcctccctactatcatgttgattatggtgaaggcatgtgaaacaaatgctcgagattctaggcagtgaattcgtatgccgtaacagattgctcaggattaggaggaaaaagcttacgttggaatcctgtaagtgagtggcatgagagtactccccatgaattgattctgctgtatggcatagatccctggaccctgagcctgatcatccaggctctgctgaggatgcatacccgtcataagcatagggtacatcaccggaaacatcaaaggagccccatttatagcgccattctgcattatcatcatcagcagcaacatgaatataatcatcatactagtcaataaccacaaatatttttcccccgatacaatagtctctaccaattacatcaaaacgatccgatccgagttgcaagaatctaacacaatcggagactaaaaggggtttacaattatgcacccaactgcatcaaaacctcgaccaaacttccaacttggacgagccaaaacacccataagaacccccaaatatcccacctttccgacaaatcacctgtcatataatcccaactcccaccaccaccaccaccacccccgaatccccactaaatctaggcaccatcgaacaagaaccggtcttcccaactacagttccacgcggtgaaccccagacagaaaagaaaagggaaaggaagaagatcactaacctggggaaacccgactggttcgccggccgtctcccccgccaccggcgccgccgtcgaggagtgggcgcggctctgggtttgcgcgtcggcttccgccatgggagacgccgcgagagcgagctcggtgttctgcgggttcgatctgacccacccaaaggatccacttcttctgtggatggacggcccagattccataatccacgtcactggaagaacccggaccgtccgatcaggggagccgggtagactttcacgtcgcttgaccaatttctccctaatagccactgaccggtgggaccaccctttcagccatagcaagcgccatccatttggtcactgacatgtgggcccatctcccaccggatatatcttcttcgtcttcttcttccgggaaacagatcccttcactctgtgcggtctgcagttgttccactgacttgtgggccccacttttgtatgacccacatgtcagtgacactgcacatagttaggggagtctcttctacttcttcctcctcttctccgtctcgactcttccatccgcggctgcttctcccgctctctctctctctctctctctctctcagccatggctcgcctcctctcgcgaaccctagccttggcccgcgcggactccgccgcggtgccctcctacggccgcctccatgtccgtggtgtctcatcgaaggtggagttcatcgagatcgacctgtcgtcggaggacgccccctcctcgtcgtcctcgtccggcgtcgaggggggcggcttcgggccgcgggagatggggatgcggcgactggaggacgccatccacggggtactcgtgcggcgggcggcgccggagtggctccccttcgtgccgggaggatcctactgggtcccggagatgcggcgcggggtcgccgccgacctcgtgggcaccgccgtccgcagcgcgattggcgccgcctggaacgcggaggcgatgacggaggaggagatgatgtgcctcaccaccatgcgcgggtggccgtcggaggcttacttcgtcgaaggtgagttgagttcgatcgaattaggcaattagcatttctggattgcgaaatggaagttgtaaaggtatttagcattttgtttggattgcgaaatggaagttgttgcgttgtttttctgtaagtagccttggttaggagcaaaccgcgggtgtttgtttgattggtgaagcattggggattcatgattgtttaggttgagagtatagtgaatagttgaagtatgaaacaactgtacatggattaccttcccctcatttgcaggttgaaattagagtattacggtattttagtagtttattttggctttggagtgtcatgtatgaaccatggttctaatagtttttggttcatcttactagtactccttttccttcatgagcttgacaggaagaaaactctacacctagtttggcttcgcaaatttgatccacaactattttagtactagttaattcaaaacaatttagacagaggttccagtaaatcttccatccacttgattcatgcagatgctaaacctggatttctctgcattaatatttgtttgtgagagttactaactaatctcaatgtcagttatacataaccatatcatgaggcatcagaatttcttccttccaaatgtagattctgtaattacctcagtaacaggagcactcagcttgttgttttggcagaactgaacttataacaggcactttctaatagtttgtacggctgtacgcgatgactgacgagttaaaatgagcctaaagaacattgtgttggtaagtttaggttgaactgattttagaatttatgactgggttgctacatatatagtttgggttcaattgttcatgccctatatgattcgttttcttgcaaatattgagtgttcatgccctaattgtgcatggtctagaatagatagaaatactgagttgctaacattatgtgtttcagattgtcttgaaccagcagttgttgggtgggcctcatgcttggggagttttgtgtatatgggctgagtttacctatggctgggttgggtagatttcaggttttcagtttatatcttctccatgtgtgtacattgtgaacctttagtattggaacctaaatgatttttctctacacgtagcattatgttgaatacttcctaatcagattaattacttctgtttaaagggaaattttctcatccagtggagagttcaagaaaagttgctactcaaactgatgaagaggaaagctaatttgtttgcatcactttagcaggggtaagttgtttcacattctccaagaaaatgcttactatcactactttctccttgtcctatactccaattgttgtgcatttgtgatatgacttaagtaaaattgccatatgcaccagcacctggcattgcaacagtgttgtttgttgtaaaaatgctaaactatgttaagtgttttaaagtagacataacagtacagaactgttcagcttggtggatacgtagcccaatagcgtgcatttacaaccaaataaaaaagaggaggtaacttgatgtgatattactgttttttgtgtggcaactggcaaggccccttgctgatccagactccaaattcatgtcccaaaacaccttatcccactatacagtgtgcacctggagttataagagatcaggacatgaaatctaacattctaaactgcatctggaataagctttgcttatcttcaacttcattgaaagacaattctttcaatgaagttttttttttccgtcaaaaaaaaacttcattgaaagacaattctgagcctggagtgtttatattgtgcagaccccctgagaaataggaagcttggagctgtcgagttctgctgatgttgtacatacagacagctatgaacgtgagcaccagcgtgtcatctcatcagtcgcttcagaagatgatgtgcccagtgctgttactactatcaaaatgccatgaacatggatccgtgtattcctgcaacacagtgccttgcgctatggtctttttttctgagagcttgtacttgtacctgtagaatgtagtgtatgcatcaagctgctgctactgaataaaagaaaaaagaaaaatatatgttgtgggttgggctgaatgcctgtaccccatgagcacaggatgctctcgatcattgagcgtgctgtgcacgtcgtgggcctccaactaaaactgtaatcatccttgggcagaagacggcagaaatcttgaactttttgttttgtcttgttcttcggctgataatgctgcttcttctgataacaattgcccctggaaatgctaatatgtaagaagagcactgctatacgtactaactttctttttaacataactctttacaaacaatgatatgagctgtttgatttaactagatggaagttaagcaagatgtattcacatcatacatgtagtgttagtgaggaaaaaaaaagtatgtatggactttttcatgtaagaaatggcacatctattttccttgaagaaatggcataactcgtgacacgtacatgctacttggcccggaaatggtagagcttagtagtgatgtagattgctgaatggtgggttaagagttaagacgcaatcgtcaagaggaagttcgatcacctcttaatgaaacagcatcttgcattcagagttctgacgccacgttccactgaagaaaatgacgctagctcccaactccaacacccagctgctccactcgaagacctgtactgattcttgcagagctcaccgggatcgtgaaccgtcaactaatcgaatgtgggttcgttcgtcaggtgtaaacgtcgcggttggtgccaaggccggtcggcgctgaaataccatcaaatacgtagtatgacggtgccgtatgaacaaaaatacatcatatgtccttgctaactctcacattaccagcattgtggtgttacatccatgtcaattgttgcttggatatcaatcggatctcgtgtagttgtgtaattatgagaaacaacagtgtcatccatctgctagtctctccagcatttctcctttggaatagctcatgcatgatgcatgcatcattgggcttcccataagagagctatggaagctggcgccatgttcgctcacagtaccgatgcccctccctttttctctttagtggttgttggctgatccaatcatggaaccttcacgttttaatttgaaccgttttggaatgtgaaatacaaaagcaaaaagatttgaaaagaagttcaggcaatggaaagagacatgcacatatagttctattatccatgggccatacgattgagtgcattgcactaccatttgcccaacgttctcattgcgttctttgggtttttgttcagtgttcacaacttcacatcccccaatagatcgatagatgctactagtacatttttttctattggagactacgaacttcacagagctggcaacttggcatatccaaatccaatgggctatctttcactacaaaatttgaatatttgtatatgtgtttatgcctgcacattcggtgaaaagtccctgtttccaatgcatatatataacactcatactaatacataatgagttcatccccagtcaactaactcgtgtgtcttatctgtcttttctccaatcttttttctccccctttgggccgcatgtgccggagggagactctgttcgtttgttaggggatagcgaaacagattgaatattgcacctggcagctgtatccgtagagccatcgttttctcactaccaactctccgacagtttagtctaatctagtttagtttttatcattttttttcttccaaacagtttaagaaaacagcgaattgtcacactgagttttgtaggtgttagttcaaaatttaagtggcagaaattatatgactgaaatgaaaattatggagggagtagaattgtgtctgaagtctgaacatgtttgtgatatcttcagaggcctttatatatgcccaactttgagaatcatctgtgatctgtccttttctggaggtaaccatcataatatttcacaccaacaccagatcatcgcatcatgctctcatgttagggctttgtctcctcccctgttctattgcagggcttgataaaaataactgcactgaacttatctcaacagctgcatacttctttctgagtttttgatctttgagaattggcacagtaagctggctgcctttggccttttcttccctgacctttcttcttgtctgttggtggcctgatcctccggccttcaatttatcatgccatgcctagtgtctttgcgtagccttaacattatccttcaaatttttcataaaggtgaaactgtactcggaacaccttttttcctttcgattcaccatcctcaaattattaggggaaaaaaaggagatccattgatgcaatatgtactaaatgaacaaaaaaaaaagcataactagctcagtaactaggttatcctacataaaccgaggttgcaggatttggttgtcacgacgtgccaacattgagagtaggaggtgagggagtgttttatctaggtttatgggtagtgatctagtcgacggattgatggttccttacatttcttatatcatttttattttagaactcgtgggtgtgagcgtatttgttcgcattctagttatgcatatgtcacgagtattttcgatatatttgttgtatcaacttaatgtaattgcttgagttcaataaaagcttccatatatcttgaaaaagaattaggtagttttgtttatgtaaaactttggctctaccatgtgccaatcacggtgcatagtttctggggaagaaaacgtatcattaaactgatgttttggccggtcatagactaaatgaatattgtaatctcttcattgtcggtgcatgattcaatattgctcgatgatgaaaaacgtgtgatccggtgattccttctgcacaattgtcggcttaagccaatatgtcctaattttcatataattattaagagaaaatttcagctgtcggtccttagattatttctttccagtttgactttcagcatctggtgttctactgttttctgaactttagagaagatgccattaactaccaattgcatacctagaggaggtgtcttacagccagattttatctcattttgttgatacaagttagtttcaaatacactgctagtttggtgataatcaccctatcgatatacaataatcctgacaaagggaccccatgatgagatacatttgcgtcaaatctgcatatgtttatctagattcagcaaaacggaacatgcatatgcaattggtcatattccagtggctggaattaaaatcagatagaccatgcagagatacagtagtgtaaccatatcagtgctagctgctgtgcatgtacactgttaggatatttggatgtaccaaaatacaagcccatgatacgatgacccacctacagtgcccataacgtggtatgtcttgtccgagcaatgtaactagaacaaccgtatgcttattaccaagtggatttccctacatttatctcaggtagaaattttatctcatgtaactagaacaaccatatgctattttttattctgtgcgccaaactagatttgtcaagaaactcagtggtgtgagattaggtacacaatctcaccacttaagttcgctctttgttgaaaattatgatttctccctctgttccaagaaaagtaagattttctcgcgtttaaaatttatcccctaaaaagttaatttacaatccttacctactttggttcacaaatcaagaagtattaaacaggttttattttttcaatgcccctaatctattcaaccgacaatactattttccttttagtgatggacactttggtctttatcttatattgtactaatttgataactcttttttggtgacggtagtatagtaaataaatttcttatataccactaaaattttatttatcctcttgtttaccactcattctctcaatgaagccaatgacaaacaaaaatctacaccaaattttaagcagcaaaataaggaagaacatcgttgttcgaaaatgcccccggacaggcattggatgcgtcttgtgtgttgtggccgcagcacaaagccagaaaaggctgacgaatctgaaaactttggcacgttagctgctagcatactccgaggttccattccagctacaatagccaaactgaagatcatctaaccagatgtgttgtcagacacaaggaaagttgaaacaagatctcctgagggccacaaagcgaaaagtgcccgcaatactcctacctacactggatatatatgatcataagaactagtgctcctacattcatgcagttttgagtctacatttatctgttttctcaaagaacataataattagaaatgtaatagatcagtaaacaaagatgcatcgatttttcttttgttttaaattttatttattttagataatggataactggtttctacattcaaaatagatgtatacatcatgatttgttttaaattttattttttgataatagattaaaacctggcctctacatctatgtacacaactaatagtgtcatgatttgttttttttataatggataaaacccctgcctccacatccaatatattgtcatgatttgttttaaatttattttttaatatataatggattgtaagtttgtaacccggcttctacatctaatgtacacaaccagtagtgtcatgatttgttttaaatttgatctgtacgataattcctgagatctgcggatcagaacacagctagtttcatgattcataatgagttaaaaaaaacttattatatataggtttgctctggtccatcagatagtaccttgcagtactggtaccgcatggtaccgaaatcatccctgccgttcgctcgcaaggggcatgataggaacctgtggaaacgcaccgctcctgcaccgtgtgtacaaccaatcccctcgagcgttttcctttctctcttccccgaagcgcaacatcgtgcggtgcgactccgctgattcatcccgtggagatgcgccgtcgccatcgttgttgccctactcgtcgacggcgcagcggccgggggacggggagaagaggaggccccgtcaacctgtacgcgaaggggtccggctttcctcgacgctctcaagccatctggtcctcggcgccgccgtgattctcgtcgtcgactgttgagattaatccttgtgtgctagattagtgtttgttttatttggttagttacatatccattgtgtgatcatgcatgtttcggcctgattggaggctataatttcctttccttgtaatcgcatatttaagcaatacaagagtcgggaaaaagctgcctagttagcagcaccaaacaagatggtgttcattcctatgttcgcgggagttttgtgtgtgtgttcttgccggcgacgtgagttttgtgtgtgtgttcaccgtgagcccttcgccttgacggccggaggtgttctcaacggcagacgcggcgccgacttttccaatggacgctccgacatcagccgctgccgcttccgccttggagacgagctcctcctcggcggtgccgagcttgtcgttctcgacgcggtcatctggggccgtcagctgcacacttctcttctccacgctggcggtcgccgtggggaaaatttcaccggtgcggagatggagatggagagagaggcggcgtcggacgaaacgatcaaagtggataagacagaatcagccatgcgaaaatacagaaatacccttccacctccacatcctaatacagtgccactacaaggacgagttggtacctcgcggtacctagcgatgacagccgttggatcctatccactcaacggtgacgatttgataccgctttggcctgctgtacggtaaaaaaaactctattatatatgctttattagtagtgtgcggctctaaacaagctagttacctagctattatgagagatcttaaaaaacacaagcacaccggccgattgatgattgtctccaccaccttacatgttggaaagcctagcattgtgcaaaatcttcagtccttcaaagctcacaaacaactcactttgtcagtttatttgtcttaaccaagaagccaaagataaactttacaaatctctctctctctctctctccaagatatactacattactacaggacatacacatgtacatacatccctgtgatgatcttttgatgcaaatgaggcatgcagctaattaacaaatacccctaaaacacacatcccatcaaacagcatgcagcgagccagtgtcagtctgtcagagcatgtatgtgttgcatggggctactctaattaactagctagggctacccagttagcaaattaattagttgatgaataataatagtagatgatgccaaattaggtggcaccaaccaggcaatgcatgcatgagatgagagaggggccctactaaaacactagcagctcagttcagctcagctcccctaaccatgtgggctttgagctcactaatcaccctgtatcatcatatcatgaccgtttggggatgaagaggaaagaacaacaacccaccctgtagcatcacgtgtacacgtaccgtatttctggcggtcgacaggagccgaccgttggttaccagcacgcataattctcctccctctacctcttaatcatctcatctgcaatttggtgtcctcttaacacttgatctccatcgatcgatgatcatgtcgttggcaaccatacatccgttcttcagagatttgcatgatcagggcgggctcttatttgattcatctgcaaccatcgatcgagttcaggtacatcacagtacaaactgaagtgcagttgtaagatgtgatgtttttctccgagactttcagtgcaatctactcaaagatggcagtgtaattaagcagggttttgtactgcctagaggattggagttatgattaattcatggtcgcttgcaagcgattatgaattcgatgatcagttggacgcattggtacacgattcttaaatccggtcgctttctgaagcatggagcttggaggctggagcaggagctaattaagagcttgtttggtttagtaccctaccaaagtatttgtagtgccaaaacttagacatgttttggcactaccaatattttggtagggtagcattttaggtgaatggatttggattgatactaattggaagccaaattttatattatactcaaaaaagttctagaattatgtcaaattaatcatgggcattaccattcacttggcttcaaaccaaaccattacattcactattcaaactaccaaacaaattggtagggcacattttggcatcaatccaaaatggccctaagtttttttatttttttgtgtcagctggaggttgctttctgaatctgtttaatggcctcctctttggagagtgagagagaaaagaaacaaagagtagttgagacaagttgagttgctgttaggagttgtagcaggcactttgtgctttgtgtggcttcccttttgtagttttgccctttggaaacccccatattgggaacctgaactgaccacaggtccaggggcattgtggtcattcaacatagtcagttgaataattgatcgtgtatgccatctgtttgagcggtatactatgggcatattcactttgattaaaaaaaaaccttactaagttttggcattaccaaaattttagcatagttgctgtcggtgatatgggaccgggagtatcgtgaccagaggcttgaggcagacacaatcgcccacgtggcctggcaccttcggggcgtcgggcccgagggtgaggtgtccgccctcctcctgatttccccgagggggggggggtcgggtgactcctgccccggccccgagggccgaggcgccccgaccccgagggccgaggcgccccgaccccttgtggagttagcgccacatgaatgggttgggtgaacacggtgagcctcacctaaccacatttattgcggtctggtcgaacgtgtcacgctgcatgcagcgcagtgcagcgcgttcctttatccggtctgtgaccggtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacagcctatatgttgtatgaagaagggcgaacatgcagattgttgaactgacgcgtggaggacaagaatgaccagtctgacactggtcatgtcgtcggcagacagccacgttcccacgacgcgcctgccttcggcagaagtggaggtaggtgtgtgccgtcccgtcagaaggatgttcggaggacaaccgtgcaaatctccgtccatttatgaagagaagaaaagtccagtttggaaagagaggggtgcatgtggtatccccttgaagtataaaaggaggaccttgcccatagggaaagggggatgatcttttccagattcggaacttagaacaagtaagaggttggctcacactttgtagctccctcatacacagatccaccaaaacacaggagtagggtattacgcttctcagcggcccgaacctgtatacatcgcccgtgtctcgcgtttcttcctagctggcgatcttttcacataccgagagagcttgagatttcaccctaagcccccggccgaaccggcaaaggggggcctgcgcggtctcccggtgaggagccacgagctccgtcatctggcgcgccaggtaggggataccgctcggggggggggggtgtgcggcacaaccgcatgctcgaaaagatcgcttccaaagagccccagactaccgcggagctttttcagctcgcagaccgagtggctcgtaaggaggaagcatggacctggaacccctccggttccggagtggcagcttcggccgcccccggatccgccgctcagacagggcggcgtgacaggaggaggaagaagaggtcggtccattccggcgacgagggtcatgtcctcgccgtcgagggcgctccgcgggccacccgaaaggggaggccagcgagcgacaaaaagaaagaggctggtactcccgccagggagcgcccagccggcaagtggtgctccgtccacaacacctccctccacgatctcgcggactgtcgcgcagtcaaaaacttggctgagcgaacgaggaagtgggaggaggacaggaggaaggaacgccgtgagggcaagtcgccggcaactccctccggtaaacggcgaagtgaggccaaacagaaggcccccgctgttgacatcgatgacggtgatgatgacctaggtttccaagaacctggggccaccattgccactgtcgatgggggagcgtgtgctcacgtctctcgccggagcctcaaggccatgaagcgagagcttctggccgcggcccctactcatgaggcgacgtgccgggcgcggtggtcggaggttgccctcactttcgaccagaccgaccacccaccgtgcgtcgcccggggagggcagattgcgatggtggtttcccccaccatctgcaacgtgaagttggggcgtgtcctcatagatgggggagcggccctcaacatcatttcccccgcggcttttgatgccatcaaggccccggggatggtgctccagccgtcccaaccgattatcggtgtgacgccagggcacacatggccgttgggtcacatcgacctaccggtcacctttggtggatcagccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctgaaagtcgcgctcgcttgcatggagcagcgcgcgggccacctcgctgctgcgtccaagcccgagggtggtgacgagaggcttggcacctccgcccccaccgccccgaggcagcggatggtcacatgcgccgaggtcccggtcaagggggttgccctgggcgacggcccatccaagaccacacggatcggtggtcttctggatggcaaataggaagacgcgctcgtctccttcctgcgggcaaacgctgacgtcttcgcatggagaccggcggatatgcccggggtccccagggaggtgattagcaccgtctcgccgtgcggccgggcgcaaggccggtccggcagaaagtgcggcggcaggccccggaacgtcaagccttcatccgcgaggaggtggcgagacttctggaggccggattcatccgtgaagtcatccatccggagtggctggcgaacccggtggtcgttccaaaggcgaacggcaagcttcggatgtgtatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcgttcattacccccgtaggaacctattgttatacatcaatgcccttcgggttaaagaatgcaggtcctacttttcaacgtactactcgaatttctttgggtagccaaatagggcgtaatgttgaggcttatgtcgatgacttggttgtaaagacgcgcaaccaagacactttactctcagatctagcggaaatttttgaaaatctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccccagcaaacttagggatgtgcaatgcgtcaccggttgcattgccgccctaagtcgtttcatatcgaggctgggagagaaggcgctacccttatttaagctcctcaagcgctcggggccgtttacttggacggaggaagctgaacgtgccctcactcagttgaaggcatatctcagctctcccccagttctagtcgccccggggccaaatgagcccctactactctacttagcggcgaccccccaagtagttagtgcagcgttggttgtggagcgcgatgaagacaatcttcatttcgcgcacccccgccctgtgttgacttggcccgggagcgagcagggaggagaagcccccgagtcgaacggtggcctaaggcccctgacgaccggagtcggccctctgcccgcttgtcagacggtgctgggtgcccccgaccctcaggaaggccccgaggccactgcgggaatgccgcacctatcgccctttggccccgaggctaaccctgtgctgactcgacccgggagaaagcagggagaagaggcccccgagccgaacggaggcctgaggcccctgacgaccggagtaggccctttgcccgcttgtccgacgacgccaggagcccccgacccccaggacggccccgaggccactgcgggaaggccgctcctgtcatcctccgaccccgaggtcattggcacagaagacgagtgcgccccgagagcccacttggacgaagaacgccccggggatgcggcccctagcgaagaggatcggccccgccgaaaggtgcagcggtctgtctactttgttagtgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtttcaatccccgaggccagcacggacccctctcagctgcctcacaccgcccactgggtgatgcagttcgacggttctctgtctctccagggcgccggtgcgggggtcacgttgacctctccgaacggagacgtcctcagatacttggtccgtctcgattttcgagcgactaataatatggcagagtacgagggactccttgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatggttgctgacgaactctcacggctcgcgtcctcgcgagcccagaccccaccgggcgcctttgaagaaaggcttacccagccgtcggcgcgacccgaccccttaggggagacggatgcgcctgaccggcccccgaggtccgtcggagtccaggcctcgggacccgaagggagcgctccaagctcccttagattgattgcttggatctctgagatccaagcatacctcacagataagactctacttgaggaccgtgaagggagtgaacgtgtcacaccccgaagttttcctcccaggccaaaatttgaattttcaaatgaccccaagaaaatgcaggtgaaatcaggataaaaccctaagaaaacaatgcaaataataatcggattggacatgtggaatttttcttgagttctacatgtcgaaattcattaacaggatttttagtggaattttcagagctcta

SEQ ID NO: 13430 - DNA, 18057 bp, Oryza sativa
tgggcgtgatggagcggggcgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcacacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgttgcaacgtgggttagcgttggacagcggatgtttaatactgcttaattattacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggtcgggtatgtgtcagatgaaggtttccccgaggagtaggcttcgtccgtgccatcgaggatgcctgtggagtggtgttcccgctgcagtttagtcaaggcttagctccagttatctttcgttttccgctgcatttatgtaagattttacaatgtttgtaagacgtggatctgtatgtcaacattgtcgtttgtgtaccccggctggtcctggacggggattttaatgcacattctgcttggaattctattcgggaatttctgagcgtgacaagttggtatcagagccaggttgaccgtaggacaagccaaatggaaagacctaagagccctctgaatccttttcattgcatatgttctttgcaattggattttgttccgggaaaatggggatctgttcttgtggttcaagggaaaaatcttggtcgctcgtttaaagtgagtttttcaaaacgagtcagtctagggttttagtaaaattattgggatttattcgtcagtcagttgggatttgatgggtgaaatgcattcggtcctagctcggtatcatgggttgcaaggtatttatgctttgttcgttactattattatgtatctaatttcccattattttatcgttatgtgagtctgtcttacttattcgctctcatgcaaaatgatctatgcataaaatttcgcttctattcgattctcttatttgagtcttttattgctttatttaaatttggatttgagcatgcattgatcctactcctttgtcttctctagatggccggtcacccacccaaccaccgcggagaaggcatgatcgactttgtggcagagctggcacgtatgacactggtggtgggctaccccgacgcaccggagtacacgaccattccaccgctcagtggcgagcttcctcaccgtgtccgcttggaggtccatggctacgtggggacttgcctcgctaacatggcgggttgaggcatctggaggcacagcagatcacgcctgtcaggaggcagcctacttgatgatggccagactacgggagcgccacaactacatcttccacgacacggcgtaccgctaccaccccagtcgagccaacggtgatggcgtcagctccttccgtccgacagctggcgagaacgacaccacctttggtcacatgtgtgctgtgatgagaggattggataggatgcactcggacctgcacaaggcgaccaaggccttgaatgatgggaagctcatgaggatcgtcgctctgaaggacgagatagcgcgcctgaagaaggagaacgctcagctaaagggtctcccagcaccaggaggagtccggatccgcactacgccccgtaagaggacgactgcacccgtgcgcatccagcttgcgcccaggaacccacctccaccagcagctcccgcagctccggcagttcccgcagttcctccagctccagctccagctccagctcccgcgttcactctctccttcgctccagcatcagccgccagaggtccagccagtggtaccggaggttggttgtccgctactcccagtggcagcgacgagactgatctgtcaggctccaggagccgctcagagggaccaggtgacgagcaggaggacgctttcgactccaccgaccgcaggagccgttccgagcattaggctcgttttcccattagtttatcgattgtttagtttctgcttgttagtttgtgtgtttaggttgcttgtttggggtcagtcgacggtcgatatcatgtgcctatgatatggctgtcttaataaggatttttgcttgcctttttaagtgttttaattcagatcagaacaattgcagttttaattcctatataataaagcttagttcttgagcatctgtttttcttcttttccccgcctgctcttccctccagatggtctacaccaggactggcaaccgcacgacaggcgagggcagcaacggcgaagaacgcgctgatggcgtgcaccccaacagcgattccggcaatggtccgccaccacttcccgagaatccgacgcttgcccaagttatggcacatcagactcagatgatggcagccatgatgcagcagatgcagcagcagcaccagcagatgcaccagaggatgatgcagcacgccgaacagcagcaccagcagtttggtccccctccccctcagtccaagttgccggagtttctacgtgtcaggccacccaccttctccagcaccaccaaccctatggaggcaaatgactggctccatgcgatagagaagaagctgaatctcctacagtgcaatgatcaggagaaggtcgctttcgccacacaccagcttcagggtcctgcgtcagcttggtgggacaaccacatggccacccgcccaccgggtactgaagtcacatgggcagagttctgccgtagcttcaggaaggcacaggtgccagacggggtcgtggcacaaaagaagagggaattccgggcgctccatcagggcaacaggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgccaggaggatcaacgcaacaagatggataggaagaggaaggccgctcagttcagggcacatcagggaagtcaccagaggccgcgcttcactcccgggcagcagggtggacctaccaccatgattgttcgtcaacaccgcccattcaaccccagcaacttccaccagggctccagtggcagccagaatcaccatggaagtcagcccaaccgcggtacagctccacgcccaccgatggcaccggcacagtcaggccagcccgcacaagccaagaaggagacgggagcaaaaccagggtcctgcttcaactgtggcgagcttggccacttcgctgacaaatgcccgaagcccaggcgtgccggaccaaggtttatccaggctcgtgtcaaccacgcatctgcggaggaggcacaagcagcaccagaggtcgtactgggtacgtttcctgttaactcaatccctgcaacagtactttttgattctggtgcaacgcattctttcatctcgaagaaatttgtcgggatgcatgggttaataagagaggaacttagcacaccgatgcgggttcataccccagggaatagctccacttcggttcaattcagcccttctataacaatagaaattcaaaggtcaccatttctagccaacctcatccttctcgaatccaaagacctagatgtcattcttgggatggattggctgaccaagtttaagggggtcatcgattgtgcgaatcgcacagtcaccttgaccaacgagaagggagaaacagtggtgtacaaatctctagtctcacccaagaaaggagcctcgttgaatcagattgagacgaaaatcccagtggacaccgaagagaagaacttgagaaaattggaggacatacccatagtctgcgagtatccagaggtgttccccgaagacctcaccaccatgccacccaagagggagattgaattccggattgatttggcaccaggaaccgctccaatctataagagaccgtacagaatggcggccaacgaattagcggaggtcaagaagcaagttgatgaacagctgcagaaagggtacatacgaccaagcacttcaccttggggcgctccggtcatttttgtggagaaaaaggataagacaaagaggatgtgcgtcgattatcgcgcacttaacgaggtcacaatcaagaataaatatcctttgccgcgaatcgacgatttatttgatcaactgaaaggagctaaagtgttctctaagatagacctgcgatcaggctaccaccagttgagaatccgggaagaggatattccgaagacggccttcaccactcggtacgggctatatgagtgcacggttatgtccttcggacttactaacgcacccgcattcttcatgaatctgatgaacaaagtgttcatggaatttctggacaagtttgttgtggtattcatcgacgacatacttatttattcaaagtccgaggaagaacatgaacaacatctccgtctagtactcgagaagttgaaggagcaccagctatacgccaagttcagcaagtgtgacttctggttgacggaagttaaatttctgggccatgtcattacagctcagacgaaagacttccaagtctattgcgatgcatcccgtcacggacttggatgtgtcctaatgcaagagggcagagtggttgcgtatgcctcgcggcagttgcgtccacacgaaggaaattatccaactcatgacttggaattggcagcagtggtccatgctttgaagatctggaggcactatctggtcggcaaccgctgcgaagtatatacggaccataaaagtctgaaatacatcttcacccaaccagacctaaaccttcgacaacgaagatggttggaactaatcaaagactatgacatgagtattcactaccacccgggtaaagccaatgtggtggcagacgctttaagccggaaaagttactgcactgctctatgcatcgagggcatgtgtgaggaattgcgacaggagcttgaacatctcaacatgggaattgttgaacacgggttcgtagccgctctggaggcacggcctacgctcgtggatcaagttagagccgctcaagtaaatgatccggaaatagcagaactgaaaaagaacatgagagtcggaaaggctcgggatttccttgaggatgagcatggcacaatctggatgggagaaagattgtgtgtaccggacgacaaggaattgaaggatctgatactcaccgaagctcatcagacccagtactccattcatccaggcagcactaaaatgtatcaagacctcaaagagaagttttggtgggtcagcatgaggagagaaatagctgaattcgtcgcactctgcgatgtttgccagcgagtgaaagcagagcaccaaagaccagcaggtttactccaacctctccaaatcccggaatggaaatgggaggagattggaatggactttataacaggactgccccggacatcatcgggacatgattcaatctgggtagtcgtggatcgactcaccaaggtggctcactttataccagtacataccacctatacgggaaagagattggcagaattgtacctcgcaaggatcatgtgtttgcatggggtacccaagaagatagcatccgaccgaggtagtcagttcacctcaaagttctggcagaagctgcaggaagaattggggacccgtttaaacttcagcacggcctatcacccgcaaactgatggtcagaccgagcgtgtcaatcaaatcttggaggatatgttgagagcttgcgctcttgattttggtggagcctgggacaaaagcttaccatatgcggaattctcgtacaacaacagctaccaggccagtctacagatggcaccgtttgaagctctatacggccggaagtgccgcacacctcttttctgggatcagacaggcgaacgtcaactgttcggaacagaagtattagcggaagcggaagagaaagtcagaatcatcagggaaaggttgaggattgctcagtctcgacagaagagctacgcggataaccgtcgaagggagctcacttttgaggcaggagattacgtgtatcttcgtgtcactccgctccggggagtacaccgtttccagacgaaaggcaagttggcaccacgcttcgtgggaccatacaaaattttggaacgaaggggagaagttgcttatcagctagaacttccatccaacatgatcggcatccatgacgtgttccacgtgtcccaactaaagaagtgcttaagggtacctgaagaacaggctgattcggagcacattgatatccaggaggacctaacatacgtggagaagccggttcgcatacttgataccagtgaaaggagaaccagaaacaaggtcacccggttttgccgagttcagtggagtcatcattcggaagaggaagcaacctgggaaagggaagatgagttgaaagccgcccatccgcacctcttcaccagctcctccgaatctcggggccgagattccgtttaaggggggtaggtttgtcacaccccgaagttttcctcccaggccaaaatttgaattttcaaatgaccccaagaaaatgcaggtgaaatcaggataaaaccctaagaaaacaatgcaaataataatcggattggacatgtggaatttttcttgagttctacatgtcgaaattcattaacaggatttttagtggaattttcagagctctagaaataattttaaccaattaaaattgagcaagcaatattttattccagggaaaatccttttcctttttctttttcttttccctccctttttccctccttttttttcttttcggatgggccgccggcccattcccctccttcctccccctcctccttgctgggccggccgcaggccgagggcccagcctggcagccgccgcccgcctcctctctcggggtcgccgacaggtggggcccacctgtcgggtctttcccccacctcccgccgatcccggcgcgccgccgcgccgaaaccgccgccgcacccacgcctccgccttctccgggccacgtcgaccacgcccgcgcgtgcgccgcgtctcccgcgccctttcccctctccctcccgttcgcgcccgcgcccgagatggccgggattcgaaaaccgaatcccgcctctctctcctccccactcccccgcgtcggccggcgaatcccgcctcttccggccacgtccggccctctctccccctatttaagcatcgccggcaccccctctcgctttttccccatttcgccgacccctcccgagctccccatcgcctccgcgccgtgcaaccacccgccgccgccgcttttgctactccggccgccgctagccgccgctaggctcgtcgccgtctcgcgccgtcgccgccgttagcttcgcggggtcgagatctacctcggccgccccttccccgtcgaggttcgccgccggagacccatccccgtcgtgtgccggcaagtggcgccatggccgccgccttcggccggcgctctcgccctcccacgctctgtcctctctctctaatccctctccttttgttcgttaggaggttccggagctcgtcccgccgtcgtcgtcgtcctccgtcggccgccgtcgtcgaccgttgtcggtgaggcttccccctcctctttctcctttttcccgtaccgtgtagccgcgtgcgcgccgcttagccgcgtagccgccgctcctcctctagccgccgctccccgccgccggtcggtcgccttcggtcgccgccttgcgccgctgccgcatgcgcgccgccgccgtgtgagcgccgcgccgccggcgccatggtcgccgccgtctcgcgccgcgcccgcgcgccccggccgcgaggtcccgccgccgtccgatctacccttgggtagatcggggccgtcggttcggccgccacgtggcgccgccgcccctcctttcccccgtgccgctgacccgtgggcccgcgcgccgccaccccctttctctcttccccggtcgctgaccggtgggccccgcctgtcggcgccgcgccccctcgctgacgtcagccctggttaatattgcgcaataaattatttaaggattttggttatagtaataaacacagtgaatcttctaaaattcatatctaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccgatccctccgacgctccggtgtacttcgagatagtcgccgaggttcctccagcagcagagcaaggcaagtcatgcttgtcacttgaacatgttgatcctatattgcaaatgctctattgttttctttcaaatattgcattgttttataatatcactatgggatggatacctattgttacagccatgcttttggatatcatgctcctttgttagcttgggttataacatgattagactttggactaggaattgcttagccatgcttagttcaactagcacacattggggatctcatttaaaacctagactataggtttataggataatgttggtttaataccaccgctccggtgttggttaattaaaatgaatcacatggtgggctgtgggtgcatggttttgctggtcgcacccatggcagttaaggaccggttcgcgggatgccctggaagaatttatcgtacttaccacaagccagcgtgggcaacggctgggcttgtagtgtagctttcctctagtcgacgcatccaggcaagggtgggcgtgatggagcggggtgggccctgcgacggcctctgtcgcttccggattcacctaggcacgagaggggactgcccgtcgcccgctggggacgggggtgaaacctgaggtgtggtgtgcttggctagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatctgttgaacttggatagtttaggtggatggttgggcctgttgcaacgtgggttagcgttggacagcggatgtttaatactgcttaattattacaactgttttcgcattaaattcctgtttataaatgccagtatttatgcaaatgaaccactctagctcttctttgttaattccctgcatcatacccctattccggtatgacttgctgagtacagtgggtagtactcagtcttgctctacttttcccaaccccagaggtcgggtatgtgtcagatgaaggtttccccgaggagtaggcttcgtccgtgccgtcgaggatgcctgtggagtggtgttcccgctgcagtttagtcaaggcttagctccagttatctttcgttttccgctgcatttatgtaagattttacaatgtttgtaagacgtggatctgtatgtcaacattgtcgtttgtgtaccccggctggtcctggacggggattttaatgcacattctgcttggaattctattcgggaatttctgagcgtgacagaacgcgtccaacgcatttccaaacgctacgtgctgatagaagggaccctctatcggcgcgcggctaacggaatcctcctgaagtgcattcctcaggaacaaggcgttgagcttcttgccgatatccatgaaggcgagtgcggagcccattccgcctcgcgcaccttggttggcaaggcctttcgtcaagggttctattggccgacagctctcaatgatgcagttgatctggtccggcgatgcagagcgtgtcagtttcacgccaagcaaatccatcagccggcccaggccctgcagatcataccactttcgtggccatttgctgtctgggggctcgatatcctgggaccgtttaagcgggccccgggcgggtttgagtatctgtatgtcgcgatcgacaagttcactaagtggcccgaggcttatccggtcgtcaagatcgataagcactctgcacttaaattcattaagggcatcacggcccgttttggagtgcctaaccgtatcattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcatggcgattcgtggatcgaggagttgccagcggtgctctgggcaaaccgaaccacaccaagccgagcaaccggggaaacgcctttcttcctcgtctacggcgcagaagcggttctcccatccgagctcaccctgaggtctcctcgggccaccatgtactgcgaagctgatcaagatcagcttcgcagagatgacctcgactacttggaagagcgaaggaggcgcgcggccctccgagccgcgcgctaccagcagagcctgcggcgctaccatcagcgccacgtccgggcccgatcactctgcgtcgacgacctcgtcttacgccgcgtctaaacgcgtgctggattgagcaagctctcaccaatgtgggagggtccgtatcgagtgatcggtgtcccccggccgggctccatacggctggccacgggcgacggcactgagctgcctaacccgtggaatatcgaacatcttcgtcgcttctacccctgaggggggggtcgagtgtcaggttttggctcgggccaaccccgcacccccctcgggtgtgcagggttggccgggggctaccacgcatgcacattcttatttctcttatttcagcatttcaataaaagcagtttcaatttcctaaaggttgtgtctgtgccgttttttccttttgaagaatcttgacttgaaataaggtcactcgtgctcaaccttgccctcgggggctcggttcggtcagctaaaatcgccaaacggggcccagaaccgagccgtgccccggggcgtggtgaacttcgggggggaatcggcaaaaacccacaatcgggtcacccataaccctcggtcaccacgttcccggcctggccagcctcgacatgtggatctccccaggcactagccccgacccgagccattagaggactgggacttgggcacgagcccttaaatcaagctaagacacaaaagaggaccacggcacagatcatcctcatctcatacgcatagcaaaataaaattgacacaaattttttcatcatttttgattccagattaagttaatctatacaaaaaagaggcatgaagaccttagaagaaagaaaaagaaaaaactggagtctggcgggggcctgggggctcagtccgatgcgcccgggtcgccggcctcgtcgtcacggtcgtctgcaccgctggcatcgccctcctcgtcggagttgggggcgaacgcgagccgaggggccgacccctcgaaactgtggacgatgtggtcggcggcatcccggacccgcgcgcgcgcgtcgtcctcggtcccgggagggaactcttccagcgccatccatggagagaagttggggtccctggcctggtaactcgctagtacgagttcaaccgctccttgggcgaggtccctcgaggatgacttgatggtcttctcgagctcctcggggagttgttggagagcccaggccatcttcgtgaggtgcggagcgaggccttccaggttggtggagtgcgtccttgtctggcctttccagaggcccgcttgccgaccggcgcgatccaggcgggagaccgcatcccaaagcatgccgggccctatttcgcccgccaagcggagggcctcggcttccccggcggatgagtctagcgcgcactgcatgtcggcgatggtgagttcggcagctgcgaggcggccggttaagtcgctttcgcccgcagccgccccgctgatacgcgccctcgcgtccagctccttttcccgcgcctcgaggtcggcagcccgctgctccagtgcggctctctcggcgcggatggattccaaattgcggcgtgcctgctctgccagcgctgcctcacggagggaaaggctatccgccaaccgttgcgccgcggcctcggcctcttcgagagctcgctcccgctcagcgagtgcgtcctcgcggaggcggagcgcggactcctcttcggcgcaggcggcctcgtgcaccgccagcgttgcctcccggatagcggcggcggcctcgcggtccgccaagcccctctccacggcgccggcgtgttcctccaatgccatagcacgggcctcaagggcctcctcgcgccgccgggacgccgcttcgatctccgttgcccgccgctctcgggcagcggcggtgtcaaggaccccttgggcggcgtcgagctttttctttagctccgcctcccagctcccgtgttgaaggcggagggtgtcctgcgcctcgatcatcgcggtggtggcaatgagggcgacctcccgctcctcctccacctctcgggcgatctctgccagcgccgctttgcgggcttcaagctccgaaacgtgacggcggtgagccttacggcccacctccaccatgacatccaccgagcgccgcccctcctcgacacgcgcccatgcggcctcgagctccgctcgttccgctcgcagggcctccacttgggcgctgaacccatctagcaccgcggtgtttgcggcggccaaggcctgcagaaggggctcggcgctcagcgaggcgacagaagacgaggagaagagccgccttggagagaatgcgacgcggctcggcccgccggaggacgcactgggctcggggatgtcccccggacccgtttggtcctgggcgtcgcctggggaagtgcgcccaggcgatccgcccgcggcctcgtcgcgagccgccccggaggctgtcgcctgagcgtcgcccgagggagtgggcccaagcgacgcgccagcagctttgtcgtgagctgcctcggaagacgccatcgcctcagcctgacgagcccgggcggcttcctccttagcagcttcttcggcttggcgagcccgggcggcctcttcagcttcccgaaggcgatctgcggcctctcgccggtcagattctcgcctccgttcctctgcggcccccggatcttcggcctcggactggccggacttgggatggcgggaggaacgtgacgggacatcgctgaagcaaaagaaaaaaccagaagacaaacaagatgggtaagagaaaacttgcttttgggataaaagaaaggcggtcgcaatgagagtgggacgaacctgcgagggggtcggttaaatgaccaccttggaggggaaatcaggtttccccgggatggttccgtctcccccatcttgcggagccgtttcttcttgcgctccccctcgggctgcgatgtcggcgcggccccctccgggtgccgactgctggcacgcaccgccccgccccctcggggaggagatgggggaggtgttcctcccagcttcctcttcccctgggcgtcggcagggcggctgctccccgagcccccgacgcggggcccagaagcacgaccccctcctggggtagattgttccccccggcggctctcgcccgcgccgtcgtggcccttaggagtttcctcctctgaggccccgacccccatcataatggtcagaatggaggcgcggtcgggatcgctgcagagggggaggattccttgaggaatgagagacgtctccacggagctgaaattcagcaccctttggaccacgatcttgaagtcctcgggagcccaatcccatctgactccctggtgggtccgcatgtagtcttcggacccggtgtactcccaggcgcctcgggcgcgccgttggagcggcgcaatccggcgacggaggtagtcaccgtacaccatggcccctgtgagcccctgggatcgcaggcccgccaggcggtcgaggacggcgtcatagtcatcccccagatctaccggcgcccgccagctggagacctgcgccgggggctgacttggaagtcggaggcgcgcttcgttggcgaggggggtgtagaaccagtcgctcttccagtcgtcccacttcttgcggagggcgcaggggatgtagcggttcaacaccggcccccgcggctggaagtagcagccaccaaccaccgacggcggcgacaccgactgcacggtgaagaaccaccggaacagccgaagagatgggcgcaccccaatgaacatctcgcacaggtgcgcgaagatggccaatgtcatcactgcattgggggtgaggtgcgccatctggagatcgtagaaatccagaacatccataaagaaagaagaaaatggcggaaccagccctgccattgcgaaggggaggaagaagacggaccgccccgggtagtctggtgccgggcgtccctcgcccagcatcactatctcccggtcggtggcagattccggcataaagcggcgcggcagcccggcatgcctctcgctcacgatgcgagaaggcggaagtacgcttccgtcgagcagagcggaaccccgagccatggcgccggagaaagggatgattgagagcgagcgcgtgtggcgaaggtagggcgcagcagagaaagagttagggctcaagcggcgaaggcaagaggaataatggcgaaaggaagggagcaaaacttttcctcggtatttttatacccttgccatagctgggcccggctcctcgtttctcgcgcccactatctcgctccctcgtttctcactatctcgctccctcgtttctcgtgcccacgcttccactaatcccattcgcccgcttgcggcgcatgaggtggatatgcgattgtggcagtcgagataggtcgtatcgtgcgcgcattaattacgctcgccggccgaagcgacgttaccatatctccaggcgaagcaaatcagctcacccagattcgtgcgctgcttaggtgatgtggcaagtcttaaagagaccgcccattatggacagccaagttaccattaccgatgtgcatggtttgagaccgttaggtttctgcgcaaccatgaaaaccggtcccacctgtcaccaggctttaggagtggcgttacgcccgaccgcttcccttgagaagggcgatcgccctggcataacgccgggggctactgtcggtgatatgggaccgggagtatcgtgaccagaggcttgaggcagacacaatcgcccacgtggcctggcaccttcggggacgtcgggcccgagggtgaggtgtccgccctcctcctgatttccccgaggggggggtcgggtgactcctgccccggccccgagggccgaggcgccccgaccccttgtggagttagcgccacatgaatgggttgggtgaacacggtgagcctcacctaaccacatttattgcggtctggtcgaacgtgtcacgctgcatgcagcgcagtgcagcgcgttcctttatccggtctgtgaccggtcacagaccggtcagatcacgggttaggtggcgactggcggtctgacgcacgccttgccccatcccgtcaagacgaaagcctctaggcactcgtctcaagccggagctagcgtgtaatctcttagagatggcacgttagccctggttagatttataccaggcttcatcccaaccattacagcctatatgttgtatgaagaagggcgaacatgcagattgttgaactgacgcgtggaggacaagaatgaccagtctgacactggtcatgtcgtcggcagacagccacgttcccacgacgcgcctgccttcggcagaagtggaggtaggtgtgtgccgtcccgtcagaaggatgttcggaggacaaccgtgcaaatctccgtccatttatgaagagaagaaaagtccagtttggaaagagaggggtgcatgtggtatccccttgaagtataaaaggaggaccttgcccatagggaaagggggatgatctttccagattcggaacttagaacaagtaagaggttggctcacactttgtagctccctcatacacagatccaccaaaacacaggagtagggtattacgcttctcagcggcccgaacctgtatacatcgcccgtgtctcgcgtttcttcctagctggcgatcttttcacataccgagagagcttgagatttcaccctaagcccccggccgaaccggcaaaggggggcctgcgcggtctcccggtgaggagccacgagctccgtcagttgccaaacattttggcaagttgccaaaattttggcaagatttcttatatagttaccaaaatttggcagcaaactaaatttagccacttttttggcagccttaccaaaatttggtaaggttgaaaatgacatcaaagtgaacatgccctataatttatcattattactgggatatttattctgttatctaaaaaactggaagctaatagatagttaactgatagtttgacaacccatctgatctgatggtgcatctttagataattttgatacttttgcattatccaaccatttcttccttgagggataatgagaagagacggagataatacggtgacaagtattaatgtatctagtggtctcctcccacaatcatgttaacattctttgttcgtctcgtcattattccactaccttcttaaaatatctgggcaatttgcaaatagatattttgataaaataaatataattttatgaaatttacttaactctatactaaaataaggaatcaagaaaacgaatgaccaaaatgttgccttccttccaaatactgtccaatgttgcgtatctttacatcgtgctatgtcaaggttccacccatgctttgacatagtgttgatcactgcactcgcttctcattctctatggtgctatgtgagatagattaaaaatgaagtcagagcatgcaaaacgagaaaaccaaccgtgtgtaattaattgagttataattattataaatttaaaagatagatttatttgatagttaaaaaagttttattttaaaaacataatatttcacagtttaaaaaatttacatcttaatcgagaaaacctaaaccaatctgtcgtaaccctcatcgggtgctcttccgtaacactgaatatgataagggccctttgaatcacaggattgaaaaaacgtagaaataggaaaaacgtaggattttgatacgagtgcaagtgtaaaatagaggattgcaaaaacacagttaagacacaggaatggccgtttgattggaccgcagaaaaacacaggaattagaggagaaatgaagattcataagaaagtttccatgagatagaacctcatgctaaatttcctccaaaacttgcatgtctttaggcattccataggaatttcatagaatttcgtaggattcattcctttgattcaaagtgccatataggaaaaattcctataggaatgaaatcctttaaaatttctatgtatttcctttgaatcaaagggggcctaaatcctcacatacccctcccagcccacaaaaaacgaagttagtactagatgtggcatattctagtataatgaatttgaatagaggtatgttcaaatttgtagtaatagattatgtcatatccaatact

SEQ ID NO: 13431 - DNA, 10204 bp, Oryza sativa
cccccccccccctcccccatccccttcttcctctctgtctccagcgcacgcacgcacgaccacctcgcctcctctcctctcccctcccctcccccacctcgcctcgcctccacgcgcgcgacgcggccggcgacggcgagccgcacggcgcgtgggcgtgcctctcctcagccggcggctagccctctcctcgcgcgggggcggcggcggcggcggttgttgctggcctcattccaccgccatccctcctccgtgtctcgggctcgactcggtggtgaaggtatccatgccattccttttctctctcgcagccctctcctccctggtggtggagactggccggctggggcgtgggagtgtctgcgcttgggcttcgttgtgtcggtggagcgagattccggtgggatttgggggggcatctgtcgctgtaactcgtaaggggttgggggtttgacacggtttcgttttttttttaagaaatgttgtttccagtgatgttgtcgtgtctcaaaattattcagaaattttttatgtagatttcttggcgtagtcagttgtttcaggggaggcgcgtctccatgaaatctctgcatgttttacggggctttgcctgtagcctgaaatttggggggagtgggaaaaaaatgtttcaacaaaggcatttcatatcaagttgttttatgctactgaagtgatgatggaagatgtgataggcctaccaaggccggaaaattttccgcgtcatgcatttttcgttgcgagcaaggggcattgtgaggttttggtaactcaaacctgcatcgtgtctctgtttaggagttctcccttccccacgccacccgtctttgtttttggtaatgtttaacctgttacagaaatggaaatagtgaaggatcagtcagctgctaattactaccagtagctgttaggatgccgctgtgccataatgcaaagcataaaaagagatacatgatgtactaagaatgaaaataaagatctgtaattttttttaaaaaaaatccaaaccaaagaagccccttagtttaccttttcttttttttttactgtaattagccctctgtgatgtgtggaagggctgttcatctaaaatctccttgatatttcataatcagtatgtgtgattcttacaattgtttttctttgtttctattagcatactatttgttccaagaggcacacataatataccgatatgcatataatgttcattcgcttttctatttgatgtctttgtcaggtcaggtgctgatgcaagatataggttgttctatgagaaggatagctgtgcacatcaagacccaaatataatctcacttggttgtactatagtggtggttgaacactaagatatagcttattctgttgtttcaaaaacatgggttcgaggtttccatcgcatcagcttagcaatggcctgtatgtgtctggccgacctgagcaaccgaaggagaaggccccaaccatttgttccactgccatgccatacactggtggtgatataaaaaaatctggagagcttgggaagatgtttgagctccacgctgtcaagtcaagaaaatctggtccactgagcaatgcaccttcgaggaatgcgtcatttggaggtgctgcatcaaactctggacctgtccctaatgccggggatcggtccaactactctggttctctatcatcttcagttcctggtgctagtggatcagcaagagcaaaatctagctccggacctctcaataagcatggagaaccagtaaagagatcatcaggtcctcagtctggaggagtgaccccaatggcgcggcagaattctggccctctccctcctatgcttcctacaactggacttatcacatctgggcctatcacatcggggccactgaattcgtctggtgctcaaaggaaagtatctggacctcttgattctgctgcatccaagaagacgcgggccacatccttttctcataaccaggctgttactaaaatcaccacagaagacagttactcaatcacaggaagcctttcgaagctaatactcggggcagtgggtgtgctctttgtgttggggctcatagcaggcatcttgattcttagtgctgttcacaatgcaattcttctgatagttgttctggtgctgtttggttttgttgctgcacttttcatttggaatgcttgctgggcaaggagaggtgtgattgggtttgtggatcgctattctgatgctgatctaagaactgctaaagatggacagtatatcaaggttacaggggtatgtaaaatgctgttgatttatcatatcatcctatcagtcaatactcctgctttattttcagatgagcttcttccagtttagaagattacatatgtatttttttttgagaggggagattacagatgtacagatgttggtacatagattcagtgcatgatctttttttctgagataatatgccaaacaattacttaagttatcatgtctaacttcacaggttgttacttgtggaaatttccctctcgagtcctcgtatcaaagggttccaagatgtgtgtacacttcaactaccttacatgaatataggggttgggactcaaaagctgccaacacccagcatcaccggtttacctggggattacggtcaatggaggtgagttctttttcatgaatgatagatacccattactaagtgggcattgagaataaattgatgcagtcaattacatcatggtatacaggctttattgaagaatattgaactttgagaatttgtttctctgatctctatgtaccttaacctctgacaatcccaatgcaatcatgacagcaacacgcagtggatttctacatctcagattttcaatctgggctccgggcattggtgaaagcaggatatggtgctcgagtgaccccattcgtggatgaatctgtcattattgacattgatcctgacaacaaagacatgtcccctgaatttcgaagatggctgcgggaaaggaatctctcaagtgatgatcggataatgcgcctaaaagaagggtattattttcttatttagttggtttgcacctagaatgcacaagctaaaattgtgatcttcaatgacctggtaaaatatcttagtgaatcactacatttacttcatcacctgcagatacattaaggaaggcagcaccgtgagtgtgatgggggttgttcaaaagaatgacaacgtgtcgatgcttgttcctccaccagagcccatctctactggttgccagtgggccaagtgtgtcctcccaagggacctttatggattagtcctgagatgtgaagatacctcaaatatcgatgtcatagcggtttagcaagctgggtgttggaacttagaagagctgctgctaaaaaagtgctttttaaatgttttgacttggagtttgtttcgtggaatgttagaattgagaaaaatgtacaaatgttggggatgattaaggttagtaaaaatagatgttaagctggggtttggatgtatagtcttttcttgtattttgtcctttcttttcacctattcctcggttatgagcactgaatgcttgtcttgtgaaatatgatggcttggttattactaccatccagctgtttgaagacttagtgaaattgggtaaacaactatatatgtttttttcaactagatgtatcactgctgttaaagcccttccatgttccatttaggtgtctatgttatgcatgtattcagcagcattcacttagcatacctatgtaccatgtctacacttataccatgcctgcatttaatctcaaatgtcactgactattgttgaagaaacattatttaaataatcctttgaagcaaatagaagtacccatgcattatagctgcagcctgcaggcaacactctggcccagtgaacagctacattacaattttgatgtaatgaatatatatgcatttcaatgtgagctgggatgctgggcaagggagttagctcaaaatggtggcgcatgccaccgaagcaatgcctgaagaagtcactgctcagggtacaggtctctctgtccagaattccagatgcagccatgcaagccattccaggctgccatctgtgggggttctttgagatgctcaacctttggccagtttcatttgtcaccacattgaatcaaggagcaaagcttgggctccaattgaccgagttctttgggatgtgacaccgttttaccatggctgtacctgcaaaggctgacttgtcaaggatatctaggattggtggtgaaactgtactgtcctctgaacttactggaacaaatggagccagatagcatgagacaaaactagaaggcatagctaattggttattcctctccctggtaaggtaagaaacttagaataggcctgtggaaaaacatttgaaaattcaccacatgccttaacttgtgtgagaatgcagcacaacacatgatgttagatatatctattaaaattcctccttttcacattcatgcagtatttcagaagaagaaaatcttttaatgatgtggttattgccatcgaagagaagcaaacctatggtatgttcagtttttctttttcttcgaaatttcttcattgcaccagttgcatgtaaggtgatcttaattaagaggcctaactctttagtagtagaatctacaattacgattttacaattgcgatcctacttagagacctccggttccgattcaagatctcgattgtaacaaccttgttgcatgagtcttcaacaaacaccgaaaattagctaataagaatctaccattaaggaacaagaaggacatggatgcaatccatcgcaatcaacaaaaagtacagatctccacaagcaagaattatgggacaaaaccttcaaagcatcccttcattggtgaatgactgaaaggtgatcttggtgccgaggggatatcttacagggccctagctgccgcacaacagatccagaatttcagaacaggtattcccttttcctcatgtttttcctccattttttcctatctgaattcgttcatgatctgtcaatcattggtgaaacagtccaaatggcaaatgatccgaacgaacagttggtcccggcagcgcaataacaacatagtaacatactaacatgcttgtgtatcaatcatcaactgtattttttttaaaaaaatatattactcagctaaagagtcctcgcacacaaggtgagagatgaagttacaactttcatccgtccaaaagtctgttaaagatttttttttttgctgggccagctaagataggccaaccaaatttacttaagattgaggaatatgtataaaagtctattaaaagattgaggaatatgtacaaaagtctattaaagactcacaccgggctctataagctaaagcataactactacgattctggattctattagccttcttgatcatgaactgtattataggttgtaagggaaacctctctactgggtaaccatggtcaattgatcgattcagcagttgacactatcatcatccagacatcatcatgaccatgattcagtgaaacatgggctctcatgtggcaatgcaagatccgtatgcatgaactgtcctgttgtgccgaaccagattatgaacttggaattgcagaggccatgaacaattgcagacggtccccaaggaggccaggaccaaagataccgatttactgatcatcgtcacttcgtcagtcttccgcgacgatatccccttattttcatgaccgtctgaagatccattgtgtggtaaaacacatcaaaagaatccttctcttgattatttgtgtaagggaacagacattctctggagaacatgcgtactatctgatcgaggaacggcaacctgaattggtgaacaaataaatactacacattgattgcgcaagaaaaatcaatgttgtgatctcttcccgacatcgcggatcggtgacagatgcgctcatgtgcacagtacggtcgtggaagaagacaagcaacgccgatgcctgattacatatggaggccaaattcgtgtaggtgaaattgtgcagcatttcatcaggaattcaggttactgaaaatcagaggatgcgaacacttttcatcacttcctttgagagcttcacgtttatactttataaccaaagagatgactcatcagtaatagcatgtacaattgtgcatgatgcaaatatccctaccatcttaataaaaacaaagtcgttctccttccattccctcctctcacagcgcgctcgcacgtgtagcttacgtaaccattggatctaggtccagttcttttcttcaataaaagttggttgaagattaagattttcgtgacacgtatttcaaactgctaaacagtgtatttcgtgcgaaaactttctatatgaaaattgctctaaaatatcatatcaatctatttttcaagtttgtaataattaaaactcaatcaatcatacattaataccacctcgttttacgtaaaaaacttaattttcatctttaagagaaaagaacaccaccctaatattttatcccaatcatagatacagtctatccctagtctgatccattataatcgttggtgcatgctactagaactaatagaacagaagaattttggattttttttttcggtaggagttgcagcagaagctccactgaagctttcgcttctgtacgtcggtcgaaatgccgttccagcccaacatatttcggcccaatatatccgcacaggtctgggattatattccggcccacgaatctccgcacgggtttccagcacaatattccgcacgtacgtgggattcccgctccggcccaatataaggcccgacactttcgaagggttaatctggaccgttgcataagattcgtacggacaagatcgaggaagcgggaaggtcaagcggaattttgtagaaatagccctcagaattactttatttcacccgtttggcctttccccctcttctggccacctcggcggttcgtcgccggcggcgatggcggcgacggtgcggttcgggctgctggtggcgatgttccaggccatgtcgcgggaccgcacggcggcgaagaagcgggcgcggctccgcgcgctcctcgaccgcgcctacgggcccggcggcagggacgactacttcagcgcgctccgcctcgtgctcccggggctcgaccgcgagcgcggctcgtacgggctcaaggaggccgcgctcgcctccgtcctcgtcgacgccctcgggatagccaaggactcgcccgacgccgtgcggctcaccaactggcggcgcgggggcggcttccgcaacgccggcaacttcgcactcgtcgccgctgaggtatgccgccacatttaccagttactatccctaaccaaaacatggggcatggcggcgtagtcgttgatgagtttatgaatttcccgcgtttgtggttcgatgagctgcgctcgattgagtgttttcttagttttgtttcattaattcattgggttgaatggatacagtctgtggtagcaaaaatctcattgagttaaagtatattcatagatagattgattgtttgaccgatacacgctttggatactgtgattattttcttagttttgtttcactaattcattcggttgaatggatacagtgtggtagcaaaaatctcattaagttaaagtatattcatagatagcttgattgtttgatcgatacatgctttggatattgtgattcggggccttatggtagcttcctgatgtttctcatactcttgtgtgctgctcaggtgctacagcggagacaaggaatgacttctgggggattgacaataaaagaggtgaatgacgcacttgatcgcctggctgcaactgagaataggtagcttatacataatacatctatttgcatttttactgtgccgtgcatcagtgtatgccttgaaagtgagaagttactcctcattcttgacaggtctgagaaggcttcgattctttctagtctgatcaagaaaaccaatgcccttgaaatgaagtggctcttgatgattattctgaaaggttgggttgctctacaagttgcatttctgcagtggttttggattgctgttgatgctttccgtacttcatcatagatttgaaattggggatcagtgagaagagcgtatttcatgagttccatcctgatgctgaagacttgttcaatgtcacttgtgacctgagattggtctgtgaaaagcttaatgatcgaagtcagaggcataagcgccaggtgatgatactacattctatgtctgcctgtctttgcctgcatgctgccattctgatgcataaaatttttacacggaagcaagtttatctccatgatatctctatgctgtatgaccaggatatagaagtggggaaggctgtcaggcctcagctatctatgagagtcaataatgcctcatctgcttggaagaaggtctttttatttattttttagcttatagtgtatcaatggaatatttagtcatttctaaggacactcacttttttcatatagtcatcttacaatttgtttggttatatgctccctccctcttcagcttcacggaaaacaagtggttgctgagtgcaaatttgacggtgaccgtattcaaattcacaagaatggggaagagattcatttcttctcaaggtaatggttccccatctatctcttgcttattattctgaaacggattggtttcttttgccataatattttctgtttctgcctgtaatatctttgctgtagataggctaatcctggtccactaatgtgctgtgtttatcaggagctttcttgatcactcagaatatgcacctggaatgtccaaagttattatagaaaatatcttggttgacaggtaaggtttactattactacctcgtcacatattatagctacttctagcattcaaaatttgtcccaagtataaatacttcctcctacttccctatgtcaaccaatcacaaccatctctcatttaatttcttcaccttctttctcatctcatccagtcacaaccatttgtcacctcaatcttaatccctccaaaaaaaaaggcagaagtagctataatatgggacggaggtagtactagtgaagattttttttttttgggggaagacaatgaggttttaattgtattctaacaattttttttctgggtgaaagtgagaaattgtacatttttttcctgaaaggtatcatcacatggcttagtctggtcatagacaaaaaaaaaagaagcaaatgaatgaattaccccctccgtataaaaatgtaaggcataatttgtttagttaggacaaggctttggccatcagtttgctttattagaatatagtttttatgacgcaagactgatgttattagattcatattgaaaattactttcttatgattatacttttgtgtcatataaatgatatattagtaaagcaaatcgttgatcaaagccttgccctagcaaaacaaaatatgccttatatttttatatggaaggaatattgtcaaagatcataataccaaggaattatttttgttacacctttttctgcagtcaacaaattataggaaaacttaaacatgttttgaatttcttttcgagttacaaactaattatgagaactttctccttagggcatgcttcaataggggatttttgatttgaatcctttgtgtaggctgtttcttactccctgcatccctaaataagtgtgtagttttagcctaagaatttgtccctaaaagagtgtagttttagagtagtccacttgacctctttaatactactacgtctttttcttcttatttttttgtcattggaccaatagtactccctcctcgttttctgtccatatcaataaagggcatggtagtcttttaatctcttccttaatatgtagttgactatctaaaactacacttatttagggaaggaaggagtagtagttagtataatacttgataacccattcttgattttgatgtgaatttgtactgaccctgcaggtgtattttggatggagaaatgcttgtttgggatactgtgcttaatcggtttgcagaatttggatcaaaccaggaaataggtttctggaatctcattggaaattgtagaattttgttttttatgctgtatgtctttatagtggact

SEQ ID NO: 13432 - DNA, 4568 bp, Oryza sativa
tgggggaagagagagagagagtacggggggggggattcaaatcgaatcccgcccatttgcgggcacgcatgctggcgggaatggcggggagggcggcgacgtggggacgcggagtggaggcgtggcgtggagcggagaaggcggcggcgcggacggtttcggcggcggttgccgtcgtggagcgggcggctagaggaaggggacgacctgacaggtgggccccacctgtcagcgtcccggagagaggggaaaggggaacggaccggcccaaaggaaggaggccaagcgcgggagggagtgggccgacggcccaatagagaaaaaagaaggaaaagaaaaagaaaaggaagaaaagatttttcctgggatttaaaattgcactttggtgatttttaattggttaaaattatttccaaggctctgaaaattccactaaaaatcttcttaatgcactggagcatggggaactcaagaaaaaattccaccacgctaattccaattattaattgcatttattaactagggattttgctctaggttaattaagataatttcttcgggcaatttatttaaccaaaaaagggggggaaacttcagggtgtgacaggaaacaacttcagtatgagtctttggttcttgcccttcttgtgaaggatcatcaatgatagcttccatctcaggctagcaatataaagataagaaatcacaaatcacattacattcacataaatatgtaagtgcaaaagataaaagaaaaatataactcacaataacattctttacaggctcactaaaacccatcttgctgttgcaatggcactccttgaaaacataaattgtagtgggtggcagtgtggcacgtccttatacttagtttgcttctaaaattacatgcaaacagtttgtaaataaagatgccatcactttctgaaagttttttcatatgcatatttagagtgctaaatataacatgccattagtgtaacgttttcttatccataatatgtcatccaatgttttaacaacctatggctgctaggtgcttatatccaccatgttagaaccacagcaacagattatgtagttaaagtgcagttggctagataaaaatatttagggtgattgtacataagtattactaactcctagaaaatgcatgtctagtttctgtggatcacacatgacacatacaaactcaaaatctgaaaaaaaaatcaacttattatacacataacacataattaagttacaaataagagtacaaaagaaccgacacattttattttgtatcttaccacatggcattgtgcaatgtagctccgagagcatgtcctttgctagtactgagcattctcatggttgttatgtttgttttacagacacttctcctatagaaagggaaacactagtaagacaagtagcttatttctatcacatatagataagacaactgtacacaatattttgatagtacgttgtattggtcaatcacatatggtttgactggtcagaagtaaaaacatatttagattcagatcagaaaataatatacgcgtgttagttgtaccacgaaaattgccagtttttacaaatatgacatgcatgtgagcttcaggtacaaacaatatgctagcttcctcttgcttttaaatgtttttcattaccatatatatgatttattcacttgtttctcttggaatgtaaacaaatatagagaaaagacatactatgattttttttactagaatatgagacttgacaagttaacagcaggttctgaatttgaagtcaacaataggtaactagttgtcattaaaccatggtcatagtttttgtaccagcaaattaacccaagatacaaaacaagtagatgcggcatcatgattcatgtagccaacactgtgtaagatttttgaaataatgccatgatttccaataacattcaagtctataccttatgctttggatctgaccacatctctactattgcttgccattgctcacggtcatactcttcagcgatgatgttgttctcacttcgttttctggtgtaccatcaaagaaaatattcttcaacttgtacctcatttgtcattgtctagacttgagcaaatcagcacatgcatctttgaccgtctgattattttcatctttggcaaattggccctaatcaagagcatggataaaagaaaattagcattaaaatagaataacatacaacatgataaacctaatgacaggtgaataaaaaaataagtaaaaatctgcataaaatagcaagcaaaatgaacgacatagacaagaataaagttatacaacaagtagcatgtgttcaacttgggagcaaataaagcaatatgaaagaaaaacaaatagcttctaagacttagttgcggatgttcaacttctccatttaaaattcagattagaattgtatagatccaacatgggcatagaaatgaggatgcaaaattaatcagagcccacacaataatttgtagaaactaggacataattcatcttatacatttgcagatactcacataaagcaacccatgaacatactgcaatacagtgaacaattaaaatttaagagtgttgctctattaggaaagaattgatctacttacaaccactttatccatatagtttttaagttgagacttgccattcttatactccttccagtgagtaaagattggtatgtgctgcctaagtacaaccccccactctgatgcttgctttgcaaactacattggtgcttctggccttctcttcccttcaacaatgcgcaccatcttaagggtgtgtttggttgctcgtatctatcaagcctggctcatctccgtcatccaggttgagttcgtcctagttaaggcgatacatatgcagtcgtttggttgtttgcattagtctggcctggctactacgagatactgtttggttgtctgcacgggggatacggttcagatgagaatttgtttggttggttgtatgaaccgtatgtatgaggatattttttcttgggtgagattaccgcttataaatttccactatattagagttcaggtaacctgaatttatttttttcattatcaatcttcttttgttagtaaaacaactcatcaattgaactaatgtagtggagtacgtaactacacagtaaatcgtatattagtgactaattacgggattagagaacggggatagtagaaaaaggaaaaagaagaaaaaagaaaaagtgctctcgcatctcctcacactcctcgctgttggtattttttaacgacattacaagaaatataattcccagcaatggcgcaaatactcctggtatattatggttacagagttcatccgcaagcgcacggatataccattgtagcatttcacccgagagtattccaagggtatcgtatttattttatctcgtgggaagatcatgtagagagaacttgactaataatttatatattacttgtgataatcatattctaagcaggggttaagataatccaagggtagagtaacacacaagcactaactactcattcttatgatatattatctaagctaagtggaaagaaaagaggaagaaaatctattcctatacttctaatatacatagtatacatacattctagttaaccgacatactagctaataccctctatccgatgccctcctggtacttcgagaagccaccccagactgccgagttccgtacgacagcccgttatgaccatataatcggggctaaatacggaggaataccctccccaggaaattaacttaggattatatacagacgcggaggaatacccgtactgagctgtcaccatcagcggcccacctctcatccgcagcatataaccccaaataatgatatcccgtaatctagacaacacgtctaaacgaccagatcctactctaatatcatcgtcatgacatagagtaattgcataagcaaacattatacccacaccaaagcatctcccagataagctagccgtatatccagtataacaagaacataatgtaaagtagatattcatatacttggaaagtatttcaataccataaatgtatatagaagagtattctaacaaaagtacaaagcttacaaaagaggaaaggaaagctattagagccatacccgaactcttccgaaggcttccggactcctgatttctactctattcctattccaccagctagatactactaactaaacttgagagaaatgagcgagctcttgcttgaggtgtgtgagtgaagtgagaaggtgaagtccttatatagaggtagttatgacggttgtggaaggggaattgtctgaagtgctctccaaccgtcattgggatgcaatcttggatgtccacgccgaaccctgcatccaacggcgccaggatgggtaccaggttcggctgaagcatcagctgggccatccctgcccttcttcggctggcggcctcctctattgcttcactttgtagacttgtgaatttttgtcaattctgagttcttggcccattcatacatcagtctgaatctcgacatcgtctgat

SEQ ID NO: 13433 - DNA, 3566 bp, Oryza sativa
  unsure (1)..(3566): unsure at all n locations
nnnnnnnnnnnnnnnnnnnnnnnnnnnnnnnnnnnnnnnnnnnnnnnnnnnnnnnnnaagcttacaaaagaagaaaggaaagctattagagccatacccgaactcttccgaaggcttccggactcctgatttctactctattcctattccaccagctagatactactaactaaacttgagagaaatgagcgagctcttgcttgaggtgtgtgagtgaagtgagaaggtgaagtccttatatagaggtagttatgacggttgtggaaggggaattgtctgaagtgctctccaaccgtcattgggatgcaatcttggatgtccacgccgaaccctgcatccaacggtgccaggatgggtaccaggttcggctgaagcatcagctgggccatccctgcccttcttcggctggcggcctcctctattgcttcactttgtagacttgtgaatttttgtcaattctgagttcttggcccattcatacatcagtctgattctcgacatcgtctgattgatttatcgtttgatttgatgtcgattctcctctactttatggttattctctgcaaaaggttagtaaacctaatactagtggaatattattattctaacatgtttaagcattgcaagcatcactagttctcctctattttggaaatattgacggtcgaaactgatcgataacgaacatcaacaaaaccccccaagcttgaacctttgctcgtcccgagtgaaggatgaaaggaaacaatgacttggttgttgatcaggagttgctactatgctgcatatctcaatgatataggtgcaaggtatatgtaccctctctcagattaaataatcttttgcacggtggcttactcttacccctgattcccacgagacactgcttctccttgccttgggtggttgaaagaaagaacagcaattagagcaccaatcacccaacattcattcaactcttattccggaagttttgaaatgatttttgtaaaagaaagccaagttcctcaagtgattcgctcagactctctaagtgtatcaatatgacttcctcaccagattttgcctttttgattcctactttaaggttttaatatgtggagctcggtagagatcaaacatggcatacttgcattcacatttattactaagtcaaaaacttaaactaaagtagataattaaaacatactaaagatcaagatcgtgcaatgtgtgtgtggtatatcgtggaaatggcacacgaggaaaaataaagaaaatgcttctcctttgtgcttactttcttctcccaaaaaatccttcttttattgattagaagagggcatggctatttatttattttttttcaacatcatgctcatgcttgatggagcataactttattttttttcttttcataaccatgccttttccttcttctctttttttttcaaatggatttttctttttaggagaagaaagcatatgaaaacatggagaatttattttgttggtaacatggaaatggaatggaatatttgcttacctcccagtgtaggagtttggcatgtgtgtcgacgggggatacccgtagaccggatatagagggtattggtgtccgttggtacaaggatctacgtagtacgacatcaagcaaacaaaagaaggattatactggttcagggcccttggtaggtaatagccctaatccagttgatatgagattatatgatggaaaacacagattacaaagggaataacagaactcgatgataccgatgagaccgtagtcgagttggtccgactagatctcccggcgacttggctcctgcatgctccggctctgtaggctatagtgggtgtgttggcggtgatattcgatgccttaggtcctgcccagggggttccttatataccgcgggtcagttgatctctaagtaggactcggagatatcgaacccctcatgatatggtaaaaacccagtcttgtccgagtagaactccttccatccgtagataccatccctatcccgtgatagatttccttaatgtatacggaaactatctgtatacgcgtgggtatattgtatcagtatacaacgtacatccaaggatagagggtataacttatccgtaaccctgacaatgtgcatatatgtgggtgtatgatcttgatcatagagcatgagaagtatctacacaagtcacaagagtttgacaaagttcaatggaatggcaagtaaccaaaatgtatatggtttaatcatgatagcacattttttgctctggtaggaatttatatcaaatgaggaactttcaattttatcattttgaaaaacagaacattcggaatgtaagtcaaactaggatcatgatcatagtaacacttatttactatctcatatcttgcaacaacttagactcagattagcaagtgcagctcatttacctcaggttcctagataattgttggctacttatatttaacctttgagagagcacttaccatgaacccatatataagagatataaaacagagcaactattcatcatttcaacaaagagaactggcttgtcttatctagcatgactcaaacctgtcgtatccttttggtattttctactttgcaaatttttatattgttttcaagtttataagatgcaattggaaagcaaacatgcaattgaaaagggaaatatgcaatgtgatacaagttaccgcagtggggggagagacatctctccccccaagcttggctttcgctcagggtccttgacaaggattgaaccgttgaaagcggtagtacatttgaaggtcatcgtgctgttgctgcatcatgttgttgaagtttgcgaactgagcatcagcagattgttgccattcttgcgtttgtgctatgtgttccgtgaggttgtactggatctcccccgtctgcatataaagggtgtccattctcctagcgatttcacccaagccccaacgagaggaactcgagcgccattcacttcgagatggaggcacaccacttgatctggaaggttggttattcccccaatgtatgtcattaggcgcatgccatcggtcctaactggcacttgcccagtttgagactccgatgctatggcgttgagcttgggtccatccgggtgcatccccagttggttcccaacctgcctcatacatttgcacgagtgttgaggatgatgaacttccctgttcatttcttgccatgttgcgcgtctccctgtatgctccacctgcacgagattcttctatggtgtgcaggggaatggttagttcacgacagttgtacaaatgataccccgcatttggcaacgggatttcatttatacaaccgggaaaaaagtaaattaaagatccatcttctccatgtttcagaatatgcccttgcactagataagtctcatcaatacatggacaagcggctgagataaaagcaatttggtcgctaatgaccactagcccttttgctatccgagtaatcagagaagtgcactcaacaggagcagagaactttatattttctaaccattgccttatcatacatttcacaggagcaattttg

SEQ ID NO: 13434 - DNA, 721 bp, Oryza sativa
  unsure (1)..(721): unsure at all n locations
nnnnnnnnnnnnnnnnnnnnnnnnnnnnnnnnnnnnnnnnnnnnnnnnnnnnnnnnnnnattctcctagcgatttcacccaagccccaacgagaggaactcgagcgccattcacttcgagatggaggcacaccacttgatctggaaggttggttattcccccaatgtatgtcattaggcgcatgccatcggtcctaactggcacttgcccagtttgagactccgatgctatggcgttgagcttgggtccatccgggtgcatccccagttggttcccaacctgcctcatacatttgcacgagtgttgaggatgatgaacttccctgttcatttcttgccatgttgcgcgtctccctgtatgctccacctgcacgagattcttctatggtgtgcaggggaatggttagttcacgacagttgtacaaatgataccccgcatttggcaacgggatttcatttatacaaccgggaaaaaagtaaattaaagatccatcttctccatgtttcagaatatgcccttgcactagataagtctcatcaatacatggacaagcggctgagataaaagcaatttggtcgctaatgaccactagcccttttgctatccgagtaatcagagaagtgcactcaacaggagcagagaactttatattttctaaccattgccttatnnnnnnnnnnnnnnnnnnnnnnnnnnnnnnnnnnnnnnnnnnnnnnnnnnn

SEQ ID NO: 13435 - DNA, 550 bp, Oryza sativa
tgaggacgacgggatgggagggaggaggaagaagggaatcaaggagaagatcaaggagaagctccccggcggcaacaagggcggccagcagcagccgacggccactgcggcgaccggcggatatggtgccggcacgggacacaccgccgccgctggtacaaccaccgacgccggcgggacggcgtatacaccgacgacgcagccgacgcacgagaagaagggtatgatggagaagatcaaggagaagctccccggtggtggccatcactgagccctttttgaggttcagtttagctccagctttggagtggccgtacactgttcagaataaccaatactccgatgtatggatgaataaaaacgagtggttgcatgcttcaatgtgttgctaatattaatatcggtcatagcttcttgtatttctgaagtttgtacttgcctgtcttttaaaatgtttccttgtatttatgaagtttgtacctgcctgccttttaaaatgtttccataatgttgctagtaatgttgttatccagtatctcctccgtccttg

SEQ ID NO: 13436 - DNA, 805 bp, Oryza sativa
tgccatccaacagcttttcaaatagcacgaaaatcagtatccatacctattttttttcagcagctccggatcatatgcccgcgtgtgagcaaacacccggtctttcagcatggagtaggcttgcctttcccagtcaccgacaaggtcgaggtcggcgtcgttcaagagatgtggaatgtcggcatcctccattgaggcatcggtggatgagcgagtgctagactcgtcatgatgacttgatcgagagccggctcccatattgaactagcgggacaatcgtctcttcattctgcacaaatgaataagaatggactaactcgggcgggggttagaatagcgagatatttacccaccggttagcttcactaaggaaacttgtgaatgcaactaatggcttaaatttgaggtaaacttgcaaagcgtgaatgaattttgagagcaaagttcggagaggagatgaaaatgagttgaaatgggatggattttcctcaactggccagttggcttaaataggctgcccacaacggtcataaccgaccgttgggacccactagttgttgcctcaaagaaagaggcacccgaccgttgccctggccggttcaaccgaacccctggtgggcccaactggccccactttcgaccgttggaacccaatggccagtatggtcgtggcatagcaaatttttgttgaaaattattttgttttgctctgaaaaaatcatttgaagtaatttcctcaaaactcaaatctaaatgtagttttttggaaactcaaacatgcattgataaagaatccaaattgata

SEQ ID NO: 13437 - DNA, 316 bp, Oryza sativa
  unsure (1)..(316): unsure at all n locations
ttcacaagtaatttccgaactaatttgttcattaaaacccttgtccaggaatcagccgaggtacacaaactgacaatttaatataaagattcatcaaaataaccaaaacgataaatctacataagaggcacttagtcctcaccatgaagaaaactgcagcggaaaataaaatctagcgaagcatctgctccactcctgtatctaagcaaaaggtcttctccttctgtatccttttcttcaactgaggtttgatgattatnnnnnnnnnnnnnnnnnnnnnnnnnnnnnnnnnnnnnnnnnnnnnnnnnnnnnnnnn

SEQ ID NO: 13438 - DNA, 1456 bp, Oryza sativa
  unsure (1)..(1456): unsure at all n locations
nnnnnnnnnnnnnnnnnnnnnnnnnnnnnnnnnnnnnnnnnnnnnnnnnnnnnnnnnnnaaattaacttaggactatatacacacgcggaggaatacccgtactgagctgtcaccatcaacggcctacctcgcttccgtagcatataaccctaaataaagatatccagtaatctaaacaccacgcataaatcaccaaatactactctaatatcatcatcatgatatagagtcatcgtaaatatgattagtatgcccacaccattgcatctcccagataagctatcatcataatgaatataacatggatatataataaagttggtattcatactcggaaagtagttctataccaaagtagtataaagaagaatattctaaataaagtacaagtcttacaaaagaaggaaaagctactagagccatacccgaattcttccgaagactccgacgactgaaaactctattctatttctattccactataccctagagactatactaagcatgaggatgtatgaaacttcttgcttgaggtgtgtggaagaagtgatgagaagagttccctaaatagactgccaatgacggttgtggagttggaatggttggaattgccctccaaccatcattgggaagtgatccacactgtccagggagggttcgactgaaccatgggccggctcaatccagcctatcatcggctggtgacctcctctcttgatatattttgcaggcttgtgaattttggcccaattgtccattcattgataagtttgattctcgacatcgtccaattgatcgatcacctgttttgatgtcgtttctccttcattttatgtacattctctgcaaaaggttagaatcctagtgctagtggaatatttattatttaaacataaatatgcatttcaagcataactagttcttttttatttaggtaatattgacaggcaaaactggtcgctaatgaccgtcaacagcaagcgtagcctaggagggagggaggcgcggtgtattgcaaggctaggagggagggcgctaccaggccacaacacgtctcttccgcttcgtttctcctttttttcgcgaatcttgcgctactctcgactccacaacccaaccacgacgcgacacatctccttctctctaattctccctccgtgcagcgcagaccacagaggcgcaggtactttaccaccgagtggcaggcgcttggctggctggccgccggcacgccgggccagcctctgatcactgacacctcacgcttcttctcgtctcatgccggcggccagcctctgatcactgacacctcacgcctcttctcgtctccactccccagtacctttagctctaagccctaggaaaactgaggtgtttttttgttcttgnnnnnnnnnnnnnnnnnnnnnnnnnnnnnnnnnnnnnnnnnnnnnnnnnnnnnnnnnnnnnnnnnnn

SEQ ID NO: 13439 - DNA, 4292 bp, Oryza sativa
  unsure (1)..(4292): unsure at all n locations
nnnnnnnnnnnnnnnnnnnnnnnnnnnnnnnnnnnnnnnnnnnnnnnnnnnnnnnnataactagttcttttttatttaggtaatattgacaggcaaaactggtcgctaatgaccgtcaacagcaagcgtagcctaggagggagggaggcgcggtgtattgcaaggctaggagggagggcgctaccagccacacacgtctcttccgcttcgtttctcctttttttcgcgaatcttgcgctactctcgactccacaacccaaccacgacgcgacacatctccttctctctaattctccctccgtgcagcgcagaccacagaggcgcaggtactttaccaccgagtggcaggcgcttggctggctggccgccggcacgccgggccagcctctgatcactgacacctcacgcttcttctcgtctcatgccggcggccagcctctgatcactgacacctcacgcctcttctcgtcttcactccccagtacctttagctctaagccctaagaaaactgaagggtttttttgttcttgtgttatttctttaatttttttctaagaaatttaggttcgcagcaggcggtgacgggaggagaggcggcagcggcgggcggccctctgctagatccggtgggaggggaggcagtggcagcggcggcggcccacgggcgacgtcggcgggctcacgtcttccagatccagcaacctctccgaccgcctctcctcctatcgcctacctcctccttcatccggtgagcagcggtggtcaacgctctgctgctttcaccctgccgattctctgatttggattggtttttaagatatctgatttaatgatgtgaagcactccatgaatttttgatcgtgtgatccaagaattgttgattgtgtgatggctgctgatatgcagttgtctttttggtagatttttggatgtttatatcggctcggctcaaatcgtatacgtcaattgctggcacctttgagtgttcttactagtgccgtcttcgtggtgccagttgggaaaaccgacatctttgtggtattcctaacaagcaccagtaaccctatctgggatagtgtattatgccaatttttgtttcgttggctcacaaaagtttattagatgttccatatcggctagaagtttaaataaaatacgtcagagaatctaccacgtctaataaactgaacccttattagagcggggcagctcaaattttaacattgacggtagaaacagtcagtaaaatgtagttcaatttttaagatgggactttacttttcagtgagattcgaataaacctgacggtgttaataacgtcaggaaaattcactgtgacggtcaaacctgtcagcactatttttcctgaagaatacacgtcaggcaaattaaaaatttcccaacaagccagttcggacagaattttcctgacagtttcacgtcaggagggttttggttgtcagggctagttgagtttttggcagtgttatacgcgtgattgcggaacatgaaagttcacacgtacaactcacagctatgcatttttgcatgtactatacctccaagtagattcatagtattggatatacctccaagtaaattcatagtactggatatacctccaaatagattcatagtactggatatagtactggatagtctatttttatccatgttttaccattagacttatttaaaatgttttgtaaatataaaataaataataactacataaacttttaataacatcgttgattttttatccatattttgccattagtcttatttaaaatattttgtaaatataaaataaataatataaatttctaataagacgaatgatcagttttataatacaatggtgtcatgcatcatgcattacaaaatgaatagagttagacggtgatcaaacataaaaaaaatcaatgatatcatgcattagaaaacgaacgtcatgcattagaaaacgaatgggcggaaaaaaaagaacagaaaagagaggattgagcactccatcataaaagaacaacctaaagagcatgtgcaaatttacccctggttttttctaatttagctaaacataccactcgaatgacagtttggttgtaattttctagtggcagtactgtaataacgatcgtagaaaattataatcaagattcaaagcagtagaaaatttataattacccaaaaagagggggaatctgtaaataccaaaaagagagggaatttgtaattaacaaaaagagggggaatctgtaattaccaaaaatttataattaccaaaaagagggggaatttgtaattaaaaaaaagagagtacgccttccgttccataaaaaacacaccataaaaaacacattataatactacgaatatgaacatacttataaaaagacacattgtaatactacgaatataaatataacacattataatactatgaatataaaaatacttcctagacttagcattgcccattgcccatattcatttagatattaatgaatcattagatattaataaatctagacatatacatgtaatactacgaatataaacatacttcctagacttagcattacccattgcccatatttatttagatattaataaatcattagatattaatgaatctagacatatacattagacatatacatgagtttagatatatgatgtttagattcattaacatctatatagactttttagcattgccatattaatgaatcatgtacatacatgtgtttaaattcattaacatctttttagcattgccatattaatgaatcatgtacatacatgtgtttaaattcattaacatctatatgtacgtggacacaatgctaaaaagtcttacattgtaaaacaatgtaaaacggagggagacggagggaataccttaaaaaaaatacattggaatactacgaatataaacatacctctattattcactcctatgttttttttaacctctattattcactcctatgtattattcactcctatgtagtatcatattcactcctatgtttttttttaagtcctattcactcctatggtttttttttaagtcccatgttgtttttaaggacggaagacgtaacattcagtcctacttcaaggacggaggagatactggataacaacattactagcaacattatggaaacattttaaaaggcaggcaggtacaaacttcataaatacaaggaaacattttaaaagacaggcaagtacaaacttcagaaatacaagaagctatgaccgatattaatattagcaacacattgaagcatgcaaccactcgtttttattcatccatacatcggagtattggttattctgacagtgtacggccactccaaagctggagctaaactgaacctcaaaaagggctcagtgatggccaccaccggggagcttctccttgatcttctccatcatacccttcttctcgtgcgtcggctgcgtcgtcggtgtatacgccgtcccgccggcgtcggtggttgtaccagcggcggcggtgtgtcccgtgccggcaccatatccgccggtcgccgcagtggccgtcggctgctgctggccgcccttgttgacaccggggagcttatccttgatcttatgctagattcccttcttcctcctccctcccatcccgagtcctcagacgactgcacgtcatatataatacattgatgacacaggaagatacgtagacataatctagttacggttaatttacagtgtgttgagaaacgttaccgagcttgagcttgaactgccggagcggcggaggatgccaccggtcttgtgctcctctctcgccggctggaactggccgcctgcgtgcggatacgcgccggtgccggcggtggcgccgtgtggcgcccctgtgccggtggttccgtatgccatggtgtcgggtgttgtggtggctccgtgtccagccatgtgcctggtgcccaagccaccggcgccgtggtgggctccggtggttccgtacccggctgtgtgcccggttcctagtccaccagctccgtgctgagctccggtgacgccggttgttccgtacccggcggtctgcccgcgggtaaaccggcgccggcgccgtggtggactccggtgccggtggtaccatgcccggcagtgtgcccaggcattaaaccaccggcgtcatggacgccagtgccggtagcgccgtacgccggctgaccggaaccaccatagcccgcggcgtcgtgggtgccggtgccggtggcgccgtatccggcctgccggccataac

SEQ ID NO: 13440 - DNA, 2192 bp, Oryza sativa
  unsure (1)..(2192): unsure at all n locations
gcgcgcgcggcgcgagcgcgacacgtcgagggggcacgtgtgagcggggtggatgcgcgacgcgtggagaacggtggggagccgacgcgtgcatgcgcggtgtgctgggatggggggtggagcggcatggaagccggtttgctttccacctggatgaggatgagtgcggacgtgggcttcggcggagattctgcgcgtcgggggtgtgcgtgggcgacgtcgagtagaacaggcgttctgccaggtggttaggttaggcatggatgcggctggtgacttgactcgactggaaacaaacagcctcggatatatatttcttttaaactgtcgaaaggtttggagttcaaatcttaacacaattctaataaataaacatagtctattttaaataaaatattaaaaatgataaacatttaaaatgtcataaatatagagaaaaaatagtagtaaactttatttttggtgttttgtactaattgagtttaaccataagttcggtctgcaataacacatctagaagattctacgactgaaacttaacccaaaatctattgtaagcggaatagtaaaatcgttttttgctaggtattgttttgtcaagaaattttcaagggaaaatcacatggatttttaaaaccaccctacacttggctattagaacaatataaagctcactaagaggataaagacgtacacaagtatcttagttagaaaatacaatataattgaattttgttttaaaatttctagatttaaaaagttacaagcatattaacaaggtacaatgtaattttatataaattacatcgtagcttaaaataacttacaacattctcattacactgtaatttgaaatgtggcttcaatttatttttctaataacgtcattaagctcatgtatacttataataccaaataggcatattgcatactttaatttgctggatcattttattacgtaactgtttcagctgggtctcacttattaaccagttgccagcctgattggccctgctctggttgctgcacgcacgccaggacatgacatggctctctatcagttgcagtctgtttgtgatcaaacgagaaaagcaaggatcttatacgtaaaatcaatggtgaaaattccgtctgattttaaagatgaaatctgttgaaagatatatagcaaaccagtaactgacatagtcccttggctcgtgagcttgtaactacatcgcatcccctagaagatagtatgctaatgggacgctatgaaattgcattgtcattcttagaaataaaatacacccgtccaaactcggataaaaatatatatttcttgctctgctaaaaaaagatcatggtaagaaatatggctctcatgaccgtgtaaaataaccaagtgttgaatatttcggaacggaggaaatatatatgttttgtggttagtctccatcttaaattaactatggggagaactgtgtaaaatataaggtaatctttatccatcaaacggtctcttggatatataggtcaaagataagttatgactccggttgagcctgtaatgaaacaggtcaaagataacttgggtggcctatcaatggtgggccaggctttacactatattttttccaaaaaaaaaatgatcaaacttaatgaaatttgacttagtacacaacaaaaacatctaaacctatgaaacggagggagtacagtggcatatgtacctagaaagttttatagatcatctctaaataaaaatggtgctgacagtagggtataatccatccaaaaaaaaagaaataattgtggggcatctttgctttgtgttgcgaagtttttttttcttgtaacaaggctgttttaaaaaatatattttttgaaaacgttggtactttttttagaacatgattttttttaattgtaattttgtttgttgacgtgcaatatatatgtacgcatatttttttattatcatctcatatgctccaatatgtttctaggaaatacatatggattggagcatacaaatcagttattcccagacactggatgtgattactaccaatcaaacactataacttcttatgtatccaattcaaccacaaaatggagcgcacttaattaatttgccaattagtccttcgctnnnnnnnnnnnnnnnnnnnnnnnnnnnnnnnnnnnnnnnnnnnnnnnnnnnnnnnnnn

SEQ ID NO: 13441 - DNA, 4069 bp, Oryza sativa
  unsure (1)..(4069): unsure at all n locations
nnnnnnnnnnnnnnnnnnnnnnnnnnnnnnnnnnnnnnnnnnnnnnnnnnnnnnnnnnnatcaaacactataactggttaggtatccaattcaaccacaaaatggagcgcacttaattaatttgccaattagtccttcgctcgctttttagttgtaggtgcattttgctagacactcagaaattgttgaatagcacttcttgtcctttgaacagcaataggcaaagtccctctcttcctgatagcaaacattcaagctcgcatggctgaccacgtttttcagtcccatcggaatattgcttccgatcttccttatggtttgacctagagatggaaggaatcatatgtactatatgttttaaaactgaaaaagaaatgatgaaatgacatataaatcaccaaaaaaaggaatttagttttcttattacctcttatttgtgcaggaagagcggagcacaccacaagaaccaagcaaaacaacatgagtccttggtaggcaggcttcatacatttcaccattgcgaaatatatatgacgttactatgttttacctgtcttattgtgatctatgtagtgaatgttggtttgcgtgaacttgaggagccatggttcatatatatagaacaaatatggctgctatatatggaataaataaatgctagcttatctggaggattttaatcataatctaaaaggatctggaagattagcctgaattatgattaattgcctatttgatgacaataaattgttgctgtaaaatgaaatatcgtaaagcctaattttagctacatggacaaacttatcttctcggtcttgcccaaacgtctattgttgattaattccaccttaaaagagcgattttaaaaatatatcacccttattcttctgttttatgataatagattaatgtttatttttttttgtcaaatctactaacttgtccgaaagtctaattttagtttcactctaaaacatgtcaggctgtactatagatttcaccatcaaaaggttctaaatgtttcttacttaattgcatttttatgacaataaattagtgcctacttagcatcaaatctggtagattatcctaattaaaatatactttcaatagcatggctaaatctagcaggtgactctcccaacgtatgctaatagcaataggccccgttcactgtttccttgcggtgaattcacctattaggaggggatggttagaattaattctccatggggacataaatgagaggaggcatgtccccgttggtttcacggggggcggggattgttcttcattccacgtccccgctccccgcgaagacccgcgtaggggccgggtccaactttaatgtattttagttatcctgtgtgattatattgtttgtagtctttgataaatgataactttatgtttttatcatgtgaattagtagaaaatattagtagatgtatgctaatatattcatataaagtacgaatatatgttgtattgcatatataatttgacatgtgtatatttttttaagcaagggtgaaatcaccgcggggatttattccccgtgcggggatggggatggtaacaaagcttcccccgctgtgtttcgcggtgacggggatgtctcgcgggggcagggatggggatgcattccccgaggtgaattctccgttgccatctcttgcactactaaacatgcatgcgttttcaaattttcttttttgtttaattgctcggtttatggcacgatttcttcactgtacttatcagattttgttggtgtaaaccctaccttctttaaatattatgaatttaatttccactttgttgtacgtatgtcaaacatattcgagaggtgattgtagttgttttcttaggcgttcggttttctccgagattcaagctaggaatttcccacgtctctgggttgtcggtatgtggggtcaaaatagagttattgcttttgtcttatagttaaaaattttagcagtaaatctactttgtgttttctctactatattccattgaatttgatttgttctatagtaggtatgaaatcggttcagatagtttccatgtctattatatattttttggcatgtctattatattaattaattattaattttattgttatatagataacattgaaattgagattattatgtggatacaacacatatttataattctgtgtttttcttaaaaaaataaaaacctaaagagtctaattttcaatggtatattatatttaacacaatttagtatattcttaattttgtaagcacggtacaaggggttttcctgttcccatagatattcatgaccatatttgttccaatacatatttactcagtatctgtattcgataatattttgcttcatttccttttacgattctgattaaaaaaatgaaaataaaatgatagaggtagtttctgttaagaaaccagtctactctactgatcagcacatgagcagataaacacaaacttatgttccccaaagttctacatgtgctatacatgtcagacacttataagagacatataggagattacttcttcaataaggttgtcctcatcatcgtccatatggacatcttcaccatccttagtgttgacaaacatgtcatcatagttttcaatgtgagcttcaggctcagtggtgaagtatgactcatattggctcattttctcattagagctcaaccagatgcttgggaacatggcagttacgagaccaatgctcaatgcctccacatctatagcaattatcatgttttccccagatgttccacatgtaactttcttgcattcggcttttgcctttgggcttacccttcccttgccccttgaacatgatacttcccttacccttctatctcttctccctgtggccccatttatggtcacgtgagtcgccatcaacatcaacattggcttgtccttcagacattgccgtagacccagtgggtcgagcggaatgattgtttaaaataatctcattcggcctttttgcaactaaaaggactgaaataagctcagactactttgagttcttgtattgttgttgaagcaccatgcatgttgttggggtggtaggtggataactttttctcaatcatctcagtatcagtgatcttttggtcacataaacataaccaagcactgatccaatatagggcagagttatacgccactataaatttgtagtcttggaagcatagggtgattaggccatgttgtgcccatgggagcaaaattgacccttgatggtcgcagcgatccttcagggattgccataataccagtggatcttcctcggtcatatactcagacttcatctctgggtggagatggtggcacaagaatgcaattcctttgctttcttcgcctttgtaggatcctctgtgccagcttcgattagcacaatagtatgaccaagacccatggagtctagcttaatttcaacatccaatgcagtgaggtagttgctaccatccaacgcaagctcgatgaattacttctttgttctatctgacatgtcccatggcatcattttgtatttataacaggtaaataatatgtgcagggtcgatataaactggtcatgagtaatttttatgatcactagcatgtgtaatctttaggattaccacacagtttaccatagaaattaatttaagtaatccttaggattacagattgcgtgattaaatattatgaatcatgctaggaaattaattatataacattaaaataaaatgttacgaaagatcatgcaaacaatatagtaagcatgtaaacaaaacgaagagcatacatgggcacaaactccatgcatattgtgcaaactttaaaaaagaatagaaaccagtaaacacttctccactatgagcccacgagccttgacggcaaagttgaccttagtgacagcaaggccccatatgggtgatctccatagaaccaaaggacatccataacacttttagggtcgtgtagaaggtttgtttgcctccactatttgcgggcaacggcggtagagccatccattaagtttacataccgatgct

SEQ ID NO: 13442 - DNA, 5675 bp, Oryza sativa
  unsure (1)..(5675): unsure at all n locations
nnnnnnnnnnnnnnnnnnnnnnnnnnnnnnnnnnnnnnnnnnnnnnnnnnnnnnnntgcgggcaacggcgggggagcgatccattaagtttacataccgatgcttcaggaacctttcatcatctgtagcattttaacgataatggtagcagagccgccatcatgtatcaactaatgctgagaggatgtatcatctcaagcctttggatggtaacggcggtagagccgccttcatgttactaggcattgctgagaggatgcatcatctctagcaattggacaataacagcgatagagccaccttcatgttatcatgtattgctgagagaatgtcagaggatggtacttcaggtgccatattgttcttctgctcatttcaactatagtagaaatattatttgcatattaagaacaagatgatcattaggcattggtttctcagctgtttacctgtttagcttggtggagactcgtgctggtaacattttaagaagccattctattctactgatcagcacaatagcagacaagcacagagttgtggaacacagaaaatatggatgaatgaaagctttatttcatcggattgcgtacaagttacatgaggagattaagtatgaaaatataattcaaaatgatgttttagagaagattgagtatgaagatataattcaaaattttatttcaaagaatatcaaaaggattatgtttttcagtagaacatgaggtcaggtcaaactattttagcattaatgttttatatgttcctaagaagaaacatatctaaaaattttatgcttttgttatgctccgttttcatatttttggggcccattttacgttttgcacatgggccccaaaatcatagatacggccctattcatctgtaacaagacgcatcacctctagtacatgtgaagcctagattctggtttctctcttcacctctccctaccttttctctcccctttggaccacctatatacccatggttgatgttagcttcctccggtactaccccatttgagctgccaccgtattctttgaaagccattaattatctggaatttactattaatttggtaaagcgtgattttctctttatatatactaccgggagtagctactcctgcatcatctgctatacgtgctttcaagccgatcgctattttcgtgggatacaaacttttgaatgcattatgcacgtcagttgtttgcattatctgcctgacggccgcatatatatatagagagagaaaatcctctatgtacccatgaaagttcacctaatcccttctatacccctgaattttgctcaatcccttacatacccctgaattttagtttggatcccttccatgccctttccgctagttgaccgttagttgactgttaaattcttttgaaaaagtccattttgccctttgctataaagaaacataataaattaatgaagtatattgttggaatgtaaaaatttattggatgagactattatatttatgagaatgtgatgcaccatattatttgtgacaaatttacttttacatatgatataaaaagttaatacttatttattagttattaaaagttcttttatgtagcatatgtgttttcatagtaatacaacatatttatttattactatcagaacacatatgctaaaaaaacttaataactaataaataagtattatttttttatatcatatctaaaagtatatttgtcgcaaataataaggtgcataactatctcataaacataatagtctcatataacaaatttctatgcttcaacaatatactctattaatttatatgcttctttataccaaagggcaaaatggacttttttataagaatttaacggtcaactaacggtcagctagctgaaagggtatggaagggatccaaactaaaattcagagatatgtaagggattgagcaaaattcaggggtatagaagggattaggtgaactttcacattatgcccgttatgcccattttctaggttctgcattttcaagttctggaggagcagaacgtatccatgctggtattcaattacacaagcagaacttgatatggggaccagaacgaaaatgttctgctcttgtttctgctggagccttttgctctaatagtagattgaatcgtttttgaaggaacagaaactattccgtcacatattcataattataggaacagggagattagcttctgttgcatgcgtatacatatttctgttatgcagattagctgctgccatattattagcctgttttttcgtttgccggctagtatatatcttctgtcggccaggagcagaaaatcaattccaaaaagagcagaacatcagttagttagttaggagcagaaaatcaatttgaaaagagcagaacatcaacaattgcatgtgctgcccgtttatatacaacatatcaccaaacagtgctcactttcaaacgaaattaataataaaaatattggtttgagagcagaacatattctgcctccttataagtagatcgagtttgttttgaaagagcagaaggtattctgctttcttcttgccaaagcttcctataagtaaacggactttgttttttggagcagaagatatatattctgctttcttgtttctagaaacagagataatttcaggtacaaaattcaaatctctttctgctccctttctaaccgatgttctgctcctttggtagtttctgctgattttcaagttttggatcaaggagcagaacttaccgatgatgagatttaattagacgagcagaagttgaatatgtactacttatctaagtacgtacacagcagaaactatacccagcagaaactcggttatgcagaatatgtactacttatctaagtacgtatagatgacatacagtatgttagtaatcaaccgacagaacatgtactgccgtcaaaaacggatacggagaaaaaataggtggctgttctgctaatttttttatgttgatgttctgtcattctttttaattcatggtctgccattttttctgttggccggctaatatatatgttccaccggcacgagcagaagataatatgtcaggacgagcgggtgggaggaagaaactgcatccgagaagttggtttgcatgcagccgatgatttagcaactatctgaactaacaaactatttaattaaacaacacgggtattcatcgttattggatcctcgtcactccactaactgaatccgatccataataggagggagtaactaccctcggtagtaggaaataggtgtcctatctatctatctatctataatataatagatagatatagatagatagatatctataatagatagatagatagagagagagagagagatttgagctcggcattgacaattttaatgtggagaacatccaggacgagaatagtcacgtgcaaggcattgtcaacaaattagatgaaagtctgaaaccatgttactttgttgaaatgttaccgacaagagatacttgattaatcgattttcttttggccaagttccgagagaatatggttgtgcagcatatgaaatttggttcgccatatgtacaatatattgaatattgaatattgaatgctgcatcaagacacgggatgaatcatcacgattcttgagttacattgcatcaatatttttctgaaatgttcaacatctggtcctattttccccatataacagctggtaacgcacatcacgtatgaccattctggtatatatcatatatgtggttcacttgatttttttttatttcaatactagagtgccaatcttctttatgtggtctgaatgtgccatgaagaaaagtatgtcatgcatatctcattgaaaaaagataatgtggttcacttgaattttgatttcaatacaagagtgccccgagatccattatggcgagttgtagattcatgcatatctgtatagtatccttgaaaaaaaaaagtcactccgcagatgtgtgcagtttgtacattcaagcatgccattcagaaaatcattaaaaatgttcttctccaaaatgacattctggaaaatgatatcagttaaaaccaatgtaccagttaatttatattacaaaaacaatggatctccattcaccataatgagatttttacaaaatggtatgtctgttacatctccatactgacattataccaaaaaaatgcacatgaactaagattttttacacaatccaacttttctttctccaaatataacaaggtcagaaattagcatcactaatcactgatccggaatcaagaatcccagctcacttgctctgccatcttaatcagtcgctccagattcctgctcacgcagaaagtaggaacgcggccaccacatgcctcacctcatggccgcctcgacgcgtgccctcaccatcgcagccacctcgctgcttgccgtgccagtgctacatggtaaaaacgccagcctgctcctcctcccttctggcttgggagctcaaccgcgccagccgccaatcccgcaggtcctaggagccgagccccatgtctatgaagccattgcagagcgacaactggtgcagcggccatgaaagtggctgcctgatccggcgacgaggctcccgtcgacgttgacctcggctgttccttctacttcctcaccggcttcgtccgaccgtgggggatcgggagcagaagggcatttgagaactggagaggggtagagagatgattgaggaacaggggcgtccacactccacaatttccccatggagatgaaggggtcagtggatgaagggcattttgggaaggacacggtacaaagtgcaccatccatcagcaattccgcagcgcctaaagggaggaaagcaggcatggtacatcctattatcatcagtcccaagattcgtgcaggggaatggagggtgtagattgcgagtgcatgtgcactcgggtgcaaataatccaattcctatatatatatatatatatatatatatatatatatatatatatatagacataataatccaattgtgagtaataactaaaacactccccctcacaccctacccccacctagggatgaaaacggagcggatagtttccatccgctccggataaaaacggatacggatacctttcggatcggataattctcggatatttcatatacggatacgaatacgaatattttctcccggatacgaatacgaatatggtatcagggtttccgtcggatacggataataattcggatatccggtgaacagtgttattcggatatccgcaggacccatgagacataccccatttctttctaactctataaccttcaatatacctttatagattttaatagtagtttatctcttaacattagtccatactattaatattatttaaattttaaaaaatatttataaattatacctcattttatataaaatgagctaattatatatgttgatatttatttctattagaagttgagttggttttcgtgttccgagaaaaatttgtttccgtattcgtgtccgatcatattcgattcttattcgtattcaagataatccgtatttgtttccatattcgagctatccgtattcgttttcgtatccgataaaaaatatgaaaacgaatatggtatgagcattatccgtc

SEQ ID NO: 13443 - DNA, 6345 bp, Oryza sativa
  unsure (1)..(6345): unsure at all n locations
cgagtcgggatgtcggtggcggggccgtcttctctgccttcccgcgccggtggacgaggaacaggaggggatggggccggcacgtcatccggcagcggcgccgcggtgatcggtcgctgctccccgcccgctgttgctgctgctgctgctttcctgtcttcttgctctggtttttcccctctcatggcggttgctctgtctagagactactcctcctttggaatccttttcagttttggttggattaattggagttcgctttgctgcgcgattgcaattgttcttgattgatttgcttggctcagaatagtccaaggctctgtccttgtttctcttcgcatactgattcctggttaagaatggtcttcgctttgtgcactcgttcttctgtctccacgaagaaaattggctttctcaaaaacctgcaaaactggaaacaataaaaacgaaacgaattgcatatgattattatgttgctcgcaaacggaatagattgaatcagcacgattgatggatacagtacatagtcttgcttgtctctgactttgctctctactgataggtacagatgagcctgggaagcaagtcgatctggagtgctgtcaagatcaagaacatcagcaagtctaaatgtagcatttaaggtaattaacagagctcctctctgatggcttcttcatcaaattaaatgctaataccagtggttttgcaaatgatggtagttaccagtaactcagtaagtagtagccagcagtccagctcctgttaatttcaaagatgctgctcggattaatgataacatcaatcctctcaataactcaggttgaaggtgaactgtattttaggatgaaatcaatcctctcaataactcatattaaaggtgaactatattttaggattatctgtcaatttagagatgttcatattttaacagatgactatgtattgatctccaccataaaaatctgttggttcagtccccacctacactaatttgatggctactaataaagcactaatttgatgcatgccttttgttctggttccaaataacagcaccaaagagttgcttcataaaacctccaggtggcatacttgttctagcagtacaaacaatttcagcttttcctagtttagagatttgattctggcatgactggtatggggaatatgattagtgcttggcttttgggctatcggctcataagtcttcggacaacatttaattgataagccaatagtttctgaaattttctatttgatgtgctagtagattcttagattttctagttgatattttattaggctattagcttctgaaatttcctagcttggaagagtattacttgataggcaatacagttctctgaattttttttgttcacacagacatgtgcagaagtgataattttttaatccgtccagtggctgctctcaactcacctgttgatttgcagtggttattgctgaatgaaagatgggagaattttcgttcagagaaattatattcagagttctgagtgtcatgttctctcagtttgcaagtacatgcccttctcataaatttttagtttggtcggctggacaatttgatacttacagttgtgtcaaaagctctgaaatgttatgaaaattatggggtttatagacaaatcatgctctaaatgtcaattagaaatatgtcatttgcaaatttgtgtgtgcagtattctgagaaatctgctctcatctgaattatcatcatcatgttctctcatatgttggcgggttccagggtgaaggttggatcctcggtggagcatgccgatgctaccgactccaccatggatgtagctggcagtgggattttgacgtcgaccgtgagtcttcggcaccggcgatggtatttggcgagttgggatgtactcgcttcatctcaatatgtagcaacctcttccagatttgtagttctagtattggtttaatctcatcctagattgtaacatattgcgacggagggagtagtcattggttacaatcttcttgattttttttatcaaaatgaatatgtgtatgtctatttcccatctgtaatttttattggtaaggaaccagccaacaccgtaatattgtattcatgttgtgtaggatatataatttgaaaaaaaaactcttctcatatattgtcatcaagtaaaacatttactatgcgttaataagcgttcatgataaaaatactaatagattgatacatagcattaaaaataaaaatcacttggcagtaaaaatactactaccacaaataaggcatcgagctactgaaaataactaaaaaatcattactaataataaggaacttatctactaatatcattactaataataaggaactaatctactaataataagaaattaatctagtgatatattcgtgagtaactgatttactgaaaagatctaacatgactaaaagccaataatttatttaccaaatgaagattggttgggtgaagtaatctgttagtaattttttttaccgatgcttccgcgagggaagaaaaatagcagatgtgaatgagaaaaaaaaaaggaaaaaaggagggagcggagggagtacggacggttggaaaaaaaaagaaaaacgtggcctggagtgggtcaggccgggggggggggggggttagggtatctgaggggagcgttttagttattacgcaccctgggtgtagtttagctctattatatatatagtagctctattatatacccttcccttagaataactattctacaccacctccccaaccaactcccacccgatcccgccctcccccctctctcgtcgcgatcccgcccttccccccagtctcgtcgcgcccctccctcctccctctccctctctcttttttcgatctctctcccactcctggcgccctggtattttctccctctccctcatctcgatctctctccctctcctggttttttctccctctccctcatctcgatctttctccctctcccggcgccctggttttttctccctctccctctctcggcgccctggttttttttctctcgcccgttggcctctccccctctaatttttttttcatctcaccttggaaagaaaatttaaaattaaaatgacaaaatcaagactttaacccatgaccttatgattcaaagaaattctctattaaccaattaaccatatgagatcttgtgattagagtttattgcatcaattttatgtctctattcaagctttatgagagcaaatcacatatattgttgtgaaacttataatctgttattatgttccagtagtaatattattgtaaaagtgcaataacacgtcacgttactgcaaaagtatataggttgttactgtagttctgacaacatcatgtgaactagctgggtggcccgcgcaattgcgcggctagcgcccaaacaaaatcatatatttttagtatgattttacttaaaatttattaaatacctatctcgttgtcttaagactttgaatgactaaaccttatcatccccgtatttctagttatatagtttttaaaagtcacaccaatttctaccccttacttctgccatctccttctttatttgctggctagatctaccactttctattcattcttcttggaacctttaaaaattggatcttatagtttttagagtttttagagtctattgtcttgttaggtttctttttataatttctagaagtcacatcaaacgctgccattatactactctacggttcgtccaatgtcttttctctttattgtcattgggattttaaaaatcgaatgtaataatcgttcgggtttattttttactttttagaagtcccgccaaaccgttagtggctttgccattgaaatcctctatggcttatctgctgcctcccttctttattgtcattgagattttaaaatcgaacatgattatcattggtttttttttactttttagaagttccgaacctttaaaaattggaccttctagtttttagagtttattgtcttgttgggtttcaattttcataatttttagaagtcccgttaaacgatgccactatactcctctacggcccacccgccgcctactctttattatcattgggattcttcgaacataactactgttggaattcattttttattttctagaagtcccaccaaccatcggtggctctgcgactatactcctatacacccagcccgctgcttctcctttttattatcattgagattctaaaaatcgaatatgattattaatgtggtttattttttttactttctagaagtcctagcaaccgccttgtccgtttgcttcacgacatacctgttgtccctccttttaatcgtcgttaagattctatttggtgttttattaacagttatatgtcgtatcaaccgccaccactctactcctttataggcatgttacttaatttatcttgtcatgtgttttaggtggtcttttctttcaatagtccttattttctatcaccaattagttatcaataaattgtattccttatggaaatttttttttctttttctaatttcagaatttattttttttttcaaattttaaccaatactgtatattgttcttttaatatttttatttttcaattccagttgtttcaaaattgtattcctactcaaccctcttttactttttttatattattttattttttattcagaattttaattaatcttgtatcgggttcttatatggattcttctttcaatattgcttatttttaatttcgaatttctgttaattttaaattgtattcctacttgaactcttattttctttttgctaattttagattttatttttatttttcttctgaatattaactaatatcgtattgggttcttgtattgactcttctctcaatatttcttatttttaattccgaatttcagctatttttgattttgtatttctacttggactctacttttctttttctctgattaatgtgggagtttctctgattaaaaattgaacataactatcattggaatttattttttattttctagaagtcccgccaaccatcagtggctctgcaactatactcctatacactcaacccgctgcttctcctttttattgtcattgagattttaaaaatcgaatatgattatcaatgttgtttattttttttactttctagacgtcctggtaaccgtctagtccatttgcttcacgacctacctgttgtccctccttttaatcgtcattagaattctatttggtattttattaacagttatatgtcgtatcaaccgccaccactctactcctttataggcatattacttaatttatcttgtcatatgttttaggtggtcttttctttcaatagtctttattttctgtcaccaattagttatcaataaattgtattcctaatagaaatctttttttctttttctaatttcaaaatttatttttttaaaaaaatttaactaataccgtatagtgttcttttaatatttttatttttcaattccagttgtttcaaaattgtattcctactcaactctcttttactttttttttaatttttgatattattttattttttattctgaattttaattaatgtcgtatcgggttcttatatggatccttctttcaatattgcttatttttaattacgaatttctgttaattttaaattgtattcctacttaaactcttattttctttttgctaattttagattttatttttatttttcttccgaatattaactaaaatcgtattgggttcttatattgactcttctctcaatattagttatttttaattctgaatttttatttgtcttccgaatattaactaaaatcgtattgagttcttatattaactcttctctcaatatttcttatttttaattccgaatttcagctatttttgaattgtatttctacttggactctccttttctttttctctgattaatgtgggaatttctagcccccacagtgaacgtggtgccttctttcaaagctgttttaataatataatagatattgtagtaacacggaacatgtatgtagtagtaacgatacttctacagactacgaatgttgttactacgagcaagtaatcatatgttagtacagtatggttgtcttgttactgtgcaattcctgcgagatgaggatacgaaagaggtgggcgtggagggaagtgagcaacacaaaagatacataatagcaaactaaacacaagtggattatttgaaattnnnnnnnnnnnnnnnnnnnnnnnnnnnnnnnnnnnnnnnnnnnnnnnnnnnnnnnnnnn

SEQ ID NO: 13444 - DNA, 1584 bp, Oryza sativa
ggaggtgggtttgacccatgggaggggggtgtagaataattattctaggggaggggtgtagaatagattatatatatatatatatatatatatatatatatatatatatatatatagagagagagagagagagagagagagagagagacgtttatcctggataatcctgcagtcctgccaatcgcgctcaactttctttttcccagactcaatagttgagccttttttgcatgataaaagaatcatttctgagatagattgcttggttttgtttttcgacccatcatggttttatgaattggaaccatagttggttgattagcagcacatccctgaacataacaaccatgaaaatagcagaacacacgctccaatatatttttagaaagtgcatatctcggctggaacaacgcacatcagctattcccaatttttcttttatatgctattcccaatcttctggatacatgattattacctgctcgatctcagtataagcagcagtgtctaatcactgagacatacaaagtgcagcagttagcctttgtgtcctctgctcaccttttccttgtagttgcactttggaaggcattgctcaagggttggatagcacagctggtcctttgaacagcaatagaacccaccggcggtcacggcgcaaacattaagtttaactccaatgctggctgccttttttactcccatcaacatattgcttccgatcttgcttgcagtttgacctagagatgcaaggagtcattatgtttatcttgccagtgcaaacaaaatgatgaaacggcatatgaatcacggaaaaatgcaatctaattttctaattacctcttgcttgtgtaggaatagaagagcacaccacaagaaccaagaaaaagaacaggaccccttgattggtgtgcttcacacattttgccattgtgaaagatatgtttactagtatgttctatatctgtcttgttgtgactaatgagtgtgaaaaagtatagcagttatatatcgaagaagactagcgtgtcaaaataggtgtatgtcttatccttgaatccctaagtaatctgctattaaagccacttctaaatatgggttttgaaaatggttatgattaattgcctgttttatgacaagaaaattatagctctagcatcaaacaagggaaattatcctaaagtctaattttaatagcggctaaatatgtctgtgtcttatcctaacttgtattatcgactaatgccattcattaacaatgattttcaaatgggcatatccatacttttctgattaatgatcataaattaatttttattttggtattaaatctgctaaattgtcctaaagtctaattttaatttcacttccaaacatgtactgtcaagctgcttctatccattgcactatacaatggtcttctaaatcgttcgtctattcatacttatattgattgggtactttctaccgatttttttacaaattgacccttttagaaaacttatttcaagaataaactatgccaaaaacttattgcaaaaatagaccgtcagctcacccccatagagattgacgctgaggtat

SEQ ID NO: 13445 - DNA, 1990 bp, Oryza sativa
gcatgcctgcagtcgactctggaggatccccctttaatttttgtagtatgaatgataaactaaaagtccctagatggctgaaggttgaagaaactgtataattgagcccctctaaattttttttcctggatccgcccctgctccccaaatgtatatagcgtcacaaactgcattatacatcctcccctaatgacataaaactttagatccaacttaatcaaccaaagtgaacgcacaacatgagacagatgacaaggatctaggagtactagcttagaaaatggaaataaactgttgcccacaatctgagccgtaaacatcacattgcctgatttttaggagctgaagccacagctgcaacggcaacctcaggattcatctccccatcacctgacgattgctgcatcgccgggataccttgtcgagtcagcggagtacagagtggcgttgctgcacgagagaagaatcctctggagaagactaacgaggccgtcgtcgagaagaaatcgccggagttggcagttgcctcctcccatcgtcgccacgacagcatcacccaccaccaccagtggaagatggaaaaaaaaaaaagtaaaaacctgacccccaccgtcgaacaagggtggaaaaaaacagatccaacccgaaaatagctttcgggcccgatgaaagaagcgctaatcttgaagagattggacggctggaaattcgagtgcgagttagagaaaaaacacgccggtgatgtatagcaaataccaataattaatatgtattacctagaaactcaaaacagtaagaagaatttaggccgtgtttagtttcccctgttcccaacttttcattacatcatatcacataaaaactttcctacacacgtaaacttttaactttttttccaattaaactctcaactttctttaaacttttaacttttttcaggaacttagcacaccgttatatacaaattcatgatagtaagaaattttatgtagctatctgcattatagtttgtcaggtcaaggactacgaccaagtagttcaccggataaattagtagcaaaatgtaatggtcgctatattagagccgatagcgtaagttgtaaatgatgtagtagtaaacgctttttattcactgtgaatggtacatcaaacttacacacagttgtacagggctattatgacttccttattttttattttttagggagcactcctcttctaaatctaaagtactacctccatttcaggttataagatttttgattttagttaaagtcaaactgtttcaagtttgactaagtttatagacaaatatagtaatatttataatactaaattagtttcatcaaatcaataattcaatatattttcttaataaatttgtcttaggttgaaaatgttattatttttttctacaaacttagttaaacttaaaccagtttgactttgacgtctcataacctaaaacataaaacggaaagagttgtcgctacttcaaacttcttgtgatcgtgcaatttctcgatatacgcctccttctccgtaggttccttgtccttgagctcctcacaatcttcatgcatcttcacagtatgttgccgatggtaaacctttgttgggtccacatagccaactggttttctcaacctttcagcgtcgtggaagtgtgacttacagacaacagctagcttgtgttctagttacttttgctttattgtataaaaatataataaatactttattgattgattaagatgtatctttttagttgtcttttcataaatatatttatatgtatacagtagatattaaaaatatgtacactacaaatgtaataatattattttaacttattataatgtcagaaggagaggagtattttttggaacattaccaagacttaggttcatttagttttttcatcgtatatccagtttaattattattaagttatatacggtgataaaatctattcattattttttctcat

SEQ ID NO: 13446 - DNA, 2268 bp, Oryza sativa
  unsure (1)..(2268): unsure at all n locations
nnnnnnnnnnnnnnnnnnnnnnnnnnnnnnnnnnnnnnnnnnnnnnnnnnnnnnnnnnnatatttataatactaaattagtttcatcaaatcaataattcaatatattttcttaataaatttgtcttaggttgaaaatgttattatttttttctacaaacttagttaaacttaaaccagtttgactttgacgtctcataacctaaaacataaaacggaaagagttgtcgctacttcaaacttcttgtgatcgtgcaatttctcgatatacgcctccttctccgtaggttccttgtccttgagctcctcacaatcttcatgcatcttcacagtatgttgccgatggtaaacctttgttgggtccacatagccaactggttttctcaacctttcagcgtcgtggaagtgtgacttacagacaacagctagcttgtgttctagttacttttgctttattgtataaaaatataataaatactttattgattgattaagatgtatctttttagttgtcttttcataaatatatttatatgtatacagtagatattaaaaatatgtacactacaaatgtaataatattattttaacttattataatgtcagaaggagaggagtattttttggaacattaccaagacttaggttcatttagttttttcatcgtatatccagtttaattattattaagttatatacggtgataaaatctattcattattttttctcataattttataattttttgaatcggacacaaaggtcggaaaatataaccaaaagttacatatatttttaaaagttgaattatagtgaatgtggacccttaaatgtaaaattatataaagaatgcggtgcgtatgtagacatggaggtcttttgattaaaataacattatttatataatttagatgtcatagctgcttaacttttttgcacaaaatttgatttctaactaatatattttgggaacattacttctgtgttctttgctaaacggtatgtttttttaaaaaaaaaaatctatacgaaagttcctttaaaaatcatattaatccattttttaagaaaatagctaatattaaattaatcatgcgctaatgagttgttttgttttgtgtgctcaagagattaggtcctgaacatacgctcaatgaggaagcccggttttcatggaagtggcggagaggcgattgctaaggtttcggctaaaacctaattggatctacgtgattcgatcatgatctctcctgtttctctatgggagtctcatcaagatctaatctttagtctctctttcaccgctacgtttagtcgggagcagatttctgtctgttttgactcggctttgaccctgtaggacttggtccgtctgctatttttctagggtttgtgcttccgtcgaaaccctagtatggctttgatctgcttcgtttgcctcgcctgttgttttctcttcctaggagttctggtggtctttggtgggggcgatcaaggggatttcggtaaattatgatatgtatgcatgaagagattgctcttgctggagttggttggagttggtgagaggtgatgttttcttttgaaccgaatgaccaccggctaacacgtgctggcattggaattttttgcgcttgtctaaccagttggggaattgaattttcagatgatatcactgaattgcttgctgcatcaatagatcaatttatgctagtccgcctgcacagaacattgagcggatttagacacaggagcctcagaatcgaaggcaaccaatcaatgctacaggattgttgaagagagcataatagtccatcataaaatcacatgataatgaataatgacttaagatcgttagtttaacgactctgcctattgcaatttgccataatagattaatccttaatctgattaatgaatcaatcgtaccagcatatgtcgacattggcgagtggcctggaatacaatgaactcatcgggagtgaaagggaggttatcgagaacacgaatctggctcgtagttagtgacgatggcgcccgcctggaccagcctctcgtcgtgcttcagcacagcacagagtagggttttttttcattatgtctacgctgttatgattcggtaccacacagtgacacagggtttttctttctttttttctagtacacaggcttttaattacatgtttcaatgggcttttagttgcacgtttattannnnnnnnnnnnnnnnnnnnnnnnnnnnnnnnnnnnnnnnnnnnnnnnnnnnnnn

SEQ ID NO: 13447 - DNA, 4721 bp, Oryza sativa
  unsure (1)..(4721): unsure at all n locations
nnnnnnnnnnnnnnnnnnnnnnnnnnnnnnnnnnnnnnnnnnnnnnnnnnnnnnnnnttgtcaaacaccaaccatattgtctggtttgtttgccactgttagggaagcaacatccagtatatattggttgtgccattattgattcacaatagaaatcacctccatggaaataattgcgatgtgcccatttggaattaacaatctcgtatattgaacaacataaatataaacagttagtacaatgagtaacaataacattctctgtctctattttatgaaaaggtacagagaacacacacattgtgatgttgtgatgtctaaccttactgaacaccaacacgtgaacgttagatatgataaaaatttgtaatcttggattgaagatgcagtagacagacgggagaatgctgaccactattcaaagaaccaattcttcatctgtaattattgtcactggatgcacctttctcatttgtttcgtcatgaatcctaccatcgacaaggatatttggaagaaaaacactttgcagcaaattaacaaggtcaatgcaagctgtgttttggatggcaattcattaatcaactcaagtatagcacaaaatagaaagctttatgtttgatgaaattatgaaagggtatatagcctagtggttgcagtaatctgagtagcactgaatgtcctaatgtcaaatcttcataggagcgaatttttgggttatttaagggctaagttccctatttgataggctaagttcctaatttcaaaaggctgcatatatcctaatttaaaatatttgacaaaactaatgaaaattccaaataatgagtataataattgttcgggctgaaccaatacactttcaatctgcaaactacaattcgcaaaccgacaaacgtatttcacacaatcaacccctcatctttccatgaactttgaggatagttttaactagcaaatcagcagcgaaacaacaataaacacatgcacacaagacacggtgatttacgtgaaaaaacctcctcggtgtgaggagtaaaaaaccatggaaccaacggtccactccaagcttccacaataatcaacaatgggtacaaatggagtcttctctagaacatgtagaggtacatcacaacagcagctacaacatcaagttacacacttggtatcatcaacatcaaccatcaattagctacaacatcaagttacacacaagaggtatatcaacaaacaagcaaagaaatggcagattctatcctcttgattagaaccacatatgcaaattgcacgaaacttggcaaaaatgatagtctatgagtcccttcctatatttccaaaaaacagcccaatcagacaccatttgaccccacaaactgacactttactaactgctgcacaatctataatttcaataactcgagctgaaaaactaccactcaaatctagtgctctacttaaccaatcctcatccatactgaccagattgaagtgctcaaagtgaggaacaaactcaccaagtttggtgccaatccaaccacgtttgagcctccaaacgctggcttgatgaagatcgggtaagagcccccactactacagaacccctaaatggtgctggttgggaaaccctcttaggtgcggcacagatcacataagcctaaaggtgccggtttcaaaaccggcacatttgaggtgcatatgagccaaaaaaaaatcggctcgttgcatcgaactgttgagccgatccctagaatacccaaaaatactccaaatccatgaacacatctagatcaaacaaatcacaaatcaacacatcaacaaatatcaacaaatcatcacatcaacaaatatgaacaaatcatcacatcaaaatatcaacaaatcaaaaatcaaaaatcagccgctgatgacgatgccgctgccgcagatgggaggatgatctcgggccgctgctgtcctttctcccgccggatttggcggaggaagagcgcctccggaggctgctgcttctcccgccaaacgccgccgctgccccacgccgctacagcggaagggactgcgctgtcgggccgccgccctccttcctcccaccggatctagtggaggggatggcgctgtccggccacacgccgacgacgccgacgccggcaccgacgcacgctgctaacgacgccgacaccgatgcctccgctcctcccaccgctcttcctgccgccaggagaggagaagagaaaggaagagaagagaagaggaggtgtgcggtggagaagagaaaggaagagagaccgagagagagagagagacacgtgagaaagattcggtctcccttatccgcttgatgagaccggggcactctcccttatccgctcctcaggcggctcggctcacggctcgatctgaaaggtgccgttttttttaaaaaaaatgacatctttaagtaaataaccgacacctataataaattaaaggtgtcggtttttttatagaaccgacacgtataatagcttaaaggtgtcagttttctgtgttttcggaccgcggaggtgggaaaagacttataggtgccggttttagcaaaaccggcatctatagtgccgacactatagatgctaacacctatttgatgttttgtagtagtgccccaagctgaacaagctgcacttcttcttctccactctcctctccctctcttgtgtttgttggttgtttcttcacctcaaaggctgctctgctcactctccctccaatggaaactagggtttttcttcccaccataaaggatgaggcaatctcaaccgttgatcaaggcatgaatcagtggctcacaattgttggacattttgggctgtaaatgggctgagaacaaaatgtccatatggagggaatttagcccaagaataattatgtggactttattgagctttagctttactgctcgaacctggtggtatcatccataattttattcctgccgaagataaactgtttaagtatgataataaaatttcagtagtatttgaaaaaatccacatgtcaggccaagttcaagtattcaagctaattcactccaataacttgtctggaatactcaacttcaaagaaatgctaaccagtcaattcttcaagtgtgtgtgctactggtgccagtgccggcgccttgccctccgcgtgaacgctgtgtcatactatcattgccagcctcacctctggcgttagggctcccattgtgtagtctagcacattcctccaatcacagttcaccacccaccagcgcaaatcgaatcactgatttgggatctagggttagggattgacattgggcacaaatttaatcattcgaataaatgcaaaatcgaatcagtgattagggatctgaggtcttgagtataccatacctttgagttgcagagcggaaagcctcacattgtaagcataccatcctcgtcgtcagccttgtccacctccttcccagctccgatccccggtgatgtgtgcccctaccgtatctggccttgctagcatgtggtgaccggatcgcacaggaggggattctggtggggaataagtttactttgactcccttaactagtgaccgaatctgattcgtatccctgaaccacaataccggataattaaccgctaaactattaatttaaaaccaattgaatttgactccctcggtggttttggaaggcggtttcaccgacgtggcgcctacatggcggtgttgactcggtctttattacacgtggacctgacgtggcgtttaggtgcactagaattaaaaatagtatgtgcgggacacatttgtcatttacacaaaaaaaattgtgagacccactaacatttgggggccaaatgtcatcccctttccctccttcttcctcttttctctctctcccttatatctctctctccccatttctctccagtcttcacgggagggccggattatcgacggcggtggcagatgggggctggagcggcagctgatggcgcctcctccaacccatctcgccggctatgcggtactctccttcgacaaacaacgtgttcacgctcgtcgccaccaaatcatcatagagaatgcccgcctcctcagatggcgcatgccgagtaggagccggggcgggggaagcgacggcgtgtcgtcgaccgtgaggtggctgcagcaggatgaggaggaggtggagggcgagaaggggagtggaagggagggaacggagaaggagccctcctccaagccgaacgcaagacgtgccctgtcgccctcactcagacaccccgccgctagggaggagcccatcggcactcggcaccaccattggggaggagcctgccaccaccggcactgatggggatggaggaggcgccggtcgctgcccctgtcgttgctcctccgatctggcccctctactatgaagaccgaagagaaacggggagagagagggaggaagaaggaaaggggatgacatgtgggccccaaataaatgccacgttagctccacgtataacaaagaccaagtcacatcgccacatcagcgaaaccatcctccaaaaccgctaagggagtcaaatttaactagttttaatagtttgggtgttgaaatatctggtattgttatgggatgtgaatcatattcggtcactagttaagggagtcactactnnnnnnnnnnnnnnnnnnnnnnnnnnnnnnnnnnnnnnnnnnnnnnnnnnnnnnnnn

SEQ ID NO: 13448 - DNA, 802 bp, Oryza sativa
  unsure (1)..(802): unsure at all n locations
ctgttgagaatgttaaggcgatcacgacgaggggtggtaagtccacttgggatccaccgtatcctaacgttgtaggaacaggcaacgctctggaagcaccatctagcaacaggctgtcgaagaagtttggccagaaaggaccgggccgcaggaatgttgtgacatgaggctgctgccattcccccaaaggtataagaagccatcggtggatgaacaatttgctcggtttgttgaggtaatccagaagatccacatcaacgtgccattattggacgcaatgcaagtgcccacctacgcacgttatctaaaggacatccttgcaacaagaggccactaccgacaaccaagttggtcaaactgacagaggaatgcagcaatgttatactccacaaactcctagaaaagaagaaggatccggggtgtcccacgatcacctgctcaatcgggacacaaaaattcaaccaagcactctccgaccttggtgcaagtgtgagcgtcatgcccaaggacgtcttcgataaactcaacatcacggtgttgacaccaacaccgatgcgcatgcaactggctaattcttcggtctgttacctagctaggatagcggaaggcgtaccggataagatacgggatttcttcatctcggtcgacttcgtggtgttggatatggattcggagaagaaaacgtcactcattttggggcgaccattccttagcaccagggacgccaacattgatgtnnnnnnnnnnnnnnnnnnnnnnnnnnnnnnnnnnnnnnnnnnnnnnnnnnnnnnnnnnnnnnnnn

SEQ ID NO: 13449 - DNA, 688 bp, Oryza sativa
  unsure (1)..(688): unsure at all n locations
nnnnnnnnnnnnnnnnnnnnnnnnnnnnnnnnnnnnnnnnnnnnnnnnnnnnnnnnntaaaatttcattaaatgctttgcttaattctataattcctagatttttctgggatttatttgagctaaggaagtatttttaataaatggaattgcatttaagaaataatttaaattgaaaaaggttttaaaagtctttttggctttgggccgaaagtcggcccaaaacctcccttctctctctcctcggcccaatccggcccagtccgccgccgcgcgcgcgcgcctttgctcgctgacaggtgggtcccacctgtcggacccatcgtctacctcgcgccgccgccgcccgaaaccctagcgcgtcgccgccgccgtttccttccaaatccggccgctcctttccgtttccggccgaattgatagaggggaatcaatctccgggatctcctctaccttttctcctttggaaacaccggctaaaatcgtttggaaattcgtggattcgagtttgtttcggattcgattttcccgaactttccttctcgtcgccggccgccgtgggcctttgccggcggctccgagcccctttaaaggacccccgagctcttctttacccgccgcaccctcgcctttgcctctcgtcgtcggaaacgccctagcgccgtgtgccctagcaccgccgtcgccgc

SEQ ID NO: 13450 - DNA, 550 bp, Oryza sativa
  unsure (1)..(550): unsure at all n locations
nnnnnnnnnnnnnnnnnnnnnnnnnnnnnnnnnnnnnnnnnnnnnnnnnnnnnnnnncaggaagagaaaggtagctcagttccggtccaaccaaggaagccatcagcgaccgcgcttcacacccggacagcagggtggacctaccaccatgattgtccgccagcatcgcccgttaaactcaagcagtttccaccagggcaagtggcagccagagccaccagggaggtcagcccaaccgcagtgcagctccgcgcccaccaatggcaccagcacagtcagctccattagcccaagccaagaaggagattggaacaaagccagggtcctattacaactgtggcgagcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13451 - DNA, 2025 bp, Oryza sativa
  unsure (1)..(2025): unsure at all n locations
annnnnnnnnnnnnnnnnnnnnnnnnnnnnnnnnnnnnnnnnnnnnnnnnnnnnnnntgggcggtcaaccagattcaccgtgattattctcacccaagtctagtctaatggaattgaatagtctaggtggatggttgggcctgttgcaacgtggggtagcgttggacagtgggtggttaatattgattaattattacaactgttttactgctttcaactactatttataaatgctcgctctatgcaaacgaacctctatagctatcccttgttaattccctgcatcatacccctattccggtatgacttgttgagtacagtgggtagtactcagtcttgctctattttccccaaaccccagagtttgagtatgcgttagatggtggcttctccgaggagtaggcttcgtccgtgccgtcaaggatgcctgtggagtggtgttcccgctgcagtccaagtcaaggcttagctccagttatcttttaattttccgctgcatttatgtaagattttatgatgtttgtaagacgtggatctgtttgtcaactttgtcgtttgtgtacctcggccggtcctagacgggggttttaacgcacattctgtttggaatcctattcgggaatttctgggcgtgacaagttggtatcagagccgaccttgattgtagtacaagccaaatggaaaacctaagagtctgaatccttttcattgcacacgttctttgcaattggatttgttcctgtggttcaagggaaaaatcttggtcgcttgttcaagtgagatttgtcaaatcaggtcagtctagggttttagtaaaattatttgagatttatttaacagttagtcgggatttgatgggaggagtgcattaggtgctaactaagagatgtgggttgcaagttatttatgttcctattgttattgttattattagtatgtatctaatttctcattattttatcgctatgtaagtccgtctcacttattcgctctcatgcaaaaatgatctatgcataaaattccgctcttattcgcttattttatttgtgtcctttattgctttatttaaattggatttgagcatgcattgatcctacccctttgccttctctagatggccgaccacccacccaaccaccgtggagaaggcatggatgattttgtggctgaattggcttgcatgaccttggtggtgggctaccccaacgcgccagagtactcaactgttccaccgctcagtggcgagcttcctcaccgtgttcgtctggaggttcatggctatgtggacacctgccttgctaatatggtggttcaggcatctggaggcaccgcagatcacgcctgtcaggaggcagcatatctggtgatggccaggcttcgtgatcgccacaactacactttctgcaacacggcgtaccgcttccaccctcgccgagcaagcggtgatgacgtcagcacctttcgcccgacggccggcgagaacgacaccaccttcggccacatgtgcgccgtgatgaggggaagggacaggatgcactctgacctgcacaaggcgtccaaggccttgaatgatgggaagctcgtgaggatcatagctctgaaggatgagatagcacgcctgaagaaggaaaacgctcagttgaagggtttcccagcgccaggaggagtccggatccgcaccacgcccctcaagttgacgactgtacccatgcgcattcagcttgcgcctaggaacccacctcctcccgcagctcctccagtacctccagcagttcttgcagtgcccgcagctccagctccagccccagctccagtcccagtgtcagctcctgcgtctgctctctcctttgctccagcgtcagccgctaggggtccagccagtggcaacggaggttggttgcctgctactcccagtggcagccgcgaccacagcagcagcagttctagtggcacagagccgggcaccggcgagacgtatctgccagactccaggagccgctcagagggacctggtgacgagcagga

SEQ ID NO: 13452 - DNA, 1882 bp, Oryza sativa
  unsure (1)..(1882): unsure at all n locations
aaagtcgccttcgccaaacatcagctccagggtcccgcgtcagcttggtgggacaaccacatggctacccgtccgccaggtatggaggtcacttgggcagaattctatcgcagctttaggaaggctcaggtgccagacggggttgtggcatagaagaagagggaattccgagcactccactagggcaacaggacagtgactgagtacctgcatgagttcaatcgcctagcgcggtatgcaccagagaatgttcgcactgacgcagagaagcaggagaagttcctagcaggcctggatgacgaactgaccatccagttgatctccagggattacgcagacttcgagaagctggtagacaacgcaatccgtcaggaggatcaatgtaacaaaatggacaggaagagaaaggtagctcagttccggtccaaccaaggaagccatcagcgaccgcgcttcacacccggacagcagggtggacctaccaccatgattgtccgccagcatcgcccgttaaactcaagcagtttccaccagggcgcaagtggcagccagagccaccagggaggtcagcccaaccgcagtgcagctccgcgcccaccaatggcaccagcacagtcagctccattagcccaagccaagaaggagattggaacaaagccagggtcctattacaactgtggcgagcatggccactttgttgacaagtgtccgaagccaaggcgtgccgggccaaggtttgcttaagcccgtgttaaccacgcgtccacagaagaggcgcaagcagcaccagaggccatactgggtacgtttcctgttaactcaatccctgcaacagtacttttcgattctggtgcaacgcattcgttcatttcaaagaagtttgttgggatgcatgggttaagaaaagaagagcttagtacaccaatgagggttcataccccgggaaatagttcaacctcggtcagttatagcccttcagtgctaataggaatacaccgatcataatttctagccaacctcatccttcttgaatccaaagacctagatgtcattcttgggatggattggctgaccaagttcaagggagtcattgattgtgcgaattgcatagtcaccttgaccaatgagaagggagaaaccgtggtgtacaagtcaccagtctcaccgaagcagggaatctccttaaatcagattgaggtggaaaaccctgtggccaccgaggagaagagttcgaggaaattggaagatatccccatagtctgcgagtatccagaggtgttccccgaagacctcactaccatgccacccaagagagagattgaattccggattgatttggcaccggggactgctccaatttacaagagaccgtacaggatggcagccaaagagctagcagaggtcaagaagcaggttgatgagcaactgcagaaagggtacattcgaccaagtacttcaccttggggtgctccggtcatttttgtggagaagaaggacaagacgaagagaatgtgtgttgattatcgcgcgctcaatgaggtcacaatcaagaacaaataccctttaccgtggattgatgatctgtttgatcagctgaaaggagctaaagtgttttctaagatagacctgcgatcaggctatcaccagttgagaattcgggaagaggatatttccaagacagccttcaccactcggtatgggttgtatgagtgcactgtcatgtcttttggacttaccaatgcacctgcattcttcatgaacctgatgaacaaggtgttcatggaatttctggataagtttgttgtggtataaattgatgacatannnnnnnnnnnnnnnnnnnnnnnnnnnnnnnnnnnnnnnnnnnnnnnnnnnnnnnnnn

SEQ ID NO: 13453 - DNA, 4191 bp, Oryza sativa
ctatttagggaactcttctcatcacttcttccacacacctcaagcaagaagtttcatacatcctcatgcttagtatagtctctagggtatagtggaatagaaatagaatagagttttcagtcgtcggagtcttcggaagaattcgggtatggctctagtagcttttccttcttttgtaagacttgtactttatttagaatattcttctttatactactttggtatagaactactttccgagtatgaataccaactttattatatatccatgttatattcattatgatgatagcttatctgggagatgcaatggtgtgggcatactaatcatatttacgatgactctatatcatgatgatgatattagagtagtatttggtgatttatgcgtggtgtttagattactggatatctttatttagggttatatgctacggaagcgaggtaggccgttgatggtgacagctcagtacgggtattcctccgcgtgtgtatatagtcctaagttaatttcctggggagggtactcctccatatttagccccggttggatggtcaagacggattgtcgtaaggaactcggtgtcacaccctgaagttctttcccaagccaaaattgaatttataaattacctagaggaaatatcggtgtaaaagcaagagagaaacctaataaattaatgcaaataataatcgggattggcatgtggaatttttcttgagttctacatgtcgaaatatgctaacaagatttttagtggaattttcagagccctagaaataattttaaccaactaaaaatgagcacaagcattatttaatccctagaaatcaattctttctttttcttttctttttccctcctttttcttttcgaatgggccgctggcccattctctccccctccccctccccgttgggccgggccgcaggccacggcctagccagccgcccgagccccctcctctctccccgggtcgccgacaggtggggccctcctgtcgggcccgtctccctcctcgagctggcgccgccgcgcccagcaaccgtcgccgcgccccgctcctgcgtctcccgggccacgtcgcccacgtcaccctcgtgcccgcgtccccgcgcccacttccccctctctcccgcccgcgcccgcgctcgagacggccgggattcaatttttgaatcccgcctctctctcctccccacctctccccactccgccggcgaaatcgcgatctccccggccacgatcgaccctcgtgggtctaaataaagcacccccgttccctcctctctctttttcgttttgcaatcacctgctccagtgcactccaccgccctagcgccgtcgtcctcctctccggcgcccgccgccgccgctccggtcgccgctagctgccgctagccaccgtgccgagccgtgccgtcgacgttgttgcgttcaccgtcgtgcgggccgtcccgtccacccctcctccgtagcaatccgccgccggagccccgtccgcgccgcgcgccggtgagcttcgccatggccggcgccttcggttgccgccctagccatccatggtttccccctccctctctaactcatcccttttgatcccttaggtggttccgcagcccgtctcgccgtcgccatcgccctccgtcgctcgccgtcgtcggtcgccgtcggtgagacccctcctccccttcctccctctctcccgcgccgcttagccgccgcgccggcgcctagccgttaaccgccgctgtcgccgtctggtcgctgtgacgccaccgccctccgccgccggccggtcgccgccggtcgccgccttgcatcgccgtcgcgtcgtgctgcgccgcagcgcgccacgaccgccgggtcagcttgagccgtgcccgtgcgcgcccggccacgagccgcctccgccgtccgatctaccgggcggtatatcggggccgtccaaccccgccgcccgcgtggctgccacgtggccgccacgtgtgcgccgcgtcagcgccacgtgtgcacaacgtggtgcgccgctcctccccggtccgtggacccggtccaccatggaccgccctccccgagtcactgccttgtggggcccgcatgtcggcgccgcccctccctctcccggtatttatttattacgcaataaatcaattaaggatgtttccgtttaagcccattcaagtctcagtaaatcaagaaaaatgtatagaatccattaaaaatggttttgttctctgtttcagtagtcttatggcctgtttgtattgttttctttgtatgtcgcttagattccggctctcccaccgctccggtgtactttgaaataatcgccgaggttcctccagcagcagagcaaggtaagtcatgcttgtcacttgaacatgttgatcctatattgcaaatgctctatcgttttcctttaaatactgcatcgttttataatgttactatgggatgtttacctactgttacagccacgctaatttttgtaccatgctcctttgttagcttggggtataacatgactagagattggactagggattgcttagccatgcttagttcaactagcacacaatgggggaaatacattaatacatagatatcagattctagtaatgatggttaataccaccgctccggtgttggttaattaaaattaactaaattgtgagctatgggtgcatggttttgatggtcgtgcccatggcatttaaggaccggttcgcgggatgccctggaagaacttatcgtacttaccacaagccagcgtgggcaacgactgggcttgtagtgtagctttcctctagttgacgcatctaggcaagggtgggcgtgatggagtttggatgggccttgcgacggcctatgtggcttccggattcacctaggcacgagaggggactgcccgctgccttgcgaggggtgggggtgaaacctgtggtgtggtgtgcttggttagagggggttatgcgaagggtcctgtcacggtctctatccggtatgtcgtggtggcatgtcggtgcacagaaacgtgtcgtggggctgtgtcttgtgggtacatgtcacgcccggaatttctatccaaaattccaaacgcttacatgtgtgtaaaccctcgtccaggaatcagccgaggcacacaataacaaagataatagagtaccattattactctaattaataagcgaataaaatgtcattacagaggtagatagttcctctcaatcaataaagatctaagtagcggaaaataagataaacggcacagacgactccactccacaggcagcttgaccagggttacacctaatcctccacaccaacagcttcactgtagaactcttcctctgatgaacgattgcaaggtgagtatatgacatactcagcaagtcacgcagcaaatatgcaagtgcacaggataacaaaggatggcatagtagggtttcatttgcataaacagcatttaataaacatttgagaatttaataaaacagttaagtaataattaaacaatattaatccaacgctatacaatataccctgttgtataagcccaaccattctgaacaaccacacccggctgtacagatctatctccaaaccaggaatataccattccaaaccaggagctaatcaaattattaccagttatagcatcttttattgtgatgagaggtgtgagactaatcacgaaagacattgttagacccgcccataaccgcgggcacggctattcgaatagttttactctgatcagaggcgtaccactgtacccacaagacacagccccacatcatgtcaccatgtgcctcaataccaccacggtacctcggaaaggagctgtgacaataccccttgcgtaacacaatccaccgcagcgcaccattcctggatcataatcacccccttataaacaaggcatggactccccagcatcccctgtgggcttatctccgccacttctcagtctggtgcccccgcaattaaccatgctatacaaaaggtaaagccgttgcccacgctggcttgtggttggcacggttaatgtttcacaaccgaaactcgtgaaccggtccttaattgtcatgagcacgactctcaaaaccatgtgctcacaacccaccattatcaaggtttagttggcaagtaattaattaaccaatcacgattgaccatcgtgaact

SEQ ID NO: 13454 - DNA, 695 bp, Oryza sativa
tagctatagaggttcgtttgcatagagcgagcatttataaacagtagttgaaagcagtaaaacagttgtaataataaatcaatattaaccacccactgtccaacgctaccccacgttgcaacaggcccaaccatccacctaggctattcaattccattagactagacttggctgagaataatcacggtgaatctggttgaccgcccataaccgcgggcacggctattcgaatagttttactctgatcagaggtgtacaactgtacccacaagacacagccccacgatacgtttccgtgcgccgacatgccaccacgacataccggatagagaccgtgacaggacccttcgcataaccccctctaaccaagcacaccacacctcaggtttcacccccactcctcgcaaggcagcgggcagtcccctctcgtgcctagatgaatccggaagccgcataggccgtcgcagggcccatccaaactccatcacgctcacccttgcctgatgcgtcaactagaggaaaggtacactacaagcccagccgttgcccacgctggcttgtggtaagtatgataagttcttccagggcatcccgcgaaccggtccttaaatgccatgggcgcgaccatcaaaaccatgcacccacagcgcacaatttagttaattttaattcaccaacccggagcgggggtatta

SEQ ID NO: 13455 - DNA, 895 bp, Oryza sativa
  unsure (1)..(895): unsure at all n locations
nnnnnnnnnnnnnnnnnnnnnnnnnnnnnnnnnnnnnnnnnnnnnnnnnnnnnnnnntatgaccgttgtgggcagcctatttaagccaactggccagttgaggaaaatccatcccatttcaactcattttcatctcctctccgaactttgctctcaaaattcattcacgctttgcaagtttacctcaaatttaagccattagttgcattcacaagtttccttagtgaagctaaccggtgggtaaatatctcgctattctaacccccgcccgagttagtccattcttattcatttgtgcagaatgaagagacgattgtcccgctagttcaatatgggagccggctctcgatcaagtcatcatgacgagtctagcactcgctcatccaccgatgcctcaatggaggatgccgacattccacatctcttgaacgacgccgacctcgaccttgtcggtgactgggaaaggcaagcctactccatgctgaaagaccgggtgtttgctcacacgcgggcatatgatccggagctgctgaaaaaaaataggtatggatactgattttcgtgctatttgaaaagctgttggatggcagagatttgctgtagtagatgagcctggttctcgtttgcttactttgcaattcctgtgcaccttgaaagaaatagaagatggaattttcttttgcttttttccataaagaatacacacttacatggaaaggattaagtacacttctttgttttcacgattcctgtaaaatcaatcttaagaatggaatttctgggttcgagaaaaacagattttgggaagacatttctggtgctccaatttgcaagaaacctaggacgaatgacatccataatcctacacttaggcttatgcacaaatggattgcta

SEQ ID NO: 13456 - DNA, 1406 bp, Oryza sativa
tagtggaatattattattctaacacaaatatgtattgcaagtataactagttctcctttattttggtagcattgatgatcgaaatcgatcgctaacgaccgtcaatagagcccgagggagattttcatagtgattggaagatgagatcaagatcgagctgtgcaggaatggctggccacggagagaggcgacgtgggcaaagaatataggcacggttcgtctccggatttcgggggaaagtggaggagaaggtggaggacgtgaaggggaccgcgcccatgaagttttagcgtgagaaaggggacgggcacgcaggattttgctggatgtgggtgccgcggcggctatggcagtgtctagccaggggaggaagaatgccctgacaagtgggcatacccgtcggcagcataggagagaggagggacgtgaagcagactttgtggtagggagagaaggcaagctgtgctgggcgggagcaagttggctggcagaggaggagaagggatggaggagtggagatgggctggaagtaggagaaaaagacgggccggaaatagcccaaggaagcgatggagagtttaatttgtcgttcaatttaaatttaattaatttcttaaatgaacattgtgatattaaaattatttcttgagctctgaaaattcacaggaaatttcaaatagtactttagggcatgcagaatattaaaaaaaatatttctagctaaaattttgaatgaaaattttattttccacattattttcacttttaattagctttaacttttaatataaattgtagaaatttattatttaatgatttttagtcctgaaagaaaattgaggcgtgacatgttttccatgcaattaaaaatctatcatgtgtacatgtggtatctctgactgtgtattccttgtaatcaaaaaaatatcaaagaacataacgaaggatcaatattaagtgcacatcatctattatggatggattagttcaaaggtgccaaaaggtagagcaacaaaattaaaccgcacgtacatgcagattagtcagaaatttatgaaaataccttcatgatttaattacagatatggtggccgagagtggatatttctgggtgcaaacgaatttgtggattcatggatcaaagccttgagcccttgaccaacacctgtacgtgcacaatttttatggccaaagagcaacattggttgtgcgtctatgtatggttatgatattaatctacggtcacgatattgtaatgcatctattcaatggccagatttttttttgttaacatttgagctcgtagaatgtatccaagtagtataggtctagatagacagacagacagatagatagaaagatgtaagatagatagatagatagaaaggtgtaagatagatagatag

SEQ ID NO: 13457 - DNA, 3628 bp, Oryza sativa
  unsure (1)..(3628): unsure at all n locations
ggtgtaagatagatagatagatagatacattgattgatggatggattgatttagcatttttgaaaccaaataaaatgtaatttaatagaaagaaagaaagaaagaaagaaagaaagaaagaaagatagatagatagatagatagatactccctctgttccagaatataacaagttttagggttggacacagttattaagaaagtaggtagaagtgggtgatggagggttgtgattggatgagtagtggaagtaggtgggaaaagtgaatggtggagggctgtgattggttgggaagagaatgttggtagagaagttgttatattttaggacaaatccttaaggctaaaaattgttatattttggaatggagggagtagatagatagatagatagatagatagattgattgatttatggatttatggacggattgatttagcatatttgataccaaataaaatgtaatttattattcgagaatagaacaatcaggatgaaaattttcaaaaccgatggatagaagtgatattaatcaattgtacacattatgatatgacaacaaaaatattgaagcagtaattcactatcataaaacaaacaattaatcataacaatttggaaaacctatgtttagaagtggctttaatataagataacttaaggataaggataaaacataccagaaaatcctcagcttacaaaagtaattaagtcaacattaatttcttccatatataacacctatctttggtctatatatatgaaccatggatcctgaagttcacactcatcaacattcaactcaatagtcacaataagacacaaaacaaaacatagtagctcactcttcacaatatgaagcacgcccaccttggactcatgttgttctgcttggttcttctagttttctttgctatccctgcacaaatacgaggcaattatttttttttgaatttgtatgttttttcatcattttctttgcactggcaagataataaacatatgactccttatgtctctaggtcaaagcacaagcagggccccggtgggagttagcattggagaacttaaacttagtgtttgcttttcggcccctccatcgtggtcttgctgttcaaaggacaacctgtgctatccatcacttgaggcatgcctggaaaagtgcaagtacgatgaataggcacgcagccgactcagaggctaagtgctcgatgtgtgattgaattggacacaatatttactaataatcatatatccggtatatttgggaataacatatgtatatgttccaacagatatgcattttctaaatccatattgaagcatatgagatgcgtggtgcttatgtttaggagttgttttcataatcaacaaaatataattccatattttcaatgctagaataaatattgggccaaaagaaaaccaagaatttcatttcataaatttcgttatcgcacataaggacccaataaattgagtctatgaaaaagagttgagcatgctagtgggcgtagttgctatagcgacactagacgtgcatggttgcgcttcccatgcaggttttggttttgcttcacgtggcatctttagcctcccgttcaaagatctctacatatcagaactttcagttttcctgaaacttccatctccaaaatcacaaaactttctcttcaaacatatgaaaacattcatctgaaaatcacattactttccaaccgtatctaaaacttttatctaacaaatcataacaactttcaattcaactataaaactgtcatctcgaaattgcacaaactaatgattcaaattaaaaacttctaggcaaacttcataaaattttcaattgaaaaatccaaaaattttcatgctgtactcaaaatccctcttcctcctcaacgatcgtcatccttgtaataacgaccgcaattatgaccaagttgttcattcctgctattgccgctcctgcacggtgtgtggcagcagtggcgagggtggtgtctccatgtggcggctagcaactacaatgctgcccctggtggctagagttgaggagctatggcatgggtggtgcagcacaatatattaggcgaacttctccaatctgttgatatgtagatatggcacaaaatgttgaaggaacaacttcaacatgctagtagataatgccgtaagggcaattgtgaaagatctcgaatccacagacagcaagagcttagtccaaagctccaagaagatttaatccaagttgtgaaataggaacatccagttgtattggtaagttggtaaacggaagtaagctacaaacttgagggcatcgcctcaatttataggcttcaaaaccccatgtacaactcataaacaactatatgataactagatgacaacctatttgataagtaggatgttactcaaaacaatccatctattactcaatgacaccaagaacacaactcaaaggacatatatcttctagttctagcagtataaggacatatgcaatgacatcgtaattattgttaagccttcatgaagcatgtactatagatgcaaaactcaaattgccttcttgttcttagtcaaaaatcatattttgctcgtaacacttatactttttgaattggtcgtctaatgtccctcatcaatgggggtacgatatggccaaaggagttgacccagggatgaagcgcggctgggaacgtggacaaggatcatggcctgacacaagcgcagattgaagggcaacgacgagcagctctactgatgctgtcgattggaaacattgaagagagaaggaaagcagcgaacgaaggaataagaagagggatcatactcctctgccccccaccccgatgggctagatgggctctaaacatgcacctgtggtgcagctgtgccaaataggaatcttgcaatacatatactgcaaatcacattttaccacgaaagattttgctggtatcaatgtgtgccaccaacatattccagcactatgactgtccacatggcatgttgaacagtggggatagtcgtcaggcactacaagagatcttatgataggtgacattttatttatgtcataataacaaagagttatgtcatgttttgaaacctgtgactctcatgtgatgaaaatccgttcgtcacagatcatgcgtctcgaatcaggctctacgacgaaacatacttttttgtcattaatctagtgatgattcttctctcgtcattaactctgcattatcttgcaaaaaaaacacaaaatctcttgtgcctaccaaggtccatgtagtatgcaacatgtttatgggcctcagcccaattgcaagcccaattagattttgggcctaacctatataaaaagaagtattttattcactattttcatcccaattatattttatccaattttttttgtgtgaaataacaaatggttgaaccccatttcaaaagcccatataggcccaagcttatacaagcccagataacatccaatagcataaatccaatatacaatatggcacaagcccaacatcccatataactcaagctcaatgatatacgcacaaattcannnnnnnnnnnnnnnnnnnnnnnnnnnnnnnnnnnnnnnnnnnnnnnnnnnnnnnn

SEQ ID NO: 13458 - DNA, 4004 bp, Oryza sativa
acagtttggactgaggaggtggaggaccaaactgcaggttctgctgctgctgctgtgcttgctgctgcacctgctgcaacacctgatggtactgttgctgcatctgttacatcatcattgtcatcatctgagtctgattgtccaacacctgggcggtggggacggactgttgtcagatgcactgttggcacgtgctccattgatcggctcttcgctgccactggcgttgttggagtcgcgtgaaccattccttgtctccatctgaaggggataggtagaaatatgagaaaaggaagaaaaacagggggctcagaaactaatctttcttataaatttaagtgtaattatcttaatcttgattaaaacactgaaaaagaggcacgtaactcctaattgaggcagtcataccactgacatatgatatcgaccgccgactaatccacaagcaacaaacctaaacacgaaaactggcaagcaaacagactaagaaggtcggggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgatttttatgcatagaacaacatttttcacgaaccgagacaaaagacactaatgcaactgactaaacaataacttaatgcatgaaatagatgcatagtcatactgatacgcataaacttaccccaccgaacatagacacgacctaatgcatatcacccgacaattcccgaccgactgccgaataaattccgaataaacttttactaaatccctagactgtccctagtcgagaaatccaattaaataagcgaccaagatttttcccacaaatcaaaagaacaaaccccaaaattttcccgaaacaaaatccaagtgcaaaagggcatatgcatatgaaaaaaaagggttcagaggctcttaggtttctagttggcttgtcctacggtcaaggtcggctctgataccaacttgtcacactcagaaaattctcgaaccagaatttctaagctgaatgtgcattaaattcctgtctaggaccagccagggtacacaaacgacaattgttgacatacagacccacgtcttacaaaaatataaaagattacaaatgcagcgggaaagattaaagcgagctaaaccgggaagcttgacttcagcagcgggcgactccactccacaggcaaaccttgacggcagcaacgaagccaacctctctgagacggctccactgagaagaacttcaactctggtgtgggggaaaagagagcaagactgagtactacccactgtactcaacaagtcataccggaagaggaagtatgatgcaagatataaccaaaggaagctaggggttcttttgtataaagcaggcatttcaaagcagtagttgaaagcagtaaaacagctgtagtaattaatcaatattaaccaatcactgtccaacgttacaccaagttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataacactcccctaaccatccacaccacgctaaggtttcacccccacccctcaaaatgcagtgggcggtcccctcttgcgccgcggtgaatccggcagctggacaaccgaacacctcggccgacccaactccatcacgcccaccctcgccaccggtgcctaggaaagggtcgagctatactttagatcaagcagttacccactcccgcttgtggtaagcacagtaagtctcccagggtttcccgtgaaccggtccttaactgccatgggtgcgtccagcaaaaccatgcactcacagcccgccattcagaattttttaatttactgacacccttgcggtggcaccaatctaaagctatgccaatagtcagagtatatgaaataatgtgacccccatttgtgtactagttgaactaagcatggctaagcatttcctaagccaacatctagtcattttgatacccaagttatcaatggcataaggtaaccaatatgtggctaaggaacaggacccatcccacattacattgtaaaagaatacaacatttaatagaaaaatgcgggatattggtaaattgggtacaatatgatcaaacgtattgcatgacttgccttgctctcgaactgatgagacctcagtaacgtcttcgagaaaccgcggatcgacgaaacggccgaaacctacacgacaaacaaagcacacaggcaaaacatgctataagactactgaaacaggaaacaaaaccatttttaatggattctttgcatttttcttgatttactgagacttgaatggacttaaacggacctcggatgaattacttatgaattttagaagataaactgtgtttttactaataaagaaaaagtccttaataaattattgcgcaataatacccagggctgacgtcatccaaggggggaggggcggcgccgacaggcggggcccatgggtcagcggctcaaaggggagaggaagggggcgccggcatgtgggccccacgggcagtggctcaaggtggccggtctaccgtggaccgggaccacgcgggtggtccaccgccggtccacaggaccgacggtccggatcggctgggaggccgatcggacggcacggcggcggctaggcacggctcggcttggcttcaaaaccggccgaccggccatggcaaccggcggtgacgcgcacggtcgccggcgacggcaatcggcggcgcgggaaacgacggcggacggggtacaggacggcggcgtcgaccaaaggcaacggcgagcgcgtggagagaggcggcgcaaacgagagagaggggaagagggagaaggggggatcctcaccggcgagtatggcggccggagcggaggatgaaggtggcggcgacgacctggcgatgaggaggggcggacgggcggcggcggcacctacggagggagttgagaaggattaggagtagagagagtgaccacggcggccaccattgttggccgggagacgaaggagaatggatagctcaccggtgtgcgaggagaaccgggctccggtggggtttagcggaaaccgagcggcggccgaggtggctcacgcggcggcaatgctaatggcggcggcggcttggcgcggcggcggctctagcggcccggcgcgcgaccggaggtggcggcaagcggcggcgctatggcgagcggcgcggcggcggtaggtggcacgggagagcgcggcgaaaagaggaaaagggagagggagatgcggggaagctttataggggctcgagaggggtggacatggccgggaaaccccccgatttggccggcgacgtgggggaagagagagagagtgggggggattcaaatcgaatcccgcccatttgcgggcgcgcgtgcgggcgggaatggcggggagggcggcgacgtggggacgcggagtaggggcgcggcgcggagcggagaaggcggcggcgcggacggtttcggcggcggttgccgtcgtggagcgggcggctggaggaaggggacgacttgacaggtgggccccacttgtcagcgtcccggagagaggggaaaggggaacgggccggcccaaaggaaggaggccgagcgcgggagggagtgggccgacggtccaatagggaaaaatgaaggaaaagaaaaagaaaaagaagaaaggatttttcctgggatttaaaattgcactttggtgatttttagttggttaaaattatttccaaggctctgaaaa

SEQ ID NO: 13459 - DNA, 1268 bp, Oryza sativa
  unsure (1)..(1268): unsure at all n locations
nnnnnnnnnnnnnnnnnnnnnnnnnnnnnnnnnnnnnnnnnnnnnnnnnnnnntcaaaggctctgaaaattccactaaaaatcttgttaatgcactggagcatggggaactcaagaaaaaattccaccacgctaattccgattattaattgcatttattaactagggatttagctctaggttaattaagataatttcttcgggcaatttatttaaccaatttttaaagcaagaaaagggggggggggaaacttcagggtgtgacaaacctaccccccttaaacggaatctcgacctcgagattcggaatggctggcgaagaggtgcgggtgggtggccttcaactcatcttctctttcccaagtggccacttcttctgagtgatgactccactgaaccttgcagaatctgattactttgtttctggtccttctctcgctggtttcgaggatacgagtcggcttctccacatacgtcagatcttcctgaatttcgatgtgatctggacttgcctgttcctcaggaactctcaaacatttcttcaacttagagacgtggaacacgttgtggatgccaagcatgttggagggaagctcaagctggtaagcagcttcacctctacgttccaagatcctgtatggtcccacaaagcgtggtgccaactttcctttggtttggaagtgatgtactcccctgagcggagtgacacggagatacacataatcccctgtttcgaaagcgagctcccttcggcggttgtctgcatagcttttctgccgagattgcgcgattctcaatctttccctgacagctctgactttctcttctgcctcatttaaaacttctgtaccaaacaactggcgttcccctgtctgatcccagaagagcggagtacgacaccttcgtctatacagtgcttcaaacggtgccatctgcagactagcttagtaactgttgttgtaagagaactcagcatacggcaagcttttgtcccatgctccaccaaagtcaagcgcacaggctctcaacatatcctctagtatttgattgactcgctcggtctggccatctgtttgtggatggtaagcagtgctgaaattcaaccgggttcccaattcttcttgtaatttctgccagaactttgaagtgaattggcttcctcaatcagacacgatcttcttaggtacatcatgtaaacacataattcttgccatatagagttctgctaatttcttccctgagtaggtagtgtgcaccggaatgaagtga

SEQ ID NO: 13460 - DNA, 2825 bp, Oryza sativa
  unsure (1)..(2825): unsure at all n locations
nnnnnnnnnnnnnnnnnnnnnnnnnnnnnnnnnnnnnnnnnnnnnnnnnnnnntgaaatccattccgatttcttcccacttccattctggaatctgaagtggctgtagcaaacctgctggcctttggtgttctgcccttactcgttgacagacgtcacagagtgctacgaattcagctatctcccttctcatgttgacccaccagaacttttctttgaggtcttggtacatcttagtactaccgggatgaatggaatactgagtttgatgagcctcggttagtatcaagtcttttaattccttgttttcgggtacatacaatctttctcccatccagattgttccttattcatcctcaacaaaacctcgggcttttccaactctcatgttctttttgagctctgctatttcaggatcacttgcttgagctatgcgaacctgctccaccagtgtgggctgtgcctctagggcaaccacgaatccgtgctcaactataccaaggttcagatgttccaaatcgcgttgaacctcacaacatagttgctctacccatacaacattgcagtagctcttcctgctcaaggcatctgcaaccacattagccttgccgggatgataatgtattcccatatcataatccttgatcagctccaaccatcttcgctatctgagattcaaatcaggttgagtgaagatgtactttagacttttgtgatctgtatatacctcacaacggttaccgatcagatagtgccgccaaatctttaaagcatgaacaactgcggccaattccagatcatgcgtcgggtagttgccttcatgaggacgcaactgccgtgaagcataagaaaccactttgccatcctgcatcaacacacatcctagcccctggcgagatgcatcacaatagactggaaatctttcgtctgatcaggcaggattaagactggtgcagacaccaaccgtcgtttgagttcttcaaaactcctattgcattcagcagaccagataaacttttcttccttcttcaatagttgtgtcattggcttagcaattttagagaagttctcaatgaaccggcggtaatagccctcaagtcctaagaaactccaaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgcttttttaacttttcaagtaccagccggagatgctgctcatgttcttcctcggacttggagtagataagtatgtcatcgatgaaaaccatgacaaacttgtctagaaattccataaacaccttgttcatcaaattcatgaagaaggcaggtgcattagtgagtccgaaagacataactgtgcattcgaacaacccgtaccgagtggtgaatgttgtctgtggaatatcctcttcgcggatcctcaactagtgatagcctgatcgcaggtctatcttagagaacacagtagctcctttcaactgatcaaacagatcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgttcatcgacttgcttcttgacttccgccaactcgttggctcccattctgtaaggcctcttgtggattggagcagttccaggtaccaagtcaatccggaactcgatatccctttttggtggcattgttgtcagatcgtccggaaaaacctctggatactctctgactatgggaatatcctccagcttcttagtggttttctccactgctacctcttgttcttcaccagcagcctggtttaaactaatccctggcttctgcggcactggagactggaaggttaccacctcttcttttgcattggtcaacttgatggtgcggctggcgcaatcaatcactcctctgtgccttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctgttgctgactgcgcctcctctgcagatgcatgattgacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactgttgttgtgactgccactatggtggttcttgttgaagcttcccgggtggtagggacggtgctgccggataatcatggtggaaggtccaccgtgacgtcccatcgtgaaacgaggcttctgactcttcccctggggagtcctgaactgagctgccttcctcttacggtttattttgttacagtgctcctcctgacggatagccttatccaccagcttctcaaa

SEQ ID NO: 13461 - DNA, 1010 bp, Oryza sativa
  unsure (1)..(1010): unsure at all n locations
gggcgtagcgtgcgagcggttgaactcatgcaaatactctataactgttctggtccttgttgcagggaacggaactctctcttcttttgtgccacaattccctcgggaacctgtgctttattgaaactatgacaaaactctgtccaagtaacctctgccccagttggacgggtcaccatgtagttgtcccaccaaacagaagcaggaccttgcagctggtgtgtagcaaaagcaaccttctcttgctcgttgcattgcaaaagattcagcttcttctcaatggcatgaagctagtcgtgggcctcgatttggttggtggtgcttcagaaagtgggcggcttgacacaaagaaattctaacagtttggactgaggaggtggaggaccaaactgcaggttctgctgctgctgctgtgcttgctgctgcacctgctgcaacacctgatggtactgttgctgcatctgttacatcatcattgtcatcatctgagtctgattgtccaacacctgggcggtggggacggactgttgtcagatgcactgttggcacgtgctccattgatcggctcttcgctgccactggcgttgttggagtcgcgtgaaccattccttgtctccatctgaaggggataggtagaaatatgagaaaaggaagaaaaacagggggctcagaaactaatctttcttataaatttaagtgtaattatcttaatcttgattaaaacactgaaaaagaggcacgtaactcctaattgaggcagtcataccactgacatatgatatcgaccgccgactaatccacaagcaacaaacctaaacacgaaaactggcaagcaaacagactaagaaggtcggggcggcgactctgaagctcggggcggcgcttgcaaacgagggataggactgacatctaaagtagacaaggcataggaaccaattcatnnnnnnnnnnnnnnnnnnnnnnnnnnnnnnnnnnnnnnnnnnnnnnnnnnnnnnnnnnnnnnnnnnnnn

SEQ ID NO: 13462 - DNA, 1231 bp, Oryza sativa
ccaatcagataatgcctccagattttcaaagcatgaaccaccgctaccaattccaagtcatgtgttggatagtttccttcatgtgggcgcaactgcctcgaggcataagcgaccactctgccctcttgcattagaacacatccaagcctgtgacgggacgcgtcgcaattgacttggaagtccttcatctgatcaggcagaatcagaactggagcagacactaatttcttcttgagctcctcaaaactcttgtcacactcggccgtccacttgaacttttcttctttcttaagcaactgagtcataggtctggcaatcctagagaaattttcaatgaaccgacggtaataacccgcaagtccaaggaaactccgaatctgtgacattgccttaggcggggtccacttggtaactgactccacattcgacggatcgactgccacgccctgagctgtaatgacgtgacccaagaatttgacctccgataaccaaaagtcgcatttactgaacttggcatataactggtgctccttcaacttctcgagtaccagacgaagatgttgctcatgttcttcttcagactttgaatagatgagtatgtcatcaatttataccacaacaaacttatccagaaattccatgaacaccttgttcatcaggttcatgaagaatgcaggtgcattggtaagtccaaaagacatgacagtgcactcatacaacccataccgagtggtgaaggctgtcttggaaatatcctcttcccgaattctcaactggtgatagcctgatcgcaggtctatcttagaaaacactttagctcctttcagctgatcaaacagatcatcaatccacggtaaagggtatttgttcttgattgtgacctcattgagcgcgcgataatcaacacacattctcttcgtcttgtccttcttctccacaaaaatgaccggagcaccccaaggtgaagtacttggtcgaatgtaccctttctgcagttgctcatcaacctgcttcttgacctctgctagctctttggctgccatcctgtacggactcttgtaaattggagcagtccccggcgccaaatcaatccggaattcaatctctctcttgggtggcatggtagtgaggtcttcgggaacacctctggatactcgcagactatggggatattcttcaatttactcgaactcttctcctcggggccacagggttttccacctcaatctga

SEQ ID NO: 13463 - DNA, 1528 bp, Oryza sativa
  unsure (1)..(1528): unsure at all n locations
nnnnnnnnnnnnnnnnnnnnnnnnnnnnnnnnnnnnnnnnnnnnnnnnnnnnnnnnnnnagctgactgtgctggtgccattggtgggcgcggagctgcactgcggttgggctgacctccctggtggctctggctgccacttgcgccctggtggaaactgcttgagtttaacgggcgatgctggcggacaatcatggtggaggtccaccctgctgtccgggtgtgaagcgcggtcgctgatggcttccttggttggaccggaactgagctacctttctcttcctgtccattttgttacattgatcctcctgacggattgcgttgtctaccagcttctcgaagtctgcgtaatccctggagatcaactggatggtcagttcgtcatccaggcctgctaggaacttctcctgcttctctgcgtcagtgcgaacattctctggtgcataccgcgctaggcgattgaactcatgcaggtactcagtcactgtcctgttgccctagtggagtgctcggaattccctcttcttctatgccacaaccccgtctggcacctgagccttcctaaagctgcgatagaattctgcccaagtgacctccatacctggcggacgggtagccatgtggttgtcccaccaagctgacgcgggaccctggagctgatgtgtggcgaaggcgactttctcctgatcattgcactgcagaaggttgagcttcttctctatggcatggagctagtcatttgcctccatgaggttgttggtgctggagaaggtgggtggcctgacgcgtagaaactccggcaacttggatagagggggagggggaccaaactgctgctgctgctacttggtttgctgctacatcctctggtgcatctgctggtgctgctgctgcatctgctgcatcatggctgccatcatctgagtctgatgagccattacttgggccagagtcggattctcggggagcggtggcggaccattgacggagtcgctgttgggatgcccaccgtcggtgcgttcttcgccgttgctgccctcacctgctgcacggctgccattcctggtgttgaccatctgaaggaagagcagacggagggggtggaaaagaagaaaaacagatgctcaggaactaagctttattttataggaatttaaactgcaattgttctgatcagaattaaaacacttaaaacagcaagcaaaatacttattaggatagccatatcataggcacatgatatcgaccgtcgactgacccacaagcgaacaaacctaaacacacaaactaacagacaaaaactaaacagtcgataaactaagggaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13464 - DNA, 23169 bp, Oryza sativa
tgttttgctctgaaaagatcagttgaagtaatttcctcaaaactcaaatctaaatgtagttttttggaaactcaaaatgcattgataaagaatccaaattgatagaaataaatatgtaggtacataccaatttacctgtggtgagggccgcgtcattttggatctgacgagcaagaccgtttctcctttcgtttagattgctaattttccaaccgtctacggatgtcatggagcgagcatcttttgctacacttgccacaccttctttggttttggtgtggacggcggcttctctggagccgtctcctctggtttcttggctggtgttttagactgtgccggcgtcttccaataacggatcctaggaacgggtgctccctctcccaggaagttccgcatgaacttccccaggctatccattttgggtggctccacttcggccacttgaatattttgcgtgtttggtccatatttgatcctcaccatggagcattgttccatccttggctgaaactcgaacttttatccgtccccacatcaatgttggcgtccctggtgctaaggaatggtcgccccaaaatgagtgacgttttcttctccgaatccatatccaacaccacgaagtcgaccgagatgaagaaatcccgtatcttatccggtacgccttccgctatcctagctaggtaacagaccgaagaattagccagttgcatgcgcatcggtgttggtgtcaacaccgtgatgttgagtttatcgaagacgtccttgggcatgacgctcacacttgcaccaaggtcggagagtgcttggttgaatttttgtgtcccgattgagcaggtgatcgtgggacaccccggatccttcttcttttctaggagtttgtggagtataacattgctgcattcctctgtcagtttgaccaacttggttgtcggtagtggcctcttgttgcaaggatgtcctttagataacgtgcgtaggtgggcacttgcattgcgtccaataatggcacgttgatgtggatcttctggattacctcaacaaaccgagcaaattgttcatccaccgatggcttcttatacctttgggggaatggcagcagcctcatgtcacaacattcctgcggcccggtcctttctggccaaacttcttcgacagccgtgttgctagatggtgcttccagagcgttgcctgttcctacaacgttaggatacggtggatcgcaagtggacttaccacccctcgtcgtgatcgccttaacattctcaacagagggttcgggttgccccagaatcctcccagattcattagcaggtactagaaacaaactaattgttgccagctgggtttcaatcattttattaaaactaagctggtttcggaaaacggaagcaaagccatctaatttgaaatttatgttttccaaagtcttgtcattagtagccagcttttagctaagagcatctgtggttttggcttggcaaaaacaagatccttcaaggaaggttggttaaaatagttaccattattttgcctccttggaaatataggcgtggctggttccacccctgacctccttgtggacggaacccattgttgttgttgttgcccatgtacatcgcctcttcacgggtttctgggcagtcattcccagaatgacccattttgccgcagatttcacacataaagtgtgagtccatggccttgacgatgccttgaggcctcttctcgtggtcgtccaatcgcttcatgaggaggtccagcttcgcaacgagcatttccgtttcctttacggtgtgcatgccacgctgacgggtctggactccttcctcgctccagctcatgttggagactatcttttctatgagattgattgctcctctgaccgtcttggaaaagaaggctcctccacttgccgtgtccagatgatcacgggacatgggagtgagtccattgtagaagttctgcaggatcagccagtcgtccatcccatgatgaggacaggcagccatgtactcctgtagtcgttcccatgcctcagaaatagactgatctctcgtctgctggaaacttgaaattcttccgcgaagggcgttggtttcgcccatcgggaaaaacttcgataagaatgccgttgaacatttatcccaattgttgatcatagcgcggttggcataaaaccactgtttcgcttttccaaggccaagagggaaaatgggaactgtcggagcctttcggcatcagaactgatgcccttcatcgtgtacatgttgcagatctcgaggaactattgcaggtgtgcattggcatcctcgtttggcttgccgcataacgggctagcctgcaccatcgtgatgaggctggacttcagatcgaaatccacgtctcccatattgatttgtggcctagtggccacgttgtcagcagagggagcagtgaattcgcggagggtcttgtcagccatagtcttgaaggttggtggcgtgggaatggctggtttctctatcggaagagttttctgcggagcaacgactcgcggcttgaagctctgaaagaaaacttctggattttccttgaaattttccggcaagttaaaaccagtcatgcactaccctatttccacaatagaagtgaaaacaaccaaggttagcctacaaaggacagtgattatacagaggtaaatataaagtattagttatagtaatcttttttatgaatcttccacggcaacggcgccagaaatgcttctggtatattactcgaaatataattcctagcaatggttgagaaatacttctggtatattatggttacagagttcatccgcaagtgcatggaaataccattgtagcttttcacccaagagtattccaagggaatcatatttgagtaatcccgtgggaagattataatagagagaaccacactaataattatatattacttgtaataaccaaagtctaggcaggggttaatatcattcaaagggtagagtgacactaagaaaaagtatttatactcttattcataactatctaagctaagtggaaaggaaaatagaaagatcctattcctatacttctagtatacatacatcctacttatatgattacttagtgtcatgcccggaaattcactagtaatttccgaactaatttgtgcataaaatcctcgtccaggaatcagccgaggtacacaaactgacaatttaatatacaaatccatcttaataataacgttacatacttacaaagaaaagaaaaacagcagaggaattaacggtctagcgatggcttcagctccactcccacaggcagctcaactggggtataagccaaacgtcttttccttctggatcctttatcttcaactgaggtttgatgattattgcaagaatgagcatatgacatactcaacaagccacacagcaaatatgcaagtgcacaaggattccaaaggatggcataatataggctcatttgcaaaagcagcatttagcaaagatttaagagtagtaaaacaatagagtaattaatcatcaattttaatcaacactgaacagcacacccatgctgctcaggcccaaccaaacctgaacaaccaaccccggtcgtacagatcaaacctccaaactaggaattatccattccaaaccaggagtcaaattaattctcacattattaacattgatgagtagtgtgaaactaatcacgaaaaacattgctcaactcgcccataaccgcgggcacggctattcgaatagttttactctggccagaggtgtaccactgtacccacaagacacgattccacacatgttgccatgcccggaaataccaccacggcattgcaaagggggaaatcgtgacaataccctttgcacaacacaactcaaaacagtgcaccgttcctggatcataatctccccctcaaaaccagaggcaatggactccccagcgacccccacggacttctcgccacttcacagtctggcacactataatgaaccatgctatacaaaaggtaaagccgttgcccatgctgccttgtggttggcacggtaaatgtttcacaacagtagctcgcgaaccggtccttaattgtcatgagcacaaccatcaaaaccatatgctcacaacccaccttagccaggttataattatcaattaattaacatcacacgattaaccatcgtgagcgaccattaaatataaccataataataatataatataatatagtttataattaacccctttagttagctaatgtttctaagcatagctaagcaaacttacatatagcatttagctgaaccaatccaatatataaggttcatgctaatcaaattataacccattggaaaataagatcatcttcggccattaattaacggggaaaggttcaccacccgatgacattcaaaaataatgcatagttgaaataaaataatagctttaaacgggttcaacatgctcaaagggttatttgggatctgtgtgacttgccttgggcttccgcaaacacttccgaaccttcctcaacgaaaacgctctcctccggaacgtcggaaaataaagcgaaagaacaaaaattaacaaaacagtacaaaaacaagcataaacagtacacgtcaatatttttaacatgaagatcttgattttagaaaaatttagcaacttgaaccacctgaaacggatctacggttatttagatatgtttttctgaagatctaatctatttcatctataaaaaaaactaaaaaggaaaggttatgacgtcatgctgacgtcatccatggtggccttggctcgggcggcacgaccaccggcgctacggaccttggccgggcgaaaagagggcaccaacgcgtagagggcaacaagacgaacgcaacggtactcaccaatgcgcccaacgacgaccgatggtggccggcgacgagaggatgcggcgcggtggttcagtcgacggtggcggcggcttcacggcgaccgacgacagcggagagggggcggacgagctagctctccctcacgcgcacctaacggcggtgagaaaaggcggcggcgacgacgcaagcggcggcgcggcacggctgagcggcgaccggcgacgacggcgactagggcggcgcggcggtgactccacggggcactagagagctcgggaaagggggcaaacaaaagaggaggactagggggtcctatttatagccttggattgaagagatcggactcctcccgcaagaaatcgatcgggaaatcaaaaactcggttttggagataaactcaaaaacgagttcgattcggataaaatactcaacgattagctccgatttttgggggtaaagatagaggaggacgaggggatcaaaatccctcaaacactcggactcaaatgcgagcgagggcggcggaatcggagacgggaggtggcgcggcgcggccggcttgggctcggcctgagtcggccggaggtaggggatgaccccgacatgtgggccccacatgtcggtggctagaggaggagggggcggttggcggcttgctgggccggctgagtcggctgggccggttcggccgcgggcgggagagagagagagagagagttgggccaaaaacggcccaacaacttaaaaggaggggttttggaactttttaattaaaataaatggtgaaatgttgtttcaattattaaaaaaatacttcccttgctcaaacaattcagaaaattctagaaaatagaggaacaagcaaaatatttaataaaattttatctagcccaattttatattgagatttagcaaattaaaattagatcttctcttttaagcttttaaaatcatttctgctaatttcttttaaacaacaatttataatttaaggattttaaacaagaaaagcacttaacaattataattagatcattattgatcaaataattactgaattgttctttgtatcatttaggaattgagctccgaaaaatccgagaaaattccagagagtataattaatcatggagaatttaataaaaattaaatccatccatgctttatattaagaaaattttatttcccacatttaacttcacttgtaaattaatgaacatttaatataaattctaataataatttattaaataatttataaatcctgaaacaaaaatcaggatgtgacacttagctaataccctccttccgatgccctcctggtgcttcgagaagccacccctgattgccgagtgtcacgcccagaaattcccgaataggattccaagcagaatgtgcattaaaacccccgtccaggaccggccgggtacacaaacgacaaagttgacaaacagatccacgtcttacaaacatcataaaatcttacataaatgcagcggaaaattaaaagataactggagctaagccttgacttggactgcagcgggaacaccactccacaggcatcctcgacggcacggacgaaacctactcctcggagaagccaccatctgatgcatactcaaactctgaggtttggggaaaatagagcaagactgagtactacccactgtactcagcaagtcataccggaataggggtatgatgcacggaattaactacggatagctatagaggttcgtttgcatagagcgagcatttataaacagtagttgaaagcagtaaaacagttgtaataataaatcaatattaaccacccactgtccaacgctaccccacgttgcaacaggcccaaccatccacctagactattcaattccattagactagacttgggtgagaataatcacggtgaatctggttgaccgcccataaccgcgggcacggctattcgaatagttttactctgatcagaggtgtacaactgtactgtcacaccctaaaaatccaaaatatataaattgtcgtttaattggaattattagaatttattttaaaagtctagaagagaagatctaattttaattaataaattccaatataaaatgggaccagataaaatttcattaaatactttgcttaattctataattcctagatttttctgggatttatttgagctaaggaagtatttttaataaatggaattgcatttcatgaataatttaaattgaaaaaggattttaaaagtctcttttggctttgggccgaaagtcggcccaaaaccgctctctctccttctcggcccaagtcggcccaagtccagccgcagctgccctcgcgcgcgctcgctgccgctgacaggtggggcccacctgtcaggcccgtcgtctacctctggccgccgccgtccgaaaccctagcgccgccgtctccttccaaattcggccgcgtctttccgtttccggtgaaatcaatagaggggaaatgatcttcgggatctcgtctaccttttctcttctggaatccccggctaaaatcgtttggaaagtgttggtttcgaggtcgagtcggatcggtctctctctctccgagccctaactttccttctcgtcgccggtcgccgtgggccttcgccgccgcctccttgcccctataaaaggacccccggtgtctcctcgacccgccgccacccttgctttcgtctctcgccgtcggaagcgccctagcgccgtgcaaccttgagccgccgtcgtcgccgtcgctccagccgtgcgccaccgccgttccggtcatcgtcgtcgctcggggaggtcgccatcgtggtcgccaagtcgtcgccgtcctcgtccgcccctgtcacaccctgaaaattcaaaatatataaattgttgtttaaatggaatttttagaatttattttaaaagcctagaagagaagatctaattttaattaataaattccaatataaaatggggccagataaaatttcattaaatactttgcttaattctataattcctagatttttctgggatttatttgagctaaggaagtatttttaataaatggaattgcatttaagaaataatttaaattgaaaaaggttttaaaagtcttcttttggctttgggccgaaagtcggcccaaaacctcccttctctctctcctcggcccaatccggcccagtccgccgccgcgcgcgcgcgcctttgctcgctgacaggtgggtcccacctgtcggacccatcgtctacctcgcgccgccgccgcccgaaaccctagcgcgtcgccgccgccgtttccttccaaatccggccgctcctttccgtttccggccgaattgatagaggggaatcaatctccgggatctcctctaccttttctcctttggaaacaccggctaaaatcgtttggaaattcgtggattcgagtttgtttcggattcgattttcccgaactttccttctcgtcgccggccgccgtgggcctttgccgccgcctccgagcccctttaaaaggacccccgagctctcctctacccgccgccaccctcgcctttgcctctcgtcgtcggaaacgccctagcgccgtgtgccctagcaccgccgtcgccgccgtcgctccagccgtgcgccgccgccgttccagacgtcgccgtcgctcgggaagaccgtcgtcgtggtcgccaagtcgtcgccgtcctcgtccgccccttcgccgtcgctgtagaccgccgaagcaccgtcgccgtcgtcaagcggaagaccgccgccgttttaacctcgtcgccgtcgccgtctgttggtcttctgccgctcctttggtcaccggtgagttcgccgcgtcgcgctctacccgttggtgccctccgttcgtgccgaagcgtcgccgttcgccgacgagcatgcgcgcccgagccgccgagtcgccgttgccggtggtgacgtcaccgctgacgtcatcgtcgccctctcccgtgagctggtcgtggaccgatcgatctcggccgtccgttttggatcaagtcgatctcggccgtccgttcgcgtgaaccgccgccgtgcgcccggtccaccgaaaccctagcccgctgacgcaataatcctccttttccttttcaaaaataattcattattgcgtcataattcaattaaaatcaatataagtgttttaatccgattaaatcttcaaaaattcataactaattcatcttagctccgatttagttggttcaagtctctaaatttttctaaaattgagatctacatgttaaaaatatccacatgtactgttcatgcttgtttatgtgctgttttggtgattttgctcttttctgcttagattccgtcgtttccggagagtccgttttcgcaggagaagaatttgaagaattccaaggccagcaaggcaagtcacacagatcccaaacaactctttgagcatgttgatcccgtttaaagctattgtttctattcaactattgcatttattttcgaatgtcattgggtggaattaacctattgtttgttatagcccttttgttcttgattactttattccttgataccttgggttattataacttgactagttgggctatatatattggttcaactagatattagatataattgcttagctctgcttagaaacattagcacactattgggataacttatgaatcactataatttaatgatggcttaatgatagttcacgatggacaatcgtgattagttaattaattaatgtgccaactaaaacctgataatggtgggttgtgagcacatggttttgatggtcgtgctcatgacaattaaggaccggttcacgagtttcggttgtgaaacattaaccgtgccaaccacaagccagcgtgggcaacggctttatcttttgtatagcatggttcattgcagagcaccagactgagaagtggcggagataagcccacgggggtcgctggggagtccatgccttgtttataagggggtgattatgatccaggaaggtgcgctgcggtggattgtgttatgcaaggggtattgtcacaactcctttccgaggtaccgtggtggtattgaggcacatggtgacatgatgtggggttgtgtcttgtgggtacagtggtacacctctgatcagagtaaaactattcgaatagccgtgcccgcggttatgggcgggtctaacaatgtttttcgtgattagtctcacacctctcatcatgataacaaatgctttaaatggtaataatttgtttagctcctggtttggaatggtacattcctggtttggagataggactgtgcagccgggatggttgttcagaatggttgggcctatagaacagggtatgttgtatagcgttggattaatactgcttaattattaactgctttattaaattctgaaatgtttattaaatgctgtttatgcaaatgaaaccctactatgccatcctttgttatcctgtgcacctgcatatttgttgcgtggcttgctgagtatgtcatatactcaccttgcaatcattcatcagaggaggagttctacagtgaagctgatggtgtggaggattaggtgtagccctggtcaagttgcctgtggagtggagccgtctgcgccgtttattttattttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagtggggtgtaacatcccggtctagggcttaataggattaatagaatactcatatcaacaagttgcaacttcttttctggaagataatctccaaagaactccagggttaagcgtgcttggcctggagcaatttaggatgggtgaccgaccgggaaattcttcgcgggtgcacacgagtgaggacaaagtgtgcagaaaagacatgtgttggtctgtgagggcagtctatgacctatgaaagctatcagatgtaagcgggcccggcctggggaaggcgggacgttacaaaatggtatcagagccgactctcgcggtttcacgggcgcaggcatggtgcgcatgtctggtgtagaccgggagtggttacacagcatggcacatgcgctggcactggacacatggacgtggccaagagaggacgttcctggcctagggttgatcgacgggggcgtcgatctctcttaaggggggtgagggtgtaacatcccggtctagggcttaataggattaatagaatactcatatcaacaagttgcaacttcttttccggaagccaatctccaaagaactccagggttaagcgtggacaaagtgtgcagaaaagacatgtgttggtctgtgagggcagtctatgacctatgaaagctatcagatgtaagcgggcccggcctggggaaggcgggacgttatagccccttcgccgctgccgaagaccgccggagcaccgtcgccgtcgtcaagccgaaggtcgccgccgcttcttcttcgtctccgttgctcttccgccgacgttttggtcaccggtgagttcgccgcgtcgccctctacatcctggtgtcctccgttcgtgccgaagcgccgttgttcgccggcgagtttgcgccgcccgagccgccgccggtggtgacgtcatcgacgacgtcatcggggccgtctgccgtgagccgccgtagacccgatcgatctcggccgtctgttttggatggatcgatctcggccgttcgtttccgtgaaccgtcgccgtgcgcccggtccaccgaaaaccctagccgctgacgcaataaatccctttttccttttcaaaaataattcattattgcgtcataattcaattaaaatccatataagtgttttaatccgatttaatcttcaaaaattcataactaattcatcttagctcggatttagttggttcaagtctctaaatttttctaaaattgagatgtacatgttaaaaatatccacatgtactgttcatgcttgtttatgtgctgttttggtgattttgctcttttctgcttagattccgacgtttccggagagtccgttttcgcaggagaagaatttgaagaattccaaggccagcaaggcaagtcacacagatcccaaacaaccctttgagcatgttgatcccgtttaaagctattgtttgtattcaactattgcatttattttcgaatgtcattgggtggaattaacctattgtttgttatagcccttttgttcttgactactttattccttgataccttgggttattataacttgactagttgggctttatatattggttcaactagatatattagatatgattgcttagccatgcttagaaacattagcacattactgggataacttatgactcactattatttaatgatggcttaatgatagctcacgatggtcaatcgtgattggttaattaattaatgtgccaattaaaacctgataatggtgggttgtgagcacgtggttttgagagtcgtgctcatgacaattaaggaccggttcacgagtttcggttgtgaaacattaaccgtgccaaccacaagccagcgtgggcaacggctttaccttttgtatagcatggtttattgcggggcaccagactgagaagtggcggagataagcccacaggggtcgctggggagtccatgccttgtttataagggggtgattatgatccaggaatggtgcgttgcggtggattgtgttatgcaaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcataataaaagatgttataactggtaataatttgattagctcctggtttggaatggtatattcctggtttggagatagaactgtgcagccgggatggttgttcagaacggttgggcctatgcaacagggtatgttctgtagcgttggattaatactgtttaattaatacttaactgttttatcaatttctgaaatatttgttaaatgctgtttatgcaaatgaaaccctactatgccatcctttggtatccttgtgcatttgcatatttgctgtgtgacttgctgagtatgtcatatactcaccttgcaatcattcatcagaggaagagttctacagagatgctgatggtgtggaggattagacgtagccctggtcaagttgcctgtggagtggagtcgtctgcgccgtttatcttattttccgctgcttagatctttattgattgagaggaactatctacctctgtaatgacattttattcgcttattaattagagtaataatggtactctattatcaatttgttattgtgtgcctcggctgattcctggacgagggtatacacacatgtaagcgtttggaattttggatagaaattccgggcgtgacaagttggtatcagagcctccttgaccctaggttgtgccaaatggttacccatagaagccctctaaaaatattggaaaagtagaactgttctcctccctttctcttttaattaaaccaaactaatggcacatgcacttcataatctcttttaatggttctcattcaaaatttattccagtgtaattagtactgtacatctattactgtactaatggctcattttaccagcaaaagttttacaatattgctttatttaatcttgctgcaattaaataaatttcgcatgttaatttataactttcttttatttcttttggaacctgttgttcaaaagtacaaaatttgtggccttgtttccaactgtttcaaattatcctgcaagtttggtttactttttactttgattttccaactttattcaaattaatccaaaaacttgtgctattaattggataaatgtcttaactccctcctttcatttgtctttagatgccgcgctacaagcctgagtacttgtttggtgttgagggatttgtccaagagttgtgtacgatgtcctttgccataggatttgggactgcccctttttatgcccagattcctcatgatcgtcatgaagagaagtgccgagtcaaagtcactttgaacagtaatagtgatgaaatcccctcagtgatgttcgaagctggaggaagaaactacatccatgcgtgtcaggaggtggcaaggatcgccataggagagctccgcgatcgctattgtgatcagttggccgacactgagtatcgctaccatcctcgccaaccacagggaagtgatcgtggcagctaccttgagactgaaggaattgagaatgatgctaccacaaggcatttggttgagatgctgtgggctatggatgaaacccgtgcggagactgtgttagcagctcaagatcgtgaagaccggaatcgtggtaagatttgcaagctagaggacaaagtggatcgtttggagaaggaactagccgcattgaagggagaagcaccaccgcagaaggccagggttcgtcttaccgcaaggaagagagctctatttgtccctcgttaccaattggcgccaaaggtccgtgtggtggagaaagaagttaccccagccctagcagatcctccggttatcattataagtgatgatgaagaagaagaatccaagcacgcccattacaagatcgagtggggagcaactcaagatgatgaagatgagccgaacgagccttcaatcaactccgatgcccggaagacttagaatgccttgtcaaaccgttgtcttagatcgttgtgttagtttgcttgttttaagtttggttgtgtgtgtctcgcatgtgatttacatcagtggtgggatgtaagtgcgtgcgtttgtttgctttcgagtgttaggtagttggtgagttcagtggtgtgagaatcttcagttttgtaataatgaaactcacttaagatcaataaaagctaaagtaattctcggtcctaagtagttttccccggtttctcttcttgtgctcctgtccatgccagatggtgctcactcgtagcaacgggaatggccccaacaacaacaacaataacaacaacaacaatggagagaatcccacacttgcccaagtcctggctcaacagacacagcttatgaacataatgatgcagcaactccagaaccagcagaaccagggaaataaccatgcacctccccagaacaagttagcagaatttcttcgtgtgaggccgcccactttctctagcaccactaatcctgttgaagctggtgactggctgcacgccatagaaaagaagttggatttgcttcagtgcactgatcaggagaaggtctcatttgcatcacaccagctgcatggccctgcctctgaatggtgggatcatttccgccttaacaggactactactgaacctatcacttggcttgagttcaccgctgctttccggaagacgcatataccatcgggagtggtgtctctcaagaagaaggaattcaggtcgctcactcaagggtctcgctctgttacggagtatctgcacgagttcaatcgtctggctcgttatgctccggaagatgtgcgcactgatgaagagcgccaggagaagttcttggaaggacttaatgatgagctttcttacccactcatgactggggattatcctgatttccagaagttagtggataaggctattcgtcaggaggacaagtacaaccgcatggaacagaagaaacgtcagattgctcaattcatggcacaacaggggaatagtcagaggccgcgtcttactttaggaccccagtccatgcctcagggaggttcttcgtctgttgttcgtccgcagcgtcagttcttcaacaacaatgctggcaacaacctccgtaatcaagctccacgccctgttgcagctccaacacagcaacagcctgccaagagggagcaaggcagcaagcccgtggtgtgtttcaactgtggagacccaggacattacgctgacaagtgtccgaagccccgacgcgtgaaggttgtccctgcccagagcaactctaccgcaccagcatcaaaggcccgtgtcaaccatgttgctgctgcagaagctcaagatgctccagatgtgattttgggtacgttccttgttaacctagttcctgcaacagtgcttttcgattctggtgctacacattcattcttatctatgagttttgcgggaaatcatgggatggaagtagaagatcttagacgtcctttgatggttagtaccccaagtaatcaagcactctctttgcaacgtagcccctctgtcagaatagaaattcagggagtaccatttctggccaatcttatcctgttagaatccaaagaccttgatgtcatcctagggatggactggttagccagatataagggtgtgatagactgtgctaacagaaaagtaactctcaccagcaatgatggtcgagttgtaactgttcatgcattgtcttctgagtctttaaggtcaagactgaaccaaataactttggaagaaattcttgtagtccgggagtatcctgatgtgttcccagacgatttacgtggtatgccgcctaaaagggatatagagttcagaatagatttggtaccaggaacaattccgatccataagagaccttatagaatggcagccaatgaattggcaaaagtcaagaggcaagtagacgaaagaacgacagttgccattggagttatgtaaggaatttgaaagattaaatttgggaattgtcagtagaggttttgttgcggctttagaagcgaagctcactctaattgatcaagttagagaagcccaaattaatgatcctgatattctagaaatcaaaaagaatatgagaagaggaaaagctatcggtttcttggaggatgagcaaggaactgtatggttgggcgagagaatctgtgtccccgataacaaagatttaaaagatgcaattctgaaagaagctcatgatactttatattccattcaccctggtagtaccaaaatgtaccaggatctcaaggaaagattttggtgggtaagtatgaagcgtgaaatcgcagagtacgtagcagtatgtgatgtttgtcagcgagtcaaggaagaacatcagaaacctgccggtttgttgcagtctttgaagattcctgaatggaaatgggaggaaatcggtatggatttcatcactggtctacccagaacgtcatcaggccatgactctatttgggtgatagtcgatagacttaccaacgtggctcatttcatcccagtaaagacaacatattccggaagtcggttggcggaattgtatatggcaaggattgtgtgtttgcatggcgtccctaagaaaatagtgtctgatcgaggcagtcagtttacttcaaatttttggaagaaacttcaggaagagatgggttctaagctgaactttagtactgcttatcatccgcagacagacggacaaaccgaaagggtgaatcagattttggaagacatgttgagagcttgtactttagacttcggtggaagttgggataagaatttaccttatgcggaattctcgtataacaacagttatcaagctagtcttcagatggctccttacgaagcactgtatattcggaagtgccgcactccgcttttgtgggatcaaacgggagaacgtcaggttttcgggacggatatcctgagggaagtagaagaaaaggtgaaaatcattcaagaaagattgcgagtggcccagtctcgtcataagagttatgccgacaatcgccgcagagatttgagttttgaagaaggagattatgtgtatcttcgtgtcacgcctcttcgaggagttcatcgttttcacaccaaagaaaaattggcaccgcgttttgtgggaccttataagattgtcagtagaagaggagaggttgcttatcagttggagttacctcaatctttggcaggagtccataatgtgttccatgtgtcgcaattgaaaaagtgtttaagggtacctatcgaagaagctaatcttgaacaaatagaagtccaagaggatctgacctatgttgagagaccaatccgtattttggaaatagatgagagaagaaccaggaatccagttatccgtttttgtaaagtccaatggagtaatcattcggaagaagaatcaacttgggaacgagaagatgaattgaagtcagctcatccgcatctgttcgccagttcttccgaatctcgaggacgagattctgtttaagggggtaggtttgtcacaccctaaaaatcctaaatatataaattgttgtttaattggaattattagaatttattttaaaaagtctagaagagaagatctaattttaattaataaattccaatataaaatggggccagataaaatttcattaaatactgtgcttaattctataattcctagatttttctgggatttatatgagctaaggaagtatttttaataaatggaattgcatttcatgaataatttaaattgaaaaaggattttaaaagtctgttttggctttgggccgaaagtcggccgaaaaccttctctctctctccttcggcccagtcggcccagtccagccgcagccgccgctcgcgcgcgcgtccgcccgctgacaggtggggcccacctgtcagtcttcgtctacctctggccgccgccgcccgaaaccctagcgccgccgtctccttccaaattcggccgcgtctttcccgatccggtgaaatcatttgaggggaaacaatctttgggatctcctctaccttttctcttttggaatcatcgtctaactcgctttggaagttcatggatttgaggtcgaatcggattcctctttctctcccgaacccgaagtttccttcgcgtcgccggccgccgtgggccttcgccgccgccctccaacccctatataaggacccccggtgtctcctctacccgccgccaccctcgccttcgtctctcgccgtcggaagagctctagcgccgtgtgacctagcgccgccgtcgtcgccgtcgctccagccgtgcttcgccgtcgcttcagccgtcgccgtcgctcggggagatcgccatcgtggtcgccgtcgtgtcgccgtcctcgtccgccacttcgccgtcgctgaagaccgccggagcaccgccgtcgtcgtcaagccgaagaccgtcgccgcttcttcctcgtcgccgccgccgtccgttgtttctccgccgcttctttggtcaccggtgagttcgccgcgtcgcgctctacgtcctggtgccttccgttcatgccgaagcgccgtcgttcgccggtgagtgtgcgccgtccgagctgccgagccgccgccggtggtgacgtcatcgccgacgtcatcggggccgtctgccgtgagccgccgtagacccgatcgatctcggccgtccgttttggatggattgatctcggccgttcgttcccgtgaaccgttgccatgcacctggtccaccgcaaaccctagccgctgacgcaataattcccttttccttttcaaaaataattcattattgcgtcataattcaattaaaatccatataagtgttttaatccggtttaatctttaaaaattcatacctaattcatcttagctcggatttagttggttcaagtttctaaatttttctaaaattgagatctacatgttaaaaatatccacatgtactgttcatgcttgtttatgtgctgttttggtgtttttgctcttttctgtttagattccgacgtttccggagagtccgttttcgcaggagaagaatttgaagagttccaaggccagcaaggcaagtcacacagatcccaaataaccctttgagcatgttgatcctatttaaagctactgtttctattcaactattgcatttattttcgaatgtcattgggtggaattaacctattgtttgttatagcccttttgttcttgattactttattccttgatactttgggttattataacttgactagttgggctttatatattggttcaactagatgtattagatataattgcttagccatgcttagaaacattagcacacttttgggataacttatgattcactattaattaattaatgatggcttaacgatagttcacgatggtcaatcgtgattggttaattaattacttgccaactaaaacttgataatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttaattgcgggggcaccagactgagaaatggcggagataagcccacaggggtcgctggggagtccatgccttgtttataagggggtgattatgatccaggaatggtgcgctgcggtggattgtgttatgcaaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggcgggtctaacaatgtctttcgtgattagtctcacacctctcatcacaataaaagatgctataactggtaataatttgattagctcctggtttggaatggtatattcctggtttggagatagatctgtacagccgggtgtggttgttcagaatggttgggcctatacaacagggtatgttgtatagcgttggattaatattgtttaattattacttaactgttttattaaattctcaaatgtttattaaatgctgtttatgcaaatgaaaccctactatgccatcctttgttatcctgtgcacttgcatatttgctgcgtgacttgctgagtatgtcatatactcaccttgcaatcgttcatcagaggaagagttctacagtcaagctgcctgtagagtggagtcgtctgcgccgtttatcttatttttccgctgcatagatctttattgattgagaggaactatctacctctgtaatgacattttattcgcttattatttagagtaataattgaactctattatcaatttgttattgtgtgcctcggctgattcctggacgagggttcacacagatgtaagcgtttggaattttggatagaaattccgggcgtgacaagttggtatcagagccaggttgaccctaggttatgccaaatggttacccatagaagccctctaaaaatattggaaaagtagaactgttctcctccccttctcttttaattaaaccaaactaatagcacatgcacttcataatctcttttagtggttttcattcgaaagttattccagtgttattagtactgtacatctattactgtactaatgactcatttaccagcaaaagttttacaatattattttatttaaccttgctgcaatgaaataaatttagcatgttgattttataactttcttttatttcttttgaaacttgttgttcaaaagtacaaaatttgtgaccttgtttccaactgtttcaacttatcttgcaagtttggtttactttatttacttaccttttactttgattttctaactttattcaaattaatccaaaaacttgtgctattaatttgataaatgtcttaactccctcctttcacttgtctttagatgccgcgctacaagcctgagtacctctttggtgttgagggatttgtccaggagttgcgtacgatgtcctttgccataggatttgggacagcccctttttatgcccagattcctcatgatcgtcatgaagagaagtgccgagtcaaagtcaccttgaacagtaatagtgaagatatcccctcagtgatgtttgaagctggaggaagaaactacatccatgcatgtcaggaggtggcaaggatcgctataggagaactccgcgatcgctattgtgatcagttggccgacactgagtatcgctaccatcctcgccaaccacagggaagtgatcgtggcagctaccttgagattgaaggaattgagaatgatgctaccacaaggcatttggttgagatgctgtgggctatggatgaaacccgtgcggagactgtgttagcggctcaagatcgtgaagaccggaatcgtggtaagatttgcaaactagaagacaaggtggatcgtttggagaaggaactagccgcgttgaagggagaagcaccaccgcagaaggccaggattcggcttaccgcaaggaagagagctttatttgtccctcgttatcaattggcgccaaaggtccgtgtggtggagaaggaagttaccccagccctagcagatcctccggtcgtcaacataagtgataatgaagtagaagaatccaagcgcacccattccaagatcgagtggggagccactcaagatgatgaagacgagccgaacgagccttcaatcaactccgatgctcggaagaactagaatgccatgtcaagtcgttgtcttagatcgttgtgttagtttgcttgttttaagtttggttgtgtgtgtctcgcatgtgatttacatcagtggtgggatgtaagtgcatgcgtttgtttgctttcgagtgttaggtagttggtgagtttggtggtgtgagagtcttcagtttgtaataatgaaacccacttaagatcaataaaagttaaattaattctctgtcctaagtagttttccccggtttctcttcttgtggtcctgtccatgccagatggtgctcactcgcagcaacgggaatggccctaacaacaataacaataacaacaacaatggagagaatcccacacttgcccaagtcttggctcaacaggcacagcttatgaacatgatgatgcagcaactccagaaccagcagaaccagggaaataaccatgcacctccccagaacaaagttagcaaaattttttcgtgtgaggccgcctattttctctagcaccattaatcctgttgaagctggtgattggctgcatgccatagagaagaagttggatttacttcaatgcaccgatcaggagaaggtct

SEQ ID NO: 13465 - DNA, 1834 bp, Oryza sativa
  unsure (1)..(1834): unsure at all n locations
nnnnnnnnnnnnnnnnnnnnnnnnnnnnnnnnnnnnnnnnnnnnnnnnnnnnnnnnnnncaataaaagttaaattaattctctgtcctaagtagttttccccggtttctcttcttgtggtcctgtccatgccagatggtgctcactcgcagcaacgggaatggccctaacaacaataacaataacaacaacaatggaagaatcccacacttgcccaagtcttggctcaacaggcacagcttatgaacatgatgatgcagcaactccagaaccagcagaaccagggaaataaccatgcacctccccagaacaagttagcaaaattttttcgtgtgaggccgcctattttctctagcaccattaatcctgttgaagctggtgattggctgcatgccatagagaagaagttggatttacttcaatgcaccgatcaggagaaggtctcatttgcatcacatcaactgcatggccctgcctctgaatggtgggatcacttccgccttaacaggactactgctgaacctatcacttggcttgaattcaccgctgctttccggaagacgcatataccatcgggagtggtgtctctcaaaaagagggaattcaggtcgctcactcaggggtctcgctctgttacggagtatctgcacgagtttaatcgtcttgctcgttatgctccggaagatgtgcgcactgatgaagagcgccaggagaagttcttggaaggacttaatgatgagctttcttatccactcatgattggggattatcctgatttccataagttagtggataaggctattcgtcaggaggacaagtacaatcgcatggagcagaagaaacgccggattgctcaattcaagacacaacaggggaataatcagaagccgcgtcttactttaggaccccagtccatgccacagggaggttcttcgtctgttgttcgtccgcagcgtcagttcttcaacaacaatgctggcaacaacatccgcaatcaagctccacgtcctgtttgcagcctcgacacagcaacaacctgccaagagggagcaaggcagcaagcccgtggtgtgtttcaactgtggagacccaggacattacgctgacaagtgtccgaagccccgacgtgtgaaggttgtccctacccagagcaactctaccgtaccagcatcaaaggcccgtgtcaatcatgttgctgctgcagaagctcaagatgctccagatgtgattttgggtacgtttcttgttaacttagttcctgcaacagtgcttttcgattctggtgctacacattcattcttatctatgagttttgcgggaaatcatgggatggaagtagaagatcttagacgtcctttgatggttagtgccccaagtaatcaagcactctctttgcaacgtagcccctctgtcagaatagaaattcagggagtaccatttctggccaatcttatcctgttagaatccaaagaccttgatgtcatcctagggatggactggttagccagatataaaggtgtgatagactgtgctaacagaaaagtaactcttaccagtaatgatggtcgagttgtaactgttcatgcattgtcttctgagtctttaaggtcaagactgaaccaaataacgttggaagagattcctatagtccgggagtatcctgatgtgttcccagacgatttacctggtatgccgcctaaaagggatatagagttcagaatagatttggtaccaggaacaactccaatccacaagagaccttatagaatggcaaccaatgagtttctacgaatatgcacatacttataaaaagacacatgggtaccgagctcgaa

SEQ ID NO: 13466 - DNA, 746 bp, Oryza sativa
  unsure (1)..(746): unsure at all n locations
tgagtaggaatacaattttgaaacaactggaattgaaaaataaaaatattaaaagaacaatatacagtattggttaaaatttgaaaaaaaaaataaattctgaaattagaaaaagaaaaaaaatttccataaggaatacaatttattgataactaattggtgatagaaaataaggactattgaaagaaaagaccacctaaaacacatgacaagataaattaagtaacatgcctataaaggagtagagtggtggcggttgatacgacatataactgttaataaaacaccaaatagaatcttaacgacgattaaaaggagggacaacaggtatgtcgtgaagcaaacggacaaggcggttgctaggacttctagaaagtaaaaaaaataaaccacattaataatcatattcgatttttagaatctcaatgataataaaaaggagaagcagcgggctgggtgtataggagtatagtcgcagagccaccgatggttggtgggacttctagaaaataaaaaatgaattccaacagtagttatgttcgaagaatcccaatgataataaagagtaggcggcgggtgggccgtagaggagtatagtggcatcgtttaacgggacttctaaaaattatgaaaattgaaacccaacaagacaataaactctaaaaactagaaggtccaattttggnnnnnnnnnnnnnnnnnnnnnnnnnnnnnnnnnnnnnnnnnnnnnnnnnnnnnnnnnnnnn

SEQ ID NO: 13467 - DNA, 719 bp, Oryza sativa
  unsure (1)..(719): unsure at all n locations
nnnnnnnnnnnnnnnnnnnnnnnnnnnnnnnnnnnnnnnnnnnnnnnnnnnnnnnntctcgaaccagaatttctaagctgaatgtgcattaaattcctgtctaggaccagccagggtacacaaacgacaatgttgacatacagacccacgtcttacaaaaatataaaagattacaaatgcagcgggaaagattaaagcgagctaaaccgggaagcttgacttcagcagcgggcgactccactccacaggcaaaccttgacggcagcaacgaagccaacctctctgagacggctccactgagaagaacttcaactctggtgtgggggaaaagagagcaagactgagtactacccactgtactcaacaagtcataccggaagaggaggtatgatgcaggatataaccaaaggaagctagggattcttttgcataaagcaggcatttcaaagcagtagttgaaagcagtaaaacagctgtagtaattaatcaatattaaccaatcactgtccaacgctacaccacgttgcaacaggcccaaccaaccacctgaactacactagttcattaagctaaactaggggtgggactaatcacggtgaatctggttgatcgcccataaccgcgggcacggctattcgaatagttttactctggccagaggtgtacaactgtacccacaagatacgattccagggtaccgagctcgaattcgccctata

SEQ ID NO: 13468 - DNA, 293 bp, Oryza sativa
gttaataaaagagtttgacgcccaaggtgtatccattcggtttattgatgacggaatcagtaccgatggggagatgggtaaaatggttgtcactattctatctgcagtggcccaggcagaacgacagagaatactagagcgtaccaatgaaggtcgccaagaggcaatggcaaaaggagttgtttttggtagaaaaagaaaaatagatagagatgcagtattaaatatgtggcaacaggggttaggtgcctcacatatatcaaaaacaatgaatattgctcgttcaacagttt

SEQ ID NO: 13469 - DNA, 1736 bp, Oryza sativa
cttgtgggtacagtggtacacctctgattagagtaaaactatgcgaatagccgtgcccgcggttatgggcgggtctaacaatgtctttcgtgattagtctcacacctctcatcataataaaagatgttataactggtaataatttgattagcttctggtttggaatggtatattcctggtctggagatagaactgtgcagccgggatggttgttcagaatggttgggcctaggcaacagggtatgttgtgtagcgttggattaatactgtttaattaatacttaattgttttatcaatttctgaaatatttgttaaatgttgtttatgcaaatgaaaccctactatgccatcctttggtatccttgtgcacttgcatattgctgcgtgacttgttgagtatgtcatatactcaccttgcaatcattcatcagaggaagagttctacagaaatgctgatggtgtggaggattaggcgtagccctggtcaagttgcctgtggagtggagtcgtttgcgccgtttatcttattttccgctacttagatctttattgattgagaggaactatctacctctgtaatgacattttattcgcttattatttagagtaataattgaactctattatcaatttgttattgtgtgcctcggctgattcctggacgagggttcacacacatgtaagcgtttggaattttggatagaaattccgggcgtgacaagggaataagaaaagaaaaagaaagaattgaatttccagagattaaataatgcttgtgctcatttttagttggttaaaattatttctagagctctgaaaattccactaaaaatcttgttagcatatttcgacatgtagaactcaagaaaaattccacatgccaatcccaattattatttgcattaatttattagggtttctctcttacttttacaccgatatttcctctaggtaatttataaattcaatttaggcttgggaaagaacttcagggtttgacaaacctacctcccttaaacggaatctcgaccccgagattcggaagagctggcgaagaggtgcggatgggcggcctttaactcatcttccctttcccaggttgcttttttttctgagtgatggctccactgaaccctgtagaacctggtgaccttgtttctagtccttctttcactggtctcaaggatacgaactggcttttccacataagtcagatcttcttggatgtcaatgtgctccgaatcggcttgttcttcgggtaccctcaagcacttctttaatgggacacatggaacacgtcatgaatgccgatcatgttggatggaagttctagctgataggcaacttctcctcttcgttccaagattttgtacggtcccacgaagcgtggtgccaacttgcctttcgtctggaaacgatgcactccccggagcagagtaacacggaggtacacataatcccctgcttcaaaagtgagctcccttcggcggttgtccgcgtagcttttctgtcgagactgggcaattctcagtctctctctgacggttctgactttctcttctgcttccgttagcacttccgttccgaacatttgatgttcgcctgtttgatcccagaagagaggcgtgcggcacttccggccatacaacgcttcgaacggtgccatttgtagactggcctgatagctgttgttgtacgagaattcagcataaggcagacttttatcccatgcccc

SEQ ID NO: 13470 - DNA, 554 bp, Oryza sativa
ttgtacgagaattcagcataaggcagacttttatcccatgccccaccaaatcgagcgcacacgctcgcaacatgtcttccaagatctgattgaccctctcggtttggccatctgtctgcggatggtaagctgtactgaaattcaaacgggtccccaattcttcctgcagtttttgccaaaattttgaggtgaactgattccctcgatcggatacaatcttcttgggtactccatgcaaacacatgattcttgagagatagaactctgccaaccttttgcctgtataagtagtgtgcactggtatgaaatgagcaaccttcgctgtcggagatttagatcaggttgggtgaagatatatttcaaactcttgtgatccgtatatacttcgcagcggttgccaatcagataatgcctccagattttcaaagcatgaaccaccgctaccaattccaagtcatgtgttggatagtttccttcatgtgggcgcaactgcctcgaggcataagcgaccactctgccctcttgcattagaacacatccaagcctgtgacggg

SEQ ID NO: 13471 - DNA, 515 bp, Oryza sativa
  unsure (1)..(515): unsure at all n locations
tatagggcgaattcgagctcggtacccatctcgccggctatgcggtactctccttcgacaaacaacgtgttcacgctcgtcgccaccaaatcatcatagagaatgccgcctcctcagatggcgcatgccgagtaggagccggggcgggggaagcgacggcgtgtcgtcgaccgtgaggtggctgcagcaggatgaggaggaggtggagggcgagaaggggagtggaagggagggaacggagaaggagccctcctccaagccgaacgcaagacgtgccctgtcgccctcactcagacaccccgccgctagggaggagcccatcggcactcggcaccaccattggggaggagcctgccaccaccggcactgatggggatggaggaggcgccggtcgctgcccctgtcgttgctcctccgatctggcccctctactatgaagaccgaagagannnnnnnnnnnnnnnnnnnnnnnnnnnnnnnnnnnnnnnnnnnnnnnnnnnnnnnnnnnnnnnnnn

SEQ ID NO: 13472 - DNA, 761 bp, Oryza sativa
  unsure (1)..(761): unsure at all n locations
tatagggcgaattcgagctcggtaccccttaagccagaagtcgcacttgctgaacttggcatatagctggtgcttttttaacttttcaagtaccagccggagatgctgctcatgttcttcctcggacttggagtagataagtatgtcatcgatgaaaaccatgacaaacttgtctagaaattccataaacaccttgttcatcaaattcatgaagaaggcaggtgcattagtgagtccgaaagacataactgtgcattcgaacaacccgtaccgagtggtgaatgttgtctgtggaatatcctcttcgcggatcctcaactagtgatagcctgatcgcaggtctatcttagagaacacagtagctcctttcaactgatcaaacagatcatcaatctggcaaaggatacttgttcttgatggtgacctcattgagtgcgcggtagtcaacgcactcttgatggtgacctcattgagtgcgcggtagtcaacgcacatcctcttggttttgtctttcttctccacaaagataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13473 - DNA, 279 bp, Oryza sativa
agctcggtacccggccgtctcgagcgcgggcgtgggcgggagagagggggaagtgggcacggggacgcgggtgcgagggcgacgtgggcgacgtggcccgggagacgcgggagaggggcgcggtgactgttgcggggcgcggtggcaccggctggaggagggagacgggcccgacaggtgggccccacctgtcggcgacccggggagagaggaggggctcgggcggctggctgggccgtggtctgcggccgtctcatcaaggagggggagggggagagt

SEQ ID NO: 13474 - DNA, 271 bp, Oryza sativa
gtagttttttggaaactcaaacatgcattgataaagaatccaaattgatagaaataaatatgtaggtacataccaatttacctgctggtgagggccgcgtcattttggatctgacgagcaagaccgtttctcctttcgtttagattgctaattttccaaccgtctacggatgtcatggagcgagcatcttttgctacacttgccacaccttctttggttttggtgtggacggcggcttctctggagccgtctcctctggtttcttggctgg

SEQ ID NO: 13475 - DNA, 307 bp, Oryza sativa
  unsure (1)..(307): unsure at all n locations
nnnnnnnnnnnnnnnnnnnnnnnnnnnnnnnnnnnnnnnnnnnnnncttcagattccagaatggaagtgggaagaaatcggaatggatttcatcaccggtttgcccaggacgtcatcagggcatgattctatttgggtagtcgttgaccgactcaccaaagtggctcacttcattccggtgcacactacctactcagggaagaaattagcagaactctatatggcaagaattatgtgtttacatgatgtacctaagaagatcgtgtctgattgaggaagggtaccgagctcgaattcgccctatagt

SEQ ID NO: 13476 - DNA, 673 bp, Oryza sativa
attcattattgcgtcataattcaattaaaatccatataagtgttttaatccgatttaatctttaaaaattcataactaattcatcttagctcggatttagttggttcaagtctctaaatttttctaaaattgagatgtacatgttaaaaatatccacatgtactgttcatgcttgtttatgtgctgttttggtgattttgctcttttctgcttagattccgacgtttccggagagtccgttttcgcaggagaagaatttgaagaattccaaggccagcaaggcaagtcacacagatcccaaacaaccctttgagcatgttgatcccgtttaaagctattgtttgtattcaactattgcatttattttcgaatgtcattgggtggaattaacctattgtttgttatagcccttttgttcttgtctactttattccttgataccttgggttattataacttgactagttgggctttatatattggttcaactagatatattagatatgattgcttagccatgcttagaaacattagcacattactgggataacttatgactcactattatttaatgatggcttaatgatagctcacgatggtcaatcgtgattggttaattaattaatgtgccaattaaaacctgataatggtgggttgtgagcacgtggttttg

SEQ ID NO: 13477 - DNA, 6229 bp, Oryza sativa
  unsure (1)..(6229): unsure at all n locations
nnnnnnnnnnnnnnnnnnnnnnnnnnnnnnnnnnnnnnnnnnnnnnnnccttttgcgccgccgtttctctctccacctcaacttcggcgtccgcctctcgtcgccgtgcgccatctccacgccgtcccggagctcggtgctgtgccaccgcgttggcctcgacctcctctgcctccgccgctgttttccgtagccgccgtgcaccttcgccgacgaacgccgccgacgccgccgcgctggagccgccatggcgccatggccagagcacgcccaggcctgtggtggagcagctactcctcctcttccctgtgacactgacgtgtgggacctgccatccaaaaactcaaaataatcacagccgtccaaatccctagatcaaatcccaaccgttggatctacataatccctaacatatgccaccttagccctagatccaaccatgtcagtaccaccgcatcgccttgtgtcgccacgtgtcattccacgtcatcgagtccacatacaccgagtccacccatacactctatgccactgacagtgggcccacatatattttcctatccaaaattaattcaatttccgaaattaaatatccagagaatattctcgaaatattcctttttcttttaccttcggattttccctgaattcaaaattccggaggccataacttttccgtttgaactccgattcgatccattcttcttcctaaattcttctaaaatcgagctttacctcctggtctaattggttatttcatttgatgttatttagttagtttttctttgtgtttatttgtttttcgtttgtaatcgtgtagacgttggagctgaagagcatttcgcttcagaacacgctgtgcaaggacagtactgggatcaaggcaagtgcactctttgaacatattgaacccatttgtgaaatgttttgttttgaatacatgcattgttttgtttataaactatcgaagggtagcgtgacctaattgttattattatcctacctttggtaattattgattgcccatgataccttgtcaccctagtctttgtgagttgaacattaggctcaactcaaggtagagtagttatgcttagccgctcaaggttgttctacaagcaaaatataattttgattaatcatatacttataatcacttttatatgaactgtgtggctatgtgctatcttttcggtagtatgtgttgcaccatgtaaaacaacgggcggataaaacatttttgaccggggtgatgggtggttctgtgtgaacctggttaggtggtaatgtatctgtgtgatcgttcccgggtatggtctctgtgtgagtctactgttgagctgtgtgctattgtagtttggcaagagttcttggtcaattaaggacttcacttcataagtcatggatctgagcctaacgtgcaagcacatgttctcatgggaagaacctggcccagtaggattccgagtcttggcactatcggcccaggtggctagatgataggagtttaggttcgccatggggactttcttgtctgtgtgagggaaaggtgtctcatgggggaaggcagtgttgggacggagtttctaaaaagccttgttacagtctccttggccacacacaacctgaagtgtgacacttgcgcatggccgttaaaaggacgatgtatcttgtgggtcaagctgtacaacctctgcagagtgttaattaatctattcgaatagccgcgtccacggtcatggacatgcacggtgatatctcacgaggggtcgtttgtgaaaactagaaatgaactgtgtgcaggttaatgaatatagctatgtggtcctgtgtggatggatagttggtaatacccattatttataactattattttaaacctgtttataaattgattataactacaaattgctgtgttatgcaaaatagccattgcctttgttgtcagctttgcatatgcatatttctgtgtgcttgctgagtattccatgtactcaccttgcaattcccctaattctagaagaatggttcccgctgtttcctgagtcccagtttgctgctgaagacgaggaataggtcatgagtcccagttgactgcctatggcaagttgaatggagctactacgcatttattatatttccgctgctactttaatattgtccttaggccctttgtggcagaataaatgtaaactttagccataaggcttaacacagtcattattattgttaaatattaggattccttcatgatgttggctgtgatattatctttgagtctgtgtgtgctagcttgatcctggactagcacttatacacaggaggtcctattttgggtcctcacagagttggtatcagagctgcgtcgactgtaggccgcaaccttagttagcctggtcttatttcaaaactgttttcaagaaacgcaaaacaatataatgtgttcttcctttccttgctctttcttgtcttcctcctttcggaatatcttcttatctgttttaatctctaccgtcagccatgggaggatgttctacatcagtgctgctttggagtcttgatgaagttttgtcggaaaccaggtttagttgtagaagtggtttttgtcgtaggaccactttgcctctagttagtagttcacgttagtaagacgttaagcttgggtgttagaagcgttgcttgtttttaatttttggttcttccggtttgttgtacggtatgtttgaagctcccggctttcaaacaatcgtacgtgtgtttcgttaggatgtgtagttctacccccttaggttgccttcttcttagagttgtttttttcttcttagtacctttctaaccagccatatgttgtatagatggtgaacactaggaccggaggacatggttcagagcatgagaacactgatgcccgcactactagtcagcaaccgcctcaagcaccccaggtgaaccaacagaactttgaagtcttcatgcaagcccagattgagctcatgaggatgatgatgcaacaacttcggaaccagcagcaacagcagccgcagcaacaaccccaaggcggtccacctccacaaagcaagatgtttgagtttctacgtaccaagccaccaaccttcaagggaatgggtactccactagaagcagaagattggatgcgtaccatggaatgaaagctggacatcactcagtgctccgatggagagaaagttcgtttcacagtccaacagttggaaggagctgccttagactggtatgagaatctcaggggaggcttggatgacccggaagccttgacctttgaggagttccatatggcttttcgtgattactatgtcctggcatcaaggagctgaagaaggaagaattccgtactcttcaataggataacaagtctttgcagcaatatctgactcagttcactactcttgctcgctatgcaccagaggatgttactagagatgcagatcgccagaggcatttcctgaaaggtctcaactctggtctcaaggtgggacttgtggcacatgattttagtagtttccagagcctggtgaacaagacccttttgttagaagaggaacgcaggaagcttggtgaagaccgcaagcgcaagatgaaccagcaagcaagtggtccgagccagaggccacgtggagcattccagcagaacaataactgtcagctagctgctccacagttcaggactattccacagacactagtcctagcagctcagacccctcgtcaggctactccaactcaatctgtgcgaggtcaaggaagctaatcattcattcgtcgttgctacaattgcaaagaagtaggccatgtcaccaaaaattgtcctcatcccaagaacattattactccagtgaagttcaacttgggaaataccccagccaaggcgccagcaccaggagtagcacaacaaactgcaccagccactcagcagactatcgtcaggggtcgtgtgaatcatgtcactgctgaggaagctcagacctctacggatgttgttctaggtaagttcctagtaaactcagtacctgcaacagttttattggattctggagcttcgcattcgtttgtttctcggtcttgtgcttctcaacatcagtttcctactatccctcttaagtgttccttacttattcaaacaccggggtcagagatgagaactcaaactggatgtcctagagtaaagattgaaatagagggtgtagagttctttgccaatctgattatgttagatactcctcagcttgatgtcatcctagggatggattggttgcacagcagtaaagcagtgttagattgtggaagtaggtctatcaccttggaaaactctaaaggagaaagagtaaatttcaaagccatagttaatccaccttggaaaggagccctagtgcacaacatggaagtttctgagctacagaaagtacctattgttagagaatatccagatgtcttcccagaagagttgccaggcatgccaccacatagagatattgagttcgtcattgatctagttcctggaatatcacctatattcaagcgaccttaccgcatggcagcaaatgagttagctgaaatgaagaagcatatataagagttgaaagagaaaggttatgtcagacctagttcgtcaccatggggagcaccagttatctttgttgagaagaaagatggaactaagagaatgtgtattgattatagaagcttaaatgatgtgaccatcaagaacaagtatcctttaccgcggattgatgatctatttgaccagatgaaaggagcaggagttttctccaagattgatcttaggtctgggtatcatcagctcagaatcagaacagaggatatcccgaagactgcattttctactagatatgggctctatgagtttacagttatgtcttttggattgacaaatgcccctgcttatttcatgaacatgatgaataaggtattcatggagtatttggataagtttgttgttgttttcattgacaacatactcatctactccaaggatgaaaaagagcatgagaatcatttaaggcttgtgctagaaaagctaagggagcatcagttatatgctaagttcagtaagtgtgagttttggatgaaagaagttgaattccttggacatgttgtgaccgccgctaaagttgtagtcgatccaaagaaagtaagtacagttatcaactggcagccgcccaagaccgtgacacaagttcgtagtttcctaggtatggcaggatattacagaaggttcatagaaggtttctccaaagttgctcgtcctttgacacagttgttgaaaaaagagaagaagtttatgtggacatcagagtgccagcgtagttttgaagccttgaagaagagtttgacgtcagcaccagtgttggttttgccagatatccacaaagggtttgatatctattgtgacgcctctcgtacaggacttggatgtgttctgatgcaagaaggcaaggttgttgcttatgctttgagacaactacgtccacatgaggagaattatccaactcatgatttggagcttgccgcagtagtacacgcattgaaaatatggagacattacctgataggcaatcgatgcgaggtctacactgatcacaagagtctgaaatatattttcactcaacatgatttgaacttgagacaaagaagatggttagaggtgaccaaggattatgacatggggatccactaccatccaggcaaggctaacattgtcgccgacgccttgggcaggaaagcatactgcaacaatgtggagatcaaggagagccagttgtcactctaccgggagtttgaaaggctgaatttagagatagtacctaaagggtttgtggctaatcttgaagtcaaacccacattggaagatcaaatcaaagaagctcaaaaagatgatgctaatgtcaaagaaatcaagctcaacatgaagaaaggaaaagccataggattcactgaggatgagaatggtgttatatggttacatgagaagttggttgtaccagatcagccagaactcaagaagctcatattgtcagaggcacatgaatctcgttattctattcatccgggaactacaaagatgtaccaggatctcaggaacagactatggtggcctagtatgaggcgtgagatcgcagaatatgtggtactttgtgatgtttgccagcgagtcaaggcagagcaccaacaa

SEQ ID NO: 13478 - DNA, 982 bp, Oryza sativa
  unsure (1)..(982): unsure at all n locations
nnnnnnnnnnnnnnnnnnnnnnnnnnnnnnnnnnnnnnnnnnnnnnnnntcccttccttctccaaacgatccactttgtcctctagcttgcaaatcttaccacgattccggtcttcacgatcttgagctgctaacacagtctccgcacgggtttcatccatagcccacagcatctcaaccaaatgccttgtggtagcatcattctcaattccttcagtctcaaggtagctgccacgatcacttccctgtggttggcgaggatggtagcgatactcagtgtcggccaactgatcacaatagcgatcgcggagctctcctatggcgatccttgccacctcctgacacgcatggatgtagtttcttcctccagcttcgaacatcactgaggggatttcatcactattactgttcaaagtgactttgactcggcacttctcttcatgacgatcatgaggaatctgggcataaaaaggggcagtcccaaatcctatggcaaaggacatcgtacacaactcttggacaaatccctcaacaccaaacaagtactcaggcttgtagcgcggcatctaaagacaaatgaaaggagggagttaagacatttatccaattaatagcacaagtttttggattaatttgaataaagttggaaaatcaaagtaaaaagtaaaccaaacttgcaggataatttgaaacagttggaaacaaggccacaaattttgtacttttgaacaacaggttccaaaagaaataaaagaaagttataaattaacatgcgaaatttatttaattgcagcaagattaaataaagcaatattgtaaaacttttgctggtaaaatgagccattagtacagtaatagatgtacagtactaattacactggaataaattttgaatgagaaccattaaaagagattatgaagtgcatgtgccattagtttggtttattaaaagagaaagggaggagaacagttctacttttcc

SEQ ID NO: 13479 - DNA, 764 bp, Oryza sativa
  unsure (1)..(764): unsure at all n locations
nnnnnnnnnnnnnnnnnnnnnnnnnnnnnnnnnnnnnnnnnnnnnnnnnnnnnttgataaaacaattaagtattaattaaacagtattaatccaacgctacacaacataccctgttgcctaggcccaaccattctgaacaaccatcccggctgcacagttctatctccagaccaggaatataccattccaaaccagaagctaatcaaattattaccagttataacatcttttattatgatgagaggtgtgagactaatcacgaaagacattgttagacccgcccataaccgcgggcacggctattcgcatagttttactctaatcagaggtgtaccactgtacccacaagacacagccccacatcatgtcaccatgtgcctcaataccaccacggtacctcggaaaggagctgtgacaataccccttgcataacacaatccaccgcaacgcaccattcctggatcataatcacccccttataaacaaggcatggactccccagcgacccctgtgggcttaactccgccacttctcagtctggtgccccgcaataaaccatgctatacaaaaggtaaagccgttgcccacgctggcttgtggttggcacggttaatgtttcacaaccaaaactcgtgaaccggtccttaattgtcatgagcacgactctcaaaaccacgtgctcacaacccaccattatcaggttttaattggcacattaattaattaaccaatcacgattgaccatcgtgagctatcattaagc

SEQ ID NO: 13480 - DNA, 1818 bp, Oryza sativa
ccaaaagagaaaaggtagaggagatcccgaagatcatttcccctctattgatttcaccggaaacggaaagacgcggccggatttggaaggagacggcggcgctagggtttcgggcggcggcggccagaggtagacgacgggcatgacaggtgggccccacctgtcagcggcagcgagcgcgcgcgagggcagctgcggctggacttgggccgacttgggccgagaaggagagagagcggttttgggccgactttcggcccaaagccaaaagagacttttaaaatcctttttcaatttaaattattcatgaaatgcaattccatttattaaaaatacttccttagctcaaataaatcccaaaaaaatctaggaattatagaattaagcaaagtatttaataaaattttatctggccccattttatattggaatttattaattaaaattagatcttctcttctagacttttaaaataaattctaataattccaattaaacgacaatttatatattttggatttttagggtgtgacaaacctaccccccttaaacagaatctcgtcctcgagattcggaagaactggcgaacagatgcggatgagctgacttcaattcatcttctcgttcccaagttgattcttcttccgagtgattactccattggactttgcaaaaacgaataactcgatttctagttcttctctcgtctatttcctagatacggattggtttctcaacataggtcagatcctcttggacttctatctgttcaagattagcttcttcggtaggtactcttaaacacttcttcaattacgacacatggaacacattacggactcctgccaaagattgaggtaactccaactgataagcaacctctcctcttctactgacaatcttataaggtcccacaaaacgcggtgccaatttttctttggtgtgaaaacgatgaactcctcgaagaggcgtgacacgaagatacacataatctccttcttcaaaactcaaatctctgcggcgattgtcggcataactcttatgacgagactgggccactcgcaatctttcttgaatgattttcaccttttcttctgcttccctcaggatatccgtcccgaaaacctgacgttctcccgtttgatcccacagaagcggagtgcggcacttccgaccatacagtgcttcgtaaggagccatctgaagactagcttgataactgttgttgtacgaaaattctgcacaaggtagattcttatcccaacttccaccgaagtctaaagcacaagctctcaacatgtcttccaaaatctgatttaccctttcagtttgtccgtctgtctgcggatgataagcagtactaaagttcaacttagaacccatctcttcctgaagcttcttccaaaaatttgaagtaaactgactgcctcgatcggacactattttcttagggacgccatgcaaacacacaatcctggccatatacaattccgccaaccgacttccggaataagttgtgtttactgggatgaaatgagccactttggtaagtctgtcaactatcacccaaatagagtcatggcctgatgacgttctgggtaaaccagtgatgaaatccataccgatttcctcccatttccattcaggaatcttcaaaggctgcaacaaaccggcaggtttttgatgttctgccttgactcgctgacaaacatcacatactgctacgtactctgcgatttcacgcttcatacttgcccaccaaaatctttccttgagatcctggtacatcttggtactaccaaggtgaatggaatataa

SEQ ID NO: 13481 - DNA, 1343 bp, Oryza sativa
  unsure (1)..(1343): unsure at all n locations
tgttgtatgggtagagcaactatgttgtgaggttcaacgcgatttggaacatctgaaccttggtatagttgagcacggattcgtggttgccctagaggcacagcccacactggtggagcaggttcgcatagctcaagcaagtgatcctgaaatagcagagctcaaaaagaacatgagagttggaaaagcccgaggttttgttgaggatgaataaggaacaatctggatgggagaaagattgtatgtacccgaaaacaaggaattaaaagacttgatactaaccgaggctcatcaaactcagtattccattcatcccggtagtactaagatgtaccaagacctcaaagaaaagttctggtgggtcaacatgagaagggagatagctgaattcgtagcactctgtgacgtctgtcaacgagtaagggcagaacaccaaaggccagcaggtttgctacagccacttcagattccagaatggaagtgggaagaaatcggaatggatttcatcaccggtttgcccaggacgtcatcagggcatgattctatttgggtagtcgttgaccgactcaccaaagtggctcacttcattccggtgcacactacctactcagggaagaaattagcagaactctatatggcaagaattatgtgtttacatgatgtacctaagaagatcgtgtctgattgaggaagccaattcacttcaaagttctggcagaaattacaagaagaattgggaacccggttgaatttcagcactgcttaccatccacaaacagatggccagaccgagcgagtcaatcaaatactagaggatatgttgagagcctgtgcgcttgactttggtggagcatgggacaaaagcttgccgtatgctgagttctcttacaacaacagttactaagctagtctgcagatggcaccgtttgaagcactgtatagacgaaggtgtcgtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13482 - DNA, 1712 bp, Oryza sativa
tcttatcctgttagaatccaaaagccttgatgtcatcctagggatggactggttagccagatataaaggtgtgatagactgtgctacagaaaagtaactcttaccagtaatgatggtcgagttgtaactgttcatgcattgtcttctgagtctttaaggtcaagactgaaccaaataacgttggaagagattcctatagtccgggagtatcctgatgtgttcccagacgatttacctggtatgccgcctaaaagggatatagagttcagaatagatttggtaccaggaacaactccaatccacaagagaccttatagaatggcaaccaatgagtttgcagaagtcaagaggcaagtagacgatttgcttcagaaaggatacatcagaccgagttcatctccatggggagctccggttatttttgtggaaaagaaagatcatacccagaggatgtgtgtggactatcgtgctctaaatgatgtgactatcaagaataagtatccgctacccagaattgatgatttgtttgatcagcttaaaggtgccaccattttctccaagatagatcttcgatcagggtatcaccagttgagaatcaaagaggaagatatacctaagacagcttttaccactagatacggattgttcgaatgtactgttatgtcttttggacttaccaatgcccccactttcttcatgaacttgatgaataaggtgtttatggaatacctagacaagttcgtggtagtctttattgatgacattcttatctactcccgaaccaaagaagagcatgaagaacatcttcgccttgcactggagaagctgcgagaacatcagctgtatgctaagtttagcaagtgtgaattttggttgtcggaagtgaagttccttggtcacgtcatctcagcaggaggagttgccgtcgatcctagtaatgtggaatccgtaaccaactggaaacaaccaaagacagtttcagagattcgcagtttcctaggcctcgcaggatattatcggaggtttatagagaatttttccaagattgctaagcccatgacacgactgcttcagaaagatgtgaagtacaagtggtcagaagaatgtgagcagagttttcaagagttgaaggatcgcttaatatcagctcctattttgattttgcctgatccaaagaagggttttcaagtgtattgtgatgcatccaagcttgggttaggttgtgttttgatgcaagatgggaaggtggttgcctatgcatctcgtcagttacgtccgcatgaggagaactaccctactcatgatcttaagttagccgcagtggttcatgcgttgaaaatttagcgtcattatcttttcggtactcgtacagaggtgtataccgatcacaagagtttaaagtatatctttactcagccggatctgaacatgagacaacggagatggttggaattaattaaggattatgatatgggaattcattatcacccgggaaaggctaatgttgtagcagacgctcttagcaggaaaggctattgcaatgctacgaaaggacgacagttgccattggaattatgcaaggaatttgaaagatttaatttgggaattgccagtagaggtttcgttgcagccttagaagcaaagcccattctaattgatcaagttagagaagcccaaattaatgatcctgatattctagaaatcaaaaagaa

SEQ ID NO: 13483 - DNA, 592 bp, Oryza sativa
cgaattcgagctcggtacccctaaagggtttgtggctaatctggaagtcaaacccacattggaagatcaaatcaaagaagctcaaaaagatgatgctaatgtcaaagaaatcaagctcaacatgaagaaaggaaaagccataggattcactgaggatgagaatggtgttatatggttacatgagaagttggttgtaccagatcagccagaactcaagaagctcatattgtcagaggcacatgaatctcgttattctattcatccgggaactacaaagatgtaccaggatctcaggaacagactatggtggcctagtatgaggcgtgagatcgcagaatatgtggtactttgtgatgtttgccagcgagtcaaggcagagcaccaacaacttgccggacttctacaaccattgaaggtaccagaatggaagtggtatgagattggtatggatttcatcaccggtttgcccaagactcagttagggtatgattccatttgggttatagttgatcatctcaccaaggtagctcactttattccagtcaagataacttattcaggtgacaagcttgagtattctatagtgtcacct

SEQ ID NO: 13484 - DNA, 731 bp, Oryza sativa
  unsure (1)..(731): unsure at all n locations
nnnnnnnnnnnnnnnnnnnnnnnnnnnnnnnnnnnnnnnnnnnnnnnnnnnnnnnnnaagtatttttaataaatggaattgcatttcacgaataatttaaattgaaaaaggattttaaaagtctcttttggctttgggccgaaagtcggccgaaaaccttctctctctctctccttcggcccagtcggcccagtccagctgcagccgccgctcgcgcgcgcgtccgcccgctgacaggtggggcccacctgtcagtcttcgtctacctctggccgccgccgcccgaaaccctagcgccgccgtctccttccaaattcggccgcgtctttcccgatccggtgaaatcatttgaggggaaacaatcttcgggatctcctctaccttttctcttttggaatcatcgtctaactcgctttggaagttcgtggatttgaggtcgaatcggattcctctttctctcccgaacccgaagtttccttcgcgtcgccggccgccgtgggccttcgccgccgccctccaacccctatataaggacccccggtgtctcctctacccgccgccaccctcgccttcgtctctcgccgtcggaagagctctagcgccgtgtgacctagcgccgccgtcgtcgccgtcgctccagccgtgcttcgccgtcgcttcagccgtcgccgtcgctcggggagatcgccatcgtggtcgccgtcgtgtcgccgtcctcgtccgccacttcg

SEQ ID NO: 13485 - DNA, 573 bp, Oryza sativa
ccaatatataaagcccaactagtcaagttataataacccaaggtatcaaggaataaagtagtcaagaacaaaagggctataacaaacaataggttaattccacccaatgacattcgaaaataaatgcaatagttgaatagaaacaatagctttaaacgggatcaacatgctcaaagggttgtttgggatctgtgtgacttgccttgctggccttagaattcttcaaattcttctcctgcgaaaacggactctccggaaacgtcggaatctaagcagaaaagagcaaaatcaccaaaacagcacataaacaagcatgaacagtacatgtggatatttttaacagtagatctcaattttagaaaaatttagagacttgaaccaactaaatccgagctaagatgaattagttatgaatttttgaagattaaatcggattaaaacacttatatggattttaattgaattatgacgcaataatgaattatttttgaaaaggaaaaagggatttattgcgtcagcggctagggttttcggtggaccgggcgcacggcgacggttcacggaaacgaacgg

SEQ ID NO: 13486 - DNA, 575 bp, Oryza sativa
gcactcccgcgcgcgcgcaggcgccggcggcgacgtgctcctcgccggggtgcacctcgtcagcgcggcgcgcgggtggggcgtgcgcgacctgctcgaccacgttcgccagctcgctgggtcgcgtggcaatgtgtgggcagtgggtgcgaggaatgttggcaagtctacactgctcaatgccattgcccggtgctccgggattgaaggcggaccgaccttgacggaggcgccggtgccaggaacgacccttgatgtgatccaggttgatggcgttcttggatcgcaggcgaagctgttcgacacaccgggcttgcttcatggtcaccagctgacatcgaggctgactcgcgaggagcagaagctggttcgagtgagcaaggagatgcggcccaggacatacagattaaaggtgatatatatttgcacatcacccactcaaccccagtcgtgtttgtgataatgcgcaattgacatagttgctgctcattttctaaatttcagcacaaatttcttgttaacgagtctagattttctgtagttctctgcaacagaattgaagatactttgcttaa

SEQ ID NO: 13487 - DNA, 600 bp, Oryza sativa
ttgttgcaatgtaaacaacacttattttttttaatctccaaaacaagaagttcaattctgaaatctgattcctagaaaatctaaccataaaacaatgacttataaatcagataagtattatttcttagaatatactattatatgcatatgcatattcacctgtaattaatgaattggtctaagttgtgtttgcaatgttgcaaaatgtgagttttgatagtttagactttagaatctgttttcctttttgaagtctgcagatctaagcagcagctttttcctgatgtttgtgatactgctttagacctattttatgcacaaaaagcttctcatgatgcaagtaagattgatgacatacctcagcggacatgattccatggtggcaatggatgctttctggtgactggccaaaaccactactggcctcaatgaacacaccagcttcagttattccaacagtctcaatcagggactggcgaggggggcttttcgtcggtatgaatatggagttcatggggttatcagccatccctttacccacatacttgttatggagaactacaggaattttatggctcctaaggtcattcttgggtccaa

SEQ ID NO: 13488 - DNA, 872 bp, Oryza sativa
gttggtacttttcttgcgagtttccttagcccactcttcttcttctttatcccaggggtatactttaccagtttgaaacttgttataaataaggttattccccgcttacctatttctttttttttattttgaatctttctattctgaattcagttaacgacgagatttagtatcctttcttgcactttcataactcgtgaaatgccgagttggtacgaattcccccaatttgcgacctaccataggatttgttatgtaaattggtatatgttcctttccattatgaatcgcgattgtatggccaaccattgcgggtagaatgctagatgcccgggaccacgttactattgtttctttctcctccttcatattgaccttttctatttttgccaataaatgatgagctacaaaaggattcattttttttcgtgtcacagctgattactccttttttttccattttaaagagtggcattcgatgtccaatatcttgatcgaagtatggaggtcagaataaatagaataatgatgaatggaaaaaagagaaaatcctttagctggataaggggcggatgtagccaagtggatcaaggcagtggattgtgaatccaccatgcgcgggttcaattcccgtcgttcgcccatcccattattgcaaattccaaaaatgcaattttccatattcctagttacgtatttacttacggcgacgaagaataaaactatcactatattttttccttttcctagttcttcttccaagcgcaggataaccccaaggggttgtgggttttttctaccaatgggggctttcccttcaccgcccccatggaggtggtccacagggttcataactacccctcttactacgg

SEQ ID NO: 13489 - DNA, 359 bp, Oryza sativa
cggaccaatttgcaggggaacaaaccggcgtacgaagctacgagcatggcaagctggcaatctggcaggcccggtcaaagtttgactattttgcccacaactcagacgcgccgaaatgagccatcgatttcttcgttataatttaatcttacttttcaacttaaaaaaacatagctaattacgtgcacttataaatatctctcttccgatcctcgcaaccattgcattatccagcagcaaaaagattcccctctttttgtgcaagcgagaccaacaaagtgatcgaaggcgcaaacgcaaggcaaagcagagagaggcgcgcgatggcggcgccgtggtggtggtggtggccgctgccg

SEQ ID NO: 13490 - DNA, 854 bp, Oryza sativa
  unsure (1)..(854): unsure at all n locations
nnnnnnnnnnnnnnnnnnnnnnnnnnnnnnnnnnnnnnnnnnnnnnnnnnnatcaatatgattttttaagcaactttcgtatataattttttttaaaaaaatacaccgtttagtagtttgaaaaacgtgcacgcagaaaatgagagtagggagttcggaactcccagcaaagaacgcagcctaagtgaagattgtggtatataggacaccaacgcagtgtccctaatgtaatttttttttgccaattgttgaatatttacagaacaaaacaaaaattcgagaaaaatctacatgttctgtattttctatgtatccaatctaattagttaagaagacattggtattcaaagtttaaaggtttgaccacatgtttacaaactacttcaaacgcattgcctttggtcggcaactaaaaaacaacacggcaaattctcaatacatattatagcatactctacaatttttttttgaatctctatattagtctattggtcaaaccaaaagctagtatttcattgttgcaccaaagcatgtgactaaatgaaattcatatgttcttttttatttgatggcttttaaattcgtactaggcattacggacagggcctcctctaattcaaagcccaacacttgtaatccgctcaagcccaaagggcccccagaagatttgccccctctagttgtctgctctatcgcgggctcggcctttcgtcgaacagctggtgcgcgtcctctcatgtcgagcacctgaccgccggtcacgtagcggcggcggcggcggcggcccggcaagatgctctcccgcgcccggcgcctccacccaaccctccagcgaatcctccggccagtccccc

SEQ ID NO: 13491 - DNA, 766 bp, Oryza sativa
atatggcaaaggactagagtttatttttaccatcaatccggttaagacaaccactagtgtctattgccttcctaggagaggtgtaagaacttagactgtagtttctatggcatcatgtgtacctagttgttggatgtattcatattgtgttcttctatcatgttccttttagcactgagaatctgcagctaattgtcgatttctaggatcgacaacatattttatagggtgcgctagatcaaagaaagaaatggtgacacaaatgttatactggttcaggccctcgacgtgaggtaataccctagttcagttgtatatggattggatctgtgtccggtatgaagagtggataatgacgcaaggtgcagccatcatccgggttgtcgagagtcatccctcgtctcgggaccccttcccctctatataggatgaggggggagggttacaaggaaagtatctagttgattgcaactagatccctctattccatctataaaagatatgtaggatcctcgggatttatactttatcccgggtttgtctatttccttatttacaaggcagccatatgggcctatgcccttggcccaccgtatgtcgcagggcccgaatgcctctccttgggtacccgggtaccgtgtaacccacagaagccagctgggagagacaagactggctgagtacttgtagacccccgattttggaaattggaaatcttctgtgtttatccgtaccaatccctggatcagtagggtaccgagctcga

SEQ ID NO: 13492 - DNA, 954 bp, Oryza sativa
  unsure (1)..(954): unsure at all n locations
gttcatgagctccttgttcttgaattgcttgaagaaattagctcccatatgacgcatgcaccacctactctgtacatcttcccaaacaccagggtatcctcattccatactcccaaactgcaactcttctatcgcttgcagaatgccagcgtgcctatcatgtatcaggcacacatttgccctcataccaacaacttttgttttaaccaatttcaggaaccagtaccagctgtcggtattctcactctcaacaaaagcaaataccaagggcaatacctgattgttcccatctacccctattgctgttagtatctggccccgatactttcctgtcaagaatgtcccatcaatgcagagaacaggacgacagttcacgaatgtcatcttgcatgcatgtagagctaagaacgccctatgcagcacactcttgccaggatgttcaattgaggggaatttcttcacttcgtaagagctcccagggtttctttcctcgataacaccaagcaggcgtggcaaattgtcatacgaggcttcgtaagttccaaatctcatctctattattttctgtttggccctccaggccttggcatagctaatagtatacttgtatgtctcttcgatgtgtcggattattgaccttggttcatatgtgagattatcgatgacatgcacatacatctcacatgcaacaaatgcacatgtaatgttcctgtggtatttctgaacaccaggtagaaaacatgtatgcttggtaatgactgacactgtccaataatccttccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13493 - DNA, 3896 bp, Oryza sativa
cgaaatgccgtctctccagaggctgaagatcttctgctgccaggagctgagctccatcggaggagaagaatccattgctagggtggagagtgttgatatcaggcattgcccaaagctgagagagctggagcagccgtttcagagaggctaactgaactgtcatctgctgctgcctgctgttgccacgacccaaaatgtctgtaaatgtacactgctgttaaccctgctgcaatgtaccaatggatcgtgtttttgtctagacaaaacaatttgagtctgtagtctccccttgtaatgtaggagtatgtatgtatgtatgttctgttattaccaagagtatatgtatgttctgtaattgacaagagctgacgatttgtaccaactgtaataaaaatcaggcaatgatgtacttcggctttgcgatggacacctccaattcttatcacatctctagcagaatcgccgaaacaaaaggcatctggtcttttattgagttgccgcagatccaaacgccaagacgaaatcagaggagagcaagaagcaccagcactgttgtcccccacacacatgaataatgacgccaagatcacaataggggtttaactgttcaagacgcaggaaaagattaaaccaacattcaactggaccaccaccaatcaccgcaaccaacagccaattaagtacaagggttgaatcatttgagattcatgggcagctagattgttcctctgtttcctcaggactacaacaaggagggtttctatttgtttggcagttcaacctcgtgggtgtctagtccctgcacgaggaaatggaagcaggaatgcaggtacacaaaatgtttcaccctaccgcctttgtacgggcttgtacagcacaacagtcacaaactttgccctgaaccgatgggtaatccccagggcgacgacggatctagagttctctttctctatgtagaggtggttgagtaccacgttttgaggtggaggaaggctgcttgaatcatcttggcttggtgggaagctcaataatgtatgctgcagatgaggaggaaccaatgggggctctcgagcttcatcttcatttccaggaacagggttgttgtagcttgaatctggtgatgttggcacttcaaacccaacaacgttgatcccttcctacattattgaaatccatcataacaatgaatgcaatcaagactttctttaaagaacataggaacacattccaatatatcttacatggtcacccctgacttgccggtccatagcaattagcaaagcactctgttgcctatcctggtttgaaaaaaaaaaactcaagtgagtaaagaatcagaataatatgtgtacacttgggaagttgaaaataaaattaagagcaaacattaatttcttataagaatcatatactctctaataaacatcacatcaaatttacataatgcctgtcttcactccatgcaaaagacagtttggaagtttggtcgaaccaaatgggtcagagatatgaatcactagcaacaccttcagtacggaagagctctacagcatttggtgtcatcagaaaggagaaagtaaaattgaattcaaagtttcaaacagttgcaatgttttctcaatgaccaatttcaacccaaaactgctccctcagaaaaagattatactagctaaatttttcgttcaaatacacataaccaagagaagcaactcgctctgtaattaacagtcaccacttaaactgaactaatacagacaaaagatgaaaatctggttgttgctaaaaaatgacataataaattgaagtaaagccttatcagcacatacaagtatttgaaacaaaaaaaatgaaatgaagtaaccaaactttaatggataaacagagacatagtaatcagtacatcatcatggtagaccgtaagagcccactaatccaaaatccaggtaccatgcttaagtattaccctccatccccaaatttaagcatttttagctatgaatctggacatgtgcttgtctagattcatagccggaagttgttatatttgggacggaggtagttgaataaagcttacatgatccacagttcttaagtggtgattaatatatagaaatttatgcactaaggaaaacttcatatgcagtgactatacaaaaagtcagtagcagaatgtcatgctatggcccatgaggtggtgcataaatggcagggccagcagcgtagatgattgctaaaggactatgttgtgtagttgcatccaagcatatctgttgggagcatttagacaatcctttaattttccattgttaggggcctcataaagagaaatcatttcctatacatggtaagaaatcaaggataaacaaaattcccttgtaaattgatccagttccaatgcagaggaggaaataagcaagaattcaatcaacctcatctggtgatccccaacatgttcttatatctcttccatcatatcccctccctcaaattcaacactgctgcctgaatcatcaatgttcacagcagtgcatgcctgccttataccataacaatctgccttctcaaactactctcctcctctcctaagcgagatcagtgtgaagagataccgaaaactgatgtctgttattggtacggaatccctaatttgtttttattcatttgactttgatctagtttggtaaatctggttttgctatgtgtttattaaatgcgcccttccatttattcgtttccttttgctggcaccccatgaacgtaattcatcaataccatccttggctgtgcatgatagctgcataggcctcttgcataaaaatgggccaatatggagtgaacttgaggcttagcttgctctgaatcttgagttttggagtttagtgatgaagtagaggttagagctttggtacggttagggatgcctttcttccaagtataggggtaactggtaagcgttggaagaagacagaatataggaaagtgtcattttgtttgcgggatatggataataacgtaaggcaacacgttatttagtttggggactatgggtaaagattttggtgggatcactgcatggaattcatttattacgacgtgacgtgtgggattgggcccttgaattggcgtgtgtgagcatattgacaaatatgtacaggtttagttgtgacatgcagttatcgttaggaaattgggtcttaaatctgtacatttctttgactttagtcatatattttgtatatgataagaacacaaataattcaaaaattcaagtactccaccacagccaactataaatcccaagcacaaaaatagcacgagatagtcttccttccatgtaaagtgtagcatctaataataggtacagatctaaaataagctaaatcatatagttcttcaagcatttcagagcaaattgaagtacacgcaaatccgcacagaagtaaactgctcatgtccatctcagtaactacaattccagcagctacatttcccaactacccagattgatcatcaaaagccacaaataatcaggtgggactagtctttcactcaccttaggatggagagattgatgaagcaaaccacgcaaaggccacccgaagactgcttcctcagccacctgcgaccaaaactaaaaatcaacagataaaagtgagcttgccgcacacacagaggctccatttcgaaaggcgaaatcacagggcgagcgaggcaaagggggaaggaggcgcggcatgggggcggccgatagcggggatttctggtagaggaggagcagcagctgctgctgcggagacctagggtagggcggcggagagctagggttcggttcgggggggcggcagatgagaagacgaccactaccgaagcggcggagtccggcggcggccataggg

SEQ ID NO: 13494 - DNA, 7783 bp, Oryza sativa
aagatggagttcctaactccacctgctgaactcagcatgagttaagctcgcaagtcacaacataagagcgcaagtttacggtagaggtgattgctacatctaatattattcacattatcaattaattaattggaaagcaatttatgctacgcattgcctctaatttactaaccccaatacataagtatttattttattcgctctcatccaatcaacatcaagataataagtatcaagatagtaggtaggattgttctttgatttatagtatcatagtatcggtattactatacataacttttatataaaatatataatattttgtataaattaaagcatataatatcaattctgataaatttaattggttttatgtaaacttcagtattattttcaatctgtcttattttaaataatatttggtaggttcacaaggatcgtagtatcgggctgctacctaaaattttgtatgatcgtataaaaatgaataataagattgagatattatgaaaattaggatactacgtaggatcgatattgtttcagcttgataggattgtagtatcacagaatactaagatatagatcaggatactgacaactttgatcaacatcactattttccatttcttccttaaagtttgtgaaaagagtatggctgtgttcgattaagctacatattacagctgttgggctgctgttggctgtatcaacagtccgaacacaccctctctcttgcatgaggggtggctcatcctctctgttctctcctccacctcaccattcaagcttaggtaggagtatcatctaggtgtttatacttagatgttttatagtacataatcttagtaggcatgttccgcgaagccggactctagttctttacctgcaggaactaagcaacagctggcttgttgcagccaaatagacccaatatttatttgaaacattagaaaatcagtgcgtcaattggcacgcctatattttatatcccgtttatgttgtttaattaattttttacatttcggtattgtagatggccaaataagtttattttctcgtatcaaataatgaatataagaaagtgatactacaataacaaatgttgaatattagtcatcaaagagagataaaatcatttttaataaagaagactaaccaactaaataattggtggatttattatcctaatgtgtgacctagttttgagtcgaaatgcaagacttttttctaaataaaaccgttgtcgttttgaacataattaattaaataaagggtacgtaatcacaatcacggtattttttaaagttgtttctgttggtgtgagcattgcgtaacccgtgtgttctatttagagttaatttacaacatataaattttaaattttaaatataatatttttttcatctctaaattttttttctttaatcattacaattatcatcaattggaagagggcaaatttctctaatttcaaggtgtccattactctgcccaatcgagaagctggaggtgctttcttttctctaatttttatctcttatacttcctccgtttcacaatgtaaatcattcaagcatttctcatatttatattgatgctaatgaatctagatagatatatatgtctagatgcattaataccaatatgaatatgggaaatactagaatgacttacattgtgaaacggaaggattataatttatagatttatcttacaaagtatagcactgtcacttggaccaatataggcttgcagttccagtgccagctttagaactattgatgattgatagattgattagaataaaatattcgtatagaaattttagtgtaaatacggtagaaaaagaagtgacataactggtaaacgattaccttttagtgattactatatttatttatttattttgttttcacgggttttacttttggtattatcgacactgactcatgatcaacgatgtcttttcacttcatcactatcactatgcggtcaacctttggttctctcgttattttccctagctctcgtgcatgtagccgatgttctaatacaacaaggtatgagtgtatgacatcggtttcttttgaggatgttttataattaaagtataactagatgaaagtattttcataaaaaatatctgttggcgtcatttttcatataccatgtcttgatacttttatactccgtatttactagtgagttactgtttagatttttatcttaagcattctaccactacttgttctagataagagtgagtattataggcgctagtctaattattcaaattgaaagggtgggatataatacacatcctctacggtatatagtatgtattaagtgtaaccgatacgtggacggcacttttctttagtcccacatgtcagtgtcatagagtgcaacatgaaatctgttttttaaagaagagaatcttgctctaaaagagtgagcttgcaagttaggaaggtggctccacgattctttccaccttttagatagattaggagcttgcctttctatagcggtgccaacaatgattatcaatttgtcatgttccaatagcaaccacacaatctctacttaaataattggtagctatgttgccattcatactctatccctttcaaaataactcaaccaagaatggatatggctcatcataatacaataaatatggataaagacttgttgcattgtagattgagttattttgagacagaggaagtagacatgaggtagagatgaaatcctgtaaaagaatgtatgtagaagaggaaaagaataagaaatattagcagaccatccaagaaaattccaataaaaaatcaccatgcaaaatagaaggaaattcccaatacaagtcttatgtccaatgatctagatatgcagtccggcccatttcaaatgtcttaaggtgtttgaagtatgggcttaacactccacttatatacttccatgcatacctattaaccatctctgttatttgagaattgcgtatatagtagtaataaggtgtccatttttcacttttagataattttgcttgtggtgttttaataagtttctgagtagggataaaaacagagctgatagttttcatccactctagacaaaaacaaatacgtatatagtttggagtagatagttctcggataatacggatatggatacgcatatgaatattttttttcctggatatgaatacgaatattatattggagtttccgacggatacgaacaataatacaaatatcctatgaacaatgctattcggatatcagctgaaggtataaaacacaacctatttctttctaactctagaccttcaacctacctctttagattttaatagtaatccatatcacaaccatagttcccgctattaatattatttaaacttttaaatatttttataaattacattgtatgttatatgttataatatcgactagacatgcattttgtaccagtataatgatgtacatgttgaagttaattgatatgtttttagtttacaatgaaacttttttgtgtaaaacgagctaattgtgtgtgatagtatttgtctctattagaagtttaggtcttttttattgcgagaaatatttgtttcagtattcctgtctgactatatttgtcgaaataattgttatttgtttatgtatccgagctatttgtatttgtcttatatccggctaaaggtaaaaaaataaatatagtatgagcactttctgtctgtatgagctctattttcatccctatttctgagatgaggtatgttttgtactagtagatcataagccaatacaaagacaataagatttgtcataattgtagtgtagctgaatggcagaatagctaaatgattttgtgttcactccttaattagaatataaatgaactactataaagttgaaaataggcttttaaagaaaaccatatttataaaagttttacgaaaaccgcgccgtttataaacttgggaagcgtatcacattaacccgccattttattcattacttcctcggtttcacaatgtaagtcattctagtatttcctacattcatattgatattaatggatctagacatatacgtttcacaatgtaagtcattcttacatttcccacgttcatattgatgttaatgaatctagatagatatatatatatgtctagatccattaatatcaatatgaatatgggaaatactagaatgacttacgttgtgaaacggagtgagtagaatgcatggtttaagcaccttgctgacacaaacttaaacaaatgaatagtacagtaaaaagcgtaataaaggttttgccaatagctaaaacctctgttataattaagtagtaattaattattcagttttcgtcgcagaggccataccaacgtggcaggtttagttagtggcgcaagtatttgtttcagcttctcattcgacttcatctccggcagtcaattgtggagtatcaattctgcacttctagtcgaatgtgcaagcatgtgatgcatgctttgattattccatggaagcttcgccaaaaataacttttgctttgtgaaacacggtctattcgtgtcgacaccaacattcgtccgaaaagctttttgttttctttcagaaattagagaaagcgagggaaaagagtttcagcttaaaattatccatctttaaaactgcattaaagcatgcagagacaggaaattctgcttttcaaagcattgtagagctgtgattatttgaccggatctttttaatactccctatcggccgatagactaccgtttactgatttttgctatttatctgtcttgtttacgcctttaaactaaaaaattagacatgcactgaagtaaagcaaatctttcaggccatgtgttttccatcaacactaatacaatacatgcactcaatacatgcacccaataaaattaaagatcttgggagtgcaggatatagaaaatcataatttagggaggataaggtgctaattaattgtattaatgtatacacgtattatattatgaaacaactttaaaaagtagttattttatatattttagaatggagaaagtagtttaaagcttaattaatcatctgtttgtttgctgatttgttagtcgcaactaaactttcaattttaaattttaatttagagttcatttgaacgattttgttcattgtagttcatttttcatcattatcttttaaatcttaatttaaaaacatatataataaaagtttcactcataaataattaattgttactttgttcctttttcacaacttatcagccatagagctaataagaggcttagtttagggcacaagtaagcttaagactacaacgcaatccatcattttgggccgccaattttgtaaaagtggattattccccgtgtaagaaatgagaggggagaattagaccgatcccttgtctataaaatttggtggggttcaattacatatattgatatttacaattaatcctcctatctccttcctcaatccctaagggaaatggattaaccgaacaaatcccaatattggggatagttgtgacgagtgttcagatgattggaaataaggaggtaaaagtgtatgtgcttgccactagttggtattagtgcagcgacaatgtagacataagggggtcttaagctttttaaataaaccttatacattatgataggagacatttggttgagctagccatatgtataaaggccactcacaaggaataaaaaaaatctatcacgccttcctctcccataatagtgcgactttctctccatctctcaacggctagtcttgggttcatgaggtctaccttaataccctttaatatcctctcttgtacatgacttcagtgggacctatattataagtagtcaacattaattgagcatgcccttaagggcttatttgatatggggactaatgtttttttaacagccaatcaactgacgttttattaatagaagggagtttaagtatacacagccaaaggccaaaagaaaaggaaaattgtacatacttgagttcaaacaaacttgcaagtcaactctccttacacctcacggcaacattctctcaatgtgttttgcgtcggctagcccctgcgattgattctttgttacactgacgcctctttccctctaaagattctcacattccttccccccagatttcccaagcaatgagcaagaagactaatttgagctctttgtgatttgctgcttccgggttgcttattccttgtgtctatcaatccaataggttagtactgttgttccacctcgagatgatatgtccttggcctaaccacatgagtacgccaaaccagatttgcttaaagatcggcattcaaacaataagtggttgacggtttctaggtttcataagcatagctggccgaagtaattatttggccaccccctagcttgcaattggtcgactgtccacatccgattttgcagcacaagccaactagagacgttgcattttaccaaggcccacgcttcctaggtcaactttgttgatggcgagattaccattctgttgaattggaattgataagaggattttgcactaaactccccattggttgtccatcgccaaacgatcgagtcttgcactccgtctgtcagttgtgggggtacttgtgctagaacccccaaatgtggaagaattcagtgagaagggcgatcgtgaggctgtggcggatgtcgctgatccatcttccttgccgcatggcttcctgaactgtgcggttctttctcttggagtgcctgtaaagatttggcacttggctttttaggatttggccagcaatccaatttgattcccagaagctcgcctttcgtccatcaccaataaggactttggttgatgctgcaaacatgtcattatccagttcatcgcaagatgtttcggtttctattgaaggtttgtttggtgcccttcattcataccagagccacctcagccatagggctctaccaatttttttctaaattggaaaatccaaggccgtcataatgaacaggagagcaaaccttgggccaattgaccttgcatttgcctccatgcatgttctcatttccaacccataggaagcgtcgcctcgttttgtcaatttcttgaagggattgtttttgttgtttcattattgtgataatgtatgtcgggatggcacttacaactttgttcatcataattcccccccccccaaccccgcatgcatacaaacagtgatggctccaatcccgagagacaaccctttatcttatcatggatgggctgaaaatgcaccttgcacaggcggcctgggatgagtggcagtaaatcaacgggaagtttgctcttgtcctagagaaatctggggactaatgttgctatgtgcgatgatcaatttctatcttggtcacaagtgtgacaagatttggcgagaaatggagtgtacacataagaactagtgaagtactggcacatcatcataattataagagctaaccggttaacaaagcgtgacacgtctaaggtttagaatgataactgtagccgccaaccaatcaaacgtacctttaattaacttgcttattctaattgctattaccaaaaggcaatggccggacagaagaaatccagctgcaccaccaagtacaagcatatcatgtattttattaactcaaccatatgtctcataacagcacacaactccatatatatatgtatattgtaatctaatctaccaacctaattaaact

SEQ ID NO: 13495 - DNA, 3177 bp, Oryza sativa
  unsure (1)..(3177): unsure at all n locations
nnnnnnnnnnnnnnnnnnnnnnnnnnnnnnnnnnnnnnnnnnnnnnnnnnnnnnnnnnntgtgtttgattgtgtttatacctttcatgcagtagaaatttgatttttctggcatgatttcagagatatttttggtcgtatgtttgtgcgtattaaccagaattgttcacagaatggcatcatttcagttcagccatgaatgaaatgattccaagaactgtagaaattgatctttctagtgagagttgagagagatcttggttgtgtttatacctttcatgctggagagggcgttcctgactttgagctcgcagccgtcgcagtccatcctcaccttgagctccaccgtctggaactgcttcctcttcttgtacctccgacggctgctgctcccgccgccgccgagaagatcagacaggtaatccatggtgcctcccattgttgttacagtttctgaagttctcaaactcaccgaacccaaccagttggtttacccaagaaaccaagaaaagaacagggcaagaacacttcacctactaatgatcgatcaacctgttcttttctcgtgcaatggccagtcactagctaagctcacagattgacagtcacactcagagcagagaggcaataatcgagacagattgattgcaactttggaatggacctgaactctgaaccttacaagagttggtgcctgtatatatagataggggagtagtgagtacaagctagctaagctgcttgcagccagtgagaaaatgtggcagcacagctaagccaaaccgtgtgcagtttgctgcaagaagtttcccctgagataccttgccccctgcaacaacccctttctgctgaattcacctctcaaccgacttcagatattagacatggaaaggtatgtagtagggcaggatagctatcagccaaccccacagatgaagaggcttttgctgtggccggccattgtcagcagtaaaagttttatcccccctgtgctaagcaaaaggaaactgcaggagggacaccagggaggaaaggaagatgtacttgtgttccttgtgctgggctacctttttggttcataatttgattattctttcctttctgaatctgcaatataaatttaatagtgatatattgtgatactagttaagaaaatataagccgaataatatttgcgcaaacagcgtgagttattgaaccgaacaaaattgttcaggatttgatccacctctttgaacggaacactatatcaagattaattttcagagaattttactaggtaaatactgcgaatattgcgcaaaattggcgcgatcctcatgattgcattggctcccactctcaactggtttcagtttctgaaaggccactacaacctgggcatgaattctgcacaactgaaaacatggggtcatgcatttgctgtgtgctgggtgtgaatgatggtggtgcctttgtgcttcagttgtaagtaagctgtcaacaggaagaacaaacagaaacaggtatagtggggttctactaagggacaggtaagcaaggagcagcccaatcagaggctgccaactgcttcatggtgattgctgagctgtcgttttgctccctcattgggtagccaaggccccagttttcaggtctcaaaatattgtgtgatttggctctgaattgtagttcctctctgctccttacatctggccctgaaaacactcagagattctgcaagaaatctgtgtttggcaacacatggagtatacagccagaggaggtgatgattgattggcaaatgacaatgtttatggaagacaaatatacagtcagttcttccatcttgtctggttgtgataaatttgcatgctatcctgcttgcagtccactcattacatgtattaaaaagtactattatattataattcacataaatatatgcatggttttggcatgggttatgattttatcagtcgaagaaatctgtgtgaagaatccgggagaaccacacaagtaagactcccttttcacctaaacacgccactataatcttgatcactttataagatccgtgcatatttttcaaaatcagttcactattgtaagatcataaaacatatttatactttgattttttttaagcaatagagcactaaaaaaaagctataccaccatatatattatataaattgtgcatgtctctaactcgtgtgttttccacgctaatcattggaacttaaccgaaagcaaggacaaaattaatctttttaagctagtgaaagctactctgttttaccttacattgaaaagtgaactttttacactactttgcaaagtaaaatggtatgtgaaaaggactagccacttatgtgaaacatggtagtaatttcttcactttgaaggtgttgcctaacctctttagaccccagccggccagtcttcttttaataaatttgtttccattttatttggagaaatagtgtgcctttattcttttaagtggataccaatttgtttgatcagaaattaatggacaccaattcaacacaatttgataaagtagcactaagatatggaattattgaaggtatatgcacacatcaattgtgcaattgcacagagcagctagcctagagctaaaatctacatgatttgaacttaaatacaatatctgcttcactaaaggttgtgctaagcaagatttatatcatattattgtaaccctgctaattatcaactcatgatcaatttgctgagagtgattaatctatggagctcgagtatcttggggttagggatgcaagtaggatgggcaagcatgatttttttacccgcttatctcacttctagttcattttctcttcgaaaatttatactaccatataggaaatgaaactagcagcggggttttgtgtgggtagtgggattactcactagcaatgtcggagcgtgctggtatttgttatggtcacagataagtccgcaattgcacggatactattatagaacttcactttggagtattttaaggatatcaaatcacaagaaatatgtatgtacatctagaaaaaggattcaactaaggacaacaataaatggtaggcttaggctagaggattcctatgagttaattaactactctctccgtcccaaaatataagcatttttagaatagtgagaagtcaaatatttt

SEQ ID NO: 13496 - DNA, 1065 bp, Oryza sativa
tttatcaaaagtcttagtaatagagcactcaatataaatattaagcgacgaacccccaacgatgacaatacatctcacttaagtaagttaattaaataccagaagggaatctcaaatacttacttatattgaagaagcatcagccgaggtacaaacgaggagagagggccaacaactccggcgctcctccaggactctcttgaagataggccaacatctgtagaacatcccagacagaaaaccaacatttgggaaccacacataacttccattgggactttaggatcttgctccacatatcagcagatggcgagaggaaggaaaggcagttcggccgacctagtggttcaaccgactcctttggcccacctcttgacctcccttctactggggggctgcctggtgggccctttgcatattgtatcttggttgggttcaattgttggtggttttgattgacatgtgggtcctctaatttgtgtattcgtgtccgactatccggaggtgtatttcgtcgtatggcggatggttttcgtccataattcacctgcatacaaatattcaccaagatttgtgaaaatagttagtaataaccactacctctaagtttggtattccactttatattctttcatttgtttttatgcatgaattgacggtcggatttggtacttaaggaccgtcaacagaatgcctcccctccagtggcacgacacaattttggctgaaattttcaaaaatttcctttttttgtgaatttaatcaaaatttcttcatttttttttaaaaaaagaattaatgaaattgcaaaccatgcttatcacacaacaacaatgaaagccatatctgaactagtagtccagtaggtaactttcatttcatgaatatacaaatgcaaaattacataattaaataagtttgaaccatatatatgtgacaaacagagaaaagtttcaaaatggctattaacatgcatgcttgaccgtattcttgttagtttagaggaattactatatatctataaaatccacagataacttaaatgaaacaaagtcatgtcatgtg

SEQ ID NO: 13497 - DNA, 266 bp, Oryza sativa
catggtgctaactactaaacaacaactgaaattgcaatccagaagaaagaaaaggacggccaaaattgttggttggtgacagaattgacactcactcttgggtttcaggagaagcatcatttggaggcgcgtccaccgatccagatttaacaggctacgtcacagaaatctgtaattaatttttactgcattgcgactaaaaattgacaagattgttactcgcggaagatcactcaaactcatgagttttgccaaggagcggcttg

SEQ ID NO: 13498 - DNA, 540 bp, Oryza sativa
aggtgctcgacatgagagaacgcgcaccagctgttcgacgaaaggccgagcccgcgatagagcagacaactagagggggcaaatcttctgggggccctttgggcttgagcggataacaagtgttgggctttgaataagagaaggcccggtcggtaatgctaagtacgaatttaaaagccatcaaataaaaaagacatatgaatttcattaagtcacaggcttggggccaccaatgaaatacaagcttttggtttgaccaatagattaaaaaaaagattcaaaaaaaaatggaaaagaaggtaataaaaggaattaagaattgccggggtggtttttaagtgccggcccaaggccaaggggtttaaggaggttggtaacaagggggccaaccctttaacctttaaaacccaagtttttttaactaaatagaatggaaacaaaagaaaatccggaccaggaaaatttttccggaattttggtttggtctggtaaaaatccaccaatggccaaaaaaaaataccataagggccctggggtggg

SEQ ID NO: 13499 - DNA, 697 bp, Oryza sativa
  unsure (1)..(697): unsure at all n locations
nnnnnnnnnnnnnnnnnnnnnnnnnnnnnnnnnnnnnnnnnnnnnnnnnnnnnnnnnnnnnnnnnnccattggtacattgcagcagggttaacagcagtgtacatttacagacattttgggtcgtggcaacagcaggcagcagcagatgacagttcagttagcctctctgaaacggctgctccagctctctcagctttgggcaatgcctgatatcaacactctccaccctagcaatggattcttctcctccgatggagctcagctcctggcagcagaagatcttcagcctctggagagacggcatttcgctccatatctcaccgccgatgcactccaccccggagcaaaactgcaactccaagctcacgagcacagggagttcacgcaggccgcatcggagaactgaatccgtgagctctccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13500 - DNA, 824 bp, Oryza sativa
  unsure (1)..(824): unsure at all n locations
nnnnnnnnnnnnnnnnnnnnnnnnnnnnnnnnnnnnnnnnnnnnnnnnnnnnnnnnnnnnnaatgacttgtcagctctttgtgtgtgatattcatgcatgatggtcagattcttttatgcattgattaaccttatcttcctgtctaatgattatgatacacaccattacaaaattgtgtagacctgcataaggactcaaaggatgaaagcaaggtgtcaatgaacaaaatagagacccacaagaatgaaactcatggtacaagcgatgatataaatgagaatacaccagttgagagagttaaaggtccaaatgtgtttgagcgtgccaaggaagagattgaagctattgttgaagccttccacccaaagaagggatctgacaagtgaagattgagatgttctgttgcctctgtctgcacttgatgtgaaaacattgacatgagttattaatagatccatggatgagttgtgagatatccatcggctggtcttattattgccaaactatggagttgtaactgttgaatggttcattgtaccactgatatatatatgagcagagtgtgtatcatgtgtgacatgaaagtattactgttcttcagtgtttgattttagtgtatgttgaacttagtcctttgcatgatatggtattttacttgctaccatacatgcaaaaatcttttgaggtgcataaataaagagagagtcaattgctgtacaattttataaccttatgctaagcctgtggtttgggttcaacatgcttcacaaaataacagcatttccttagtgaaacaagacagaaacgcgagatatgaacgata

SEQ ID NO: 13501 - DNA, 712 bp, Oryza sativa
  unsure (1)..(712): unsure at all n locations
nnnnnnnnnnnnnnnnnnnnnnnnnnnnnnnnnnnnnnnnnnnnnnnnnnnnnnnnntcacgttctgctacataaatcgggatggtgggctggacattgttcgtccaatcgcgaagacaatcaaggcctgtaccaaaggagttcttatttcttttagaaagctcaagagcaaaacgagcatggtgtgttgtctcaatcaatattaataaagttgcttgcttcaataaaagtatttgcaaacctccgattgcatccgcatgagaatgagtaataatcacagcatcaattgtcctcaatctgaatgtcagaagctagcgtttaacaaggctaaatttctcggaaacaaatatggagcacgtcagcagttcaatacccataagcaggaaaccactggagcgcagagtggtagaagaacctagcagaggaagcagagaaaaacacagtggtgtctcattactctctctcactctttttcaattcaagaatgataacccagaatggaagagaaatgaagcaaactttcagactcccagatcaaccaaaggcgcatacttacttgccagcgtcaattaggatgttcgccgtgccagacggcgtggcatggcgcaggaggatggacgtgttgcgcctcctgttccgattccctggctcggctgccttggtacagacctgcgtgcaggaaaggacaaagaagaaagtgagcaaatgacat

SEQ ID NO: 13502 - DNA, 677 bp, Oryza sativa
agttccagacggtggagctcaaggtgaggatggactgcgacggctgcgagctcaaagtcaggaacgccctctccagcatgaaaggtataaacacaaccaagatctctctcaactctcactagaaagatcaatttctacagttcttggaatcatttcattcatggctgaactgaaatgatgccattctgtgaacaattctggttaatacgcacaaacatacgaccaaaaatatctctgaaatcatgccagaaaaatcaaatttctactgcatgaaaggtataaacacaatcaaacacaccaccaaaatctccctgaattcatgccacaaacatcaatttctacagttcttggaaccattcatcatgcatggccgaactgaaatgatggcattacttaatctctgtgaaatgattttggttaatacacacaaacatacgaccaaaatctctctgaattcatgccagaaagttcagtttctacagttcttggaatcattcatgcatggctgcaatgatgtcgctacttaatatctgtgaagaatccttgttaatacaaacaaacatacgaccaaaatctctctgaattcatgccagaagcatcaaatttctgcagttcttggaacaattcatcgatcatgcatgactgacaactgaattcttggggtaccgagctcgaat

SEQ ID NO: 13503 - DNA, 769 bp, Oryza sativa
  unsure (1)..(769): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtgcatgttttttttgtggggctaatgcatgttgtttaataggttactttgtcattgcttttctttccaggggatcatttggagccagtacttgatttggtgaaccctcagcatgagtaagtattctgtgaaaaaggacatacatctgataatcatttgacatatcgtttattctagagaaatatgcacttgcactctcatcctccatcttttcagagcttttgttttcgattttgtaggggtccttggggtgctcgctctccaatacctgaaaacaacgccattgcgattaacaaacaggtcaacaccagaaagtctgcattttcacttcatccaaagaagcaaaataatctcttgtgtgcatttttgttcatcgtgtatattatatagaaatgatgcatattgttacgggtaccgagctcga

SEQ ID NO: 13504 - DNA, 667 bp, Oryza sativa
gacaccagtcggcggcggataagccggccggtcggtgaagacgcaaacgcccatcaacggtggcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaacaacggcggcataaaggccagccgtgcaggcggaagcaccagtcggcggcggacgaggcggccggtcggtgaagacgtagatgcccaacaacagcggcataaaggccagccgtgcaggcgaaaacaccagtcggcggcggacgaggcggccggtcggtgaagacgtagacgcccaacaacggcggcataaaggccagccgtgcaggcggaaacaccagtcggcggcggcgaaggcaagccggtcggtgaagacgtagacgcccaacaacagcggcataaaggccagccgtgcaggcggaaacaccagtcggcggcggcgaaggcaagccggtcggtgaagacgtag

SEQ ID NO: 13505 - DNA, 981 bp, Oryza sativa
  unsure (1)..(981): unsure at all n locations
nnnnnnnnnnnnnnnnnnnnnnnnnnnnnnnnnnnnnnnnnnnnnnnnnnnnnnnnnnntgttttctgttccttcagctggatttcaaggaagtcctgatgacttccttttatggtccctaatcctacattagagtccagttatccatacaactgttacgggctctagtgtctctggggcagcagccagcagcngtagagacaccccacacgcaagaatcagcaaggccacctccaagtgagggaagaaaatagcagattggagattaaaatcttagttggtttggttaggagacgagattactttggttatttgattagattctcttgttaggggtaaacctcatctatataagtgaggacccatacccttcattgcggaagcagaaatatacaagttcatgctagtattccccttctcatttccaaaggcctcagagcctctctttcacagctggaagcctggaataagccctgccagcagctggatccctagcctcagtccctcacacccgtatccaacccaagcaataatagccataaagaaaatctgtttaagggggcaacagaaagataggaaagtattgtttcaaaaacaatcaattggaaattttattgcattgggaaattataagatgtatatttgctacataagctccctctatagagaagggagaataaaagaaaagcaaaggctcaaagcaaggagttcaacagattacatcttgtaataataattttactaactgaaaccttagaaaatctgtaaacatatcctagctgtgcctagaagacaaaaaaatgtcgtgtgtgtttaaaagaattaatagtattagagccatacaggtaccctgagaccatcatagctcagctggatgtcaagcccctctgtctccatcaacttggcaagttcattgtttactttcttgtgatccattaaatgcatcattcctgaagaaatcattcagtcaagttatcaaga

SEQ ID NO: 13506 - DNA, 536 bp, Oryza sativa
cattggagaaggttactactgtgcacttgcaaaagggccacttgttccaaaccatgttctagttataccagttgagcactgctctagtacactaaagatgcccgtggaagctgaggcagagcttgggagatataaggatgctctggccaagtattttgagaaacaaggaaagatagctatatacttcgagtgggtttctcagcagtcccgccatgcaaaccttcaggtgaggacatttttttcctgatatgttgctccatgcttccatttaaatgatgctgtcatttggaatttggatgcttgtatgcgatctcatttgttttttgttcatactggatggtaatccactaaatttctgcgcaggctgttccagtaccattgtctaaagcatcaagtgttaaaaagatattccatttagcagcacagagactgggatttgaattttctgtagtgaatccaggtgaagttgtacctaactttatctctcttagtcagctgaatagaaaggggatagacaaaaacaatcttaggctgcg

SEQ ID NO: 13507 - DNA, 517 bp, Oryza sativa
tcgtcaaggacgaggcactagctgcgcaaccgccgccgcaacaacctacgagtacttgaactacgggacggccggcgacgagggcagcagccacgcctggtacaccggcaacggcggcgacgccgacgcctcgccgccgatgggtttgagcgatcagctccagcagtgccagatcggggccgcgccgccgttcgatgtgaagcctgagctgccggcgacgatggaacacggcggtagcgtgttcgtcgaacagccggagcagaagattctgccggcggcagggtcgtcgtcgtcggcggcggcgcattgccagctggagcttgggtgctcttctaatgcttggaaagttggaacacacgttattaattaattaattaatagtttctcgatttgattgattcggatatgatgaaatgcttgttgcatttcaaattttggcttgttgagttaggagttaattacaaaaataatcactagactagcttataaatagtcaagttttaattaatagtagatg

SEQ ID NO: 13508 - DNA, 739 bp, Oryza sativa
tatcaggtacacgagatcgccaagtgtgttatccagagatcccttgccacgatgacacctatgttgaaacctatcctactgtccctttacgccgtcttgacaaggcctccgaggaacctaagggaacttcagctggggacgcccaaagccgataaggccttgtcggatcctgtagagacaaaagaccatgtaagatctggtcgtgtaagagttctcgccgtgcgtattaaccaagccgtgtaatcggaaaatgagttttccaacttcacggctgggggctaggatcagtgcttgttcaaccgaggcaggtcaaaggtccaagagccttatcatccgagaacgattctccgacgacaaggctaggggctagggagagtgtatgactctacaaactgactgattggagtcggtaagagagaagacgctcatataacaaaacattagtctgtacattcaattcactagtctgttatattataacatgttaccctttgagcgttcgctcgggggctatttttattaatattcttttttgagtactgattttaggaaaattctattcgacattatcgaaggctccatgtctctatggttctacaccaagatcgactaagacgagtacgataaatgtcgacaaggctccgtcgcagactctacgccagctcgattactcgagaacggttggtggatctcgacaaggaatacggaatgaaaagatggtgtacccgccgagataaaa

SEQ ID NO: 13509 - DNA, 1060 bp, Oryza sativa
aattcgagctcggtacccttactctttttttttgttttttgtttcgggagactgcagtctgcaggtagtactcttgatcgagagctcactgatccggaatcaacagcttcccaaatcgaagccctactcctaatcctccccatccccagatcaggagaaccctacgcggatccctgccctgcgcggcgagtgctaaaacgatacgaactgctctctctctctctctctcgtcagatcccaaacctaactatggaaaaagaacatgtcgccggggtacacagaaagatatagttgcgcacctgcggctggctcccgccggcggcgcgtcgatccggcgatatcctcaccgaattgatgatgaaggagagagaggcgcggcggatggatggattgggtagttcgtggaatggaacccagacgatggagaagggaaagggaggaacggaatattcttgggccggcccaacacaaaagcccaatgtacccaaaactagcttaaagaggcccatgtggccctctgacatctactaggcccatatcggctttgaccccacctgtcaatgggatgggcgctgaacggacggaaaggtcggggactttctgtgcggttacgcggggcccacctgtcagcgtcgcccgtgtcgctccgtctccaaccccgccgcgcgcgacaagcgagcggccggtggccgagacgtcgtttgaccgtccccgattcgcccgccgccgccggcgccgcccgccgccacagcccgccggcgaaccgtggccgtatctctctctatcctctccgtagatggccggcgcgggtgcgggtgcgggcgcgatcaccgctctcatgcgcgccgcgcacgtgccgccggcgccgcgcgcgcgctcgattcggggcctcgccgcggcgcgcggcttcctcctctcgtccgcgccacgcggcggccatcgcgccgtcatcgttctgcccttacctcccgcgcctcagctctggtgcgttgcctggcgtgaattgctgctgccgtatgacgtacatacagctcgcgcctcagctgttcgacgtaatgcc

SEQ ID NO: 13510 - DNA, 1901 bp, Oryza sativa
ggtggcgcggtgtccacctcgccgtccgagcaggagaagcagcggcagcagtcggagctcatcttcctcggcacgggcaccagcgagggcatcccgcgtgtcagctgcctcaccaatccctccaagacctgcaccgtacggccaccctcttcattgcagcagcgcgatgtcgtttctatgtcatactttgtgttgattggttgctcaatgtcatttgctcactttcttctttgtcctttcctgcacgcaggtctgtaccaaggcagccgagccagggaatcggaacaggaggcgcaacacgtccatcctcctgcgccatgccacgccgtctggcacggcgaacatcctaattgacgctggcaagtaagtatgcgcctttggttgatctgggagtctgaaagtttgcttcatttctcttccattctgggttatcattcttgaattgaaaaagagtgagagagagtaatgagacaccactgtgtttttctctgcttcctctgctaggttcttctaccactctgcgctccagtggtttcctgcttatgggtattgaactgctgacgtgctccatatttgtttccgagaaatttagccttgttaaacgctagcttctgacattcagattgaggacaattgatgctgtgattattactcattctcatgcggatgcaatcggaggtttgcaaatacttttattgaagcaagcaactttattaatattgattgagacaacacaccatgctcgttttgctcttgagctttctaaaagaaataagaactcctttggtacaggccttgattgtcttcgcgattggacgaacaatgtccagcccaccatcccgatttatgtagcagaacgtgattatgaggttggtgctatgtttgtagttttgtttttgcttctctagaattgcagcctcagaaagtttcattcctaacgtagacaactgtcatgccaattgaaatgaaactcacaacttctctttatgtatgcaagattttaacaactgggccactggctcacttttctttctatgcttgtactatttgttcgctatcaggtgatgaagatgactcactactatttgattgacacaagtgtggttatacctggagctgcagtttcagcattgcaattcaacattattaaagaggaaccatttacagttcataaccttgaggtctgttgtctaaaataataatttatgtaagcaagaagtagacataaaccacacgctatcagcaataattagctcttcaatccgcaaagaaatttctttttctcaactcatttgactgcactgtaataatactttatactctatgtaggcaggtaataaaaggatacatttacttctatatccttatttttgtttactatcataacttaattaactgaccatgtctatactttgagttatttgaattccaatgttgttctgagttaaatgttagtaaatccgtcatgaacctattagttacatcctatgttctcaaaatatgttgttttggtcatgatctccggtagacacctgtgaccatcgatttgttggccaaaagtatgtaaactataaggtaagtaattttgaatgtgcctttttaaattgcatgtccaaacgaaattaatatgtttttaattatgtcagtttgcgctaagtgtactttcgagtgtaccctgtctaatttattttgctgaagatatgatttctgtatttttcaggtcattcctttgcctgtctggcatggtcagggttaccgctctcttggttttcgttttggtcgtgtatgctacataaggtagatcaaagtgcaaagctaattttttacaatatattctgttggttcaagttcaacacacatggtcttaatatctctgatgtacacagtgatgtcaatgatat

SEQ ID NO: 13511 - DNA, 3033 bp, Oryza sativa
  unsure (1)..(3033): unsure at all n locations
ggggtagttagttctaatatatcaatcagctctagcttcttattgcttcactgtattccatggtgatatattcttcacttctgcaggcccttgaggaagttaggaaaatcaacccaaagaaaacactgtttactggtaatcattttgaggctcgtttaatgcctttactgaattaacgctgctagacttcttcagtttaaactctatgtgcactttaacttttcatgttaatttataaaaacattaatcactctggaacagaatgcacagtttactatgagaaaaggtacattgttctattgcatgtttgagaaagcttatctgcctttctattgattggcagaatttaatctcagaaaggaaaaaaggggcaatatactaaaaaaatgatctccttagttaactgttcaataatttggtacttcatgtgcacaataagcatgatgagggtgtcctacaatcactcacgccgagcttgctgtttgttttccaatggtgtgtttgatattttctcctattgcttgtcacataaaagaagaaaatatctgtatagtaacttagatctaaatattcatgttggtcacttttcagaacctttcaatgtcagaagttaactattactattcatgttactccagtttattcagaactaaagcatcaaagttcggctacttatttcttgtttatggacatgataagaaaaggtcgtttaatttgatcgaatttcacatgatgtagcttttattgtttacatgatgttgctcttgatgacttgactgaatgatatcttcaggaatgatgcatttaatggatcacgagaaagtaaacaatgaacttgccaagttgatggagacagaggggcttgacatccagctgagctatgatggtctcagggtacctgtatggctctaatactattaattcttttaaacacacacgacatttttttgtcttctaggcacagctaggatatgtttacagattttctaaggtttcagttagtaaaattattattacaagatgtaatctgttgaactccttgctttgagcctttgcttttcttttattctcccttctctatagagggagcttatgtagcaaatatacatcttataatttcccaatgcaataaaatttccaattgattgtttttgaaacaatactttcctatctttctgttgcccccttaaacagattttctttatggctattattgcttgggttggatacgggtgtgagggactgaggctagggatccagctgctggcagggcttattccaggcttccagctgtgaaagagaggctctgaggcctttggaaatgagaaggggaatactagcatgaacttgtatatttctgcttccgcaatgaagggtatgggtcctcacttatatagatgaggttaacccctaacaagagaatctaatcaaataaccaaagtaatctcgtctcctaaccaaaccaactaagattttaatctccaatctgctattttcttccctcacttggaggtggccttgctgattcttgcgtgtggggtgtctctacttgctgctggctgctgccccagagacactagagcccgtaacagttgtatggataactggactctaatgtaggattagggaccataaaaggaagtcatcaggacttccttgaaatccagctgaaggaacagaaaacacggtgggggggggggggtcaataaaccatttgatctgcaatatcacatgacacaaatgattactgggtacagatgaaactcctagcttgtctttcttcggtgaatcacactagatcccagcaataattagtaatttttcttctctaggtcacacataacaaaaggctggtgtccaggaatcgattacactccagctgctcgacatagtcttccccttaggatcatcactccaaaatatctgagtatgaaatatgagggaagcaatttagtctttaagagtttaaagttagaatatcattaggtaaagactaaagaagttaattttttactgtgtttatgtacctgcccatcatcatgaccgtggcttgagggttcgtccctggtgatctagaaaatgttgagccatcgactacacggacgcctgaaactccaagcacacggtgttgctgatcaaccaccttccctacatggcatccaccatggtagtgccagatggttattactgtatccctgcaaaattgctctagggattctgtgtcatttgtatgcttgggtatcaagttcacattagcctgcacactcatattgagcactctttccattgaatgtccatcagtgttggcagacagttcagagaaacggtttgtcttcagtattcgttcaatggtcttgataccatagacgcaacgagtgagatcctgtggatgactgaagtagttgaaggtaaccgcagggttcttcttgacatcagtgtctatcagggcaagatgtcccgtagacagtggaccatcaatcttctcgaggataaaaccaccatggaatatctctttgggtagattaagtttggtatttgcatacttctgtgctttttccaggcttctttccttcggaggaattgtggacagctgtccaatctgtaccataggaatataatatgtattagaccaacaaggccaagtagggaacaaattgagacaacaatggaaactatgatggcagttattggagttgttgcaatgtagacaacacttattttttttaatctccaagacaagaagttcaattctgagatctgattcctagaaaatctaagcataaaacaatgacttataaatcagataagtattatttcttagaatatactattatatgcatatgcatattcacctgtaattaatgaattggtctaagttgtgtttgcaatgttgcaaaatgtgagttttgatagtttagactttagaatctgttttcctttttgaagtctgcagatctaagcagcagctttttcctgatgtttgtgatactgctttggacctatnnnnnnnnnnnnnnnnnnnnnnnnnnnnnn

SEQ ID NO: 13512 - DNA, 11557 bp, Oryza sativa
ttttgaagtctgcagatctaagcagcagctttttcctgatgtttgtgatactgctttagacctattttatgcacaaaaagcttctcatgatgcaagtaagattgatgacatacctcagcggacatgattccatggtggcaatggatgctttctggtgactggccaaaaccactactggcctcaatgaacacaccagcttcagttattccaacagtctcaatcagggactggcgaggggggcttttcgtcggtatgaatatggagttcatggggttatcagccatccctttacccacatacttgttatggagaactacaggaattttatggctcctaaggtcattcttgggtccaatcccactgagcaatagcagctgggggctgccaattgcgccagcagagacaatgatttcactatcacagttgctgttgaggaatgcctggtggagtcctccattctcatcggtgaactgaactccggttgctcttggcttcagttgccctgcatcagaaatggtgtatctgaaatatggtacgtgattactgaacttactctttctattcatggcatataattctatataactctattttagaagataatacaacttgtaggagctttggccacacatgtgtaattatttacctctctgcgagttaaagactatcctgttcacactagcatgaagcagcacccttaggttgttagggtctccagctgcaagtaagtcggctgctgtgtggcggtagccagtctcatcaaagatggtgccaccaactttggtcccagaaacatggtcatatgtgtagccattgaaaggagatacacctgcttggagtagcccatcccttagtgcagcctgccaaggtgcgatcttaggccactggacgatcttgtcctccacccaagggaaggactcattcaccaggtcttcatcccagcctacctcctggatgaagctgtttgtttcaagaacaaaaacacatggtatacaagttattagcaatttaacatgtagttcaccaataacaatttaacatgtagttcaccaatatgaatatcaatatagaagtaaaattccttcttgaagactacgggattaagcttatcaattattgataccttttaagtcacattggcgtttctggtaatgagcaggtatatcactagggatgactgatgagcacgggtgtgtggggcccacccattgacctattgtaattcgattctgtacaaataattcgaatgcatatgtactaattggcccaaacttgaagtagcctcgagtctactagggttttagttatttagtgtcctttgcctagacaacttagttaccatgactgcaaagaaacaattatagccccatgtgattttgttttgttgtctctctctttttttttttcatcaatgtctcttttcaatctagtctgtttcagtaacatgtagttcatgactgcaagaagagcaaggaagtctttttattcactgagaaaaccacagcatgtgctgctgccagcgtagttaattatttgcaataccagactgaagcactttaatgcaaaccacttttgcaatctgcttattttctttatgttatcaactttctcactagtgctcatttgtatgcaagcactcaaagtacaacctttgctaattttacagctggattttatttcgttatatattgcagagctgcattgtgataaatctcaaagaaagcctgcattttgataaccataaactagaagtctagaatcataccaaccaaaatatgtagtcctagtgaaccgataatcatgtccaaatgcagtgctgggtacgttctagagtgagtgctagtaatgcaggtggtggttttatgcatttgtgtcttttggctggctcattttagtcgattagaacctatttgagctacactaattagtgtttgtttgtttccccgttttcccttttccatttggacgctggagaaaagaaacaagaggttgtagccagagaatcctaattggcagaaactttggtttcatggtaattgaatgctactattgagaacagtgaataatatttagtgttctgctgcacgtttcagcagacagctattactccacttgaagggtgaacaaaggtggctgcagtatgctagggtggcagcagtcaagcagatcttaccagttaccattagtaatttctactggcactatcactgctctgcatttaccctagagctgatgtttgttcatgtgaaagtgataggccatgtgttgcatatactgagagactacttggtatatttaatctacttatgctaacttcattttaggctctgctatttgtgcttgccctcttatggtaaagaatataatagtaaattatatctgaagtcttgatcatgattgagaccattctgcacttcggcagtaaaaaaaaaggttaaatttgcatgtgtgaactgtgaattctcttgcatatgtttgtgtgtatatattaatgctgaccattctgcacttcggcagtaaaaaaaaggttaaatttgcatgtgtgaactgtgaactctcttggctggtcactcgtagacggaagagaacaatcataatcaggtaagaatactgatacacaagatagcatccatatctgtgcaatgcaattgcttactttgagctggcccggctgtagaagccggcattgatgcaggtgccacctcccaacaccctcgctcgggcattgatgacgccgtcagtggagatgaaggcctgagacgccgagtccggcgccatattgctcaggccaatgtggaagttctccatgtaggagacgttgcggttgccatacggagaccctcccctctccagcaggagcaccttgtacttgagcgacaatgtcgccgccagggggcaaccggcggtgcccccgccgacgacaatgtagtcgtatgtctcgtggcgcatcgctgggaagctgctcgccttctggagggtagggagattccttaagctgaattgctggttgcctgagaaaacaaagtgttccataatgttgtcattgcctgaaaaagttttgctttgttctgctgtaagtttttcatgctataaccccctttttttttttgcatgacttcaataaaagctttcattatctaaaaacataacctgtttttgcatgttgataaatgagtgtatcaatctaattgatgctatgattactagggtctggacctcttggcagttggcattgtacctcctaggactggatgagaggtacgtcttgtggcattgtgttgactatttatttcctatccttcaatctctaaatattgaactctgaatgattagatgttctgctactctcaaatactagtggtgaggccaatgtggcgataaacaatgataggaaccaaagtgtcagataatggaagtgcacgtgataatgatattcttgcgagaaagaagctaagcaaaaactagcatatataactgcatttcaccattgcaagttcttcaatgggaaagtggaacagaaatgtacagaataaaggaggaatgcctgagaaacatgagatgagacagaatacagaatagaggaggaatgcctgagaaacatgagatgagacagaaccacaagagatgcccaccttgggataaactgaaggagcagaggcaaccatggcctggaagatgaatagcattctcgtgctcaaagccattgagcctgagaaccacctgccaagctaaactctttccccttcttaggatttccttccctccaaaacaacggtggcaaaacctctctccctcccctgtttcctgatctccacctctcaagcttgctcactgcatttgagtaggtttatgtagagggcttggcattgggggattgatagcaataggctgctgtgtatatgcattaaagagagctcaccagctctagtaagtgctattcaatgcagagggagcactggcctggtacaactgggatttatggacttcatcaaccaaccaaccgtagcaaggctgctctgaaggtacccaccaccctcattacaagaatgacagtcgtatatctctttcctctatctattcatagaaaaatattttccttttccaatctttttgccaattggttaagccaacgtgttattagtattctaatattctattcctggtctgttccctccatttttcaaatataggctgtgtttagttcgtgtgccaaaattttttttaagtacacggacacacatttgaaatattaaacgtagactaataacaaaacaaattacagattccgtctgtaaactgtgagacgaatttattaagcctaattaatccgtcattagcaaatgtttactgtagcatcacattgtcaaatcatggcgtaattaggctcaaaagattcgtctcgcaatttacagtcggactgtgcaattgggttttttttttcgtcgacatttgatgctccatatatgtgtccaaacattttatgtgacggaaaagttagaagtttgaagaaaaaagttgaaatctaaacatggccatagatacattcttgttatttagtgcagatgcttccatctttaaataccagttgcagacttgcaggaaacatatggtgccatttttttatagcaactgcagaaattgttttgtgctgccatcttcttggaacctatatgctgacaaacatgctccaaattataattagttagaaatgtctctgatgtagattatccagctctcacggcctgtttggttggagggagttggtgatggggaataggagtttatgatatctgggagtttaagtctgtagtttggttggaagacttgggaattcgagggggtttgggatggggaattaaaaggtcgaattctcaccaatatcttacctgggagagacctgttaattcgtgagacttggagggaattcgacgtgaaaccaaacaagggacgagaactaaaaatgtaactcccatgaccaatcccaccatcaactccctccttaaaactcccattcctcttcccttctcttaccaaacagaccgtcagtgtttttatttcatttcatctagaaaaattagccaccatccctgaatagacaagcatagcaaagtttactgtaatgcaccgctcaaagttaccgtcttaccattaagattacttcttttatctgcacactgttccttgttaatgcgatgtgtatagctagaaacaaagcagagagctaagccaagctgaggttgaattgactaattgtgtggcctaccttgtcctatctggtctgtagggatttatattgctatcgctcaaatatatcatttatgggttgatggccatactaaatacacttaacaataataaatgctatgtgctacctttagttatggagtacattacattacattgcttgagactcgtcatgatcaacatacagtgtgcaaaactgttctttgtttttttataagacctcttttaggacttacaaagctgttattgaacctttcatgtccattaggcggtactcacttgtgagcaccaggaaaagcaattagacctccatataaattttgaactggaaagcaagcgagcaaaatttattaccaccatcaactgcctgtgtatatttggcagaaaacaattgatgcacaagaaaagagtgaagtgttaactattacatctgccccaacattactaggctgtcctcttttcgttcccctgcaaccatggagcttgtgagtaaagaaaaataaaacactgagcgttcgtcaactacactatgatgcttttcttttcctgcatccctggaactcacaggtttactacaagagtgaaacctaaagcagaactatagctaatctcaagctgcaacgtgtcgcacacttttcatttccctcacaaggatataactcttttgttgcttatttgtctgcagattggaagaaagggacctatgcctctcaagcactttaaggagagggagagccaaggacaatatgacctgtgaagaaccagaaagagccttcacatcacacggttacatctggatcgaaaagagacgccctaacaacctactcgcaggcaacctgggattatttaaaggtaacacgagctagcgttaaatcagtttctacacacccgttttcacctgttgtcacagactcagtgtcacacaccaagcgtgtgtatgcatgtagatataacacaacttgcatgggtgaatcttttggtcgccatgcagcctacattgatgctgccggaaaattaggtgagtgggagatatatgatgacactgtgcatcatcttgatttgcagggctgtctgagctgccgaagcagagtggtgcacctaggggtcacaagactcacatccttgtccgggcagttcgctgatcgccggacggctccttaattttctcaacagaagcctttaatctgtattcaaatggctctaaatggatccgcagccaaacatttccaagatacaatcgtaactctattgggtggattctggaatctcgatgaaatggagttagatctgggagaagaatcagtactggaactatgtcaaatggggcaacctgaccagtgactagtgaccactgctacgagctggaacctgttaaatttccatgcccatccatccatatgatatatttcccactcaccaccagtttttctgaacctgatgcaattatgcaagtaatcaagcaatcaacccaccggtgaagatgttggtcaatgactgaaactaggaggctaaggttatgtcatcaagatgctccatctccctggaatcccagcattttcatcctctaccatttcaatacaaccacatggaaattgtgctagaatcatcatcatcaccatgaaacaaaggtacatttcctccttttgaaaagcagtgatactgaatttttcagcacttaaatacaccactttggatcctaagattggcgtcgacacccttaactcctgtggggtaaatcacaaccccctccctgccattggattgaatggttcatgcaacacaataggactacatgagtgctacaggtgaccccctcatccccaaagaaagttctagttctcgcaaggttccaagttcatcacctagccattgtgttcacccacttcccttgctccccttcatccggtccaaccttagtcgtgaatgcatgcacgtagttacatgtacgaacatctatgttatgaagatcgtagatgtcatcgtggcgccctaatccacttggcaggtgcggtttactacacccacatggcagtgactgttcacgacgattttcctagaatagttgcttgtactgtgaggagaacttgcaaatgtaaatactgctggcagcacacagttaggagagatgttagctgtgccatacggtgtgcgcttaaatgagaagggcagaaggtcacatggtagcgtatttaccagctgtgtcccagcactgtccgtctgctgctgcccattggtgatgcaaccatggccatgtttgtgtgatcccttgagctcaaatgcttcgtactgtgattatcaaaccatctaatactaatcaaagttgtttttgtagatgccactatatcgtctcacctctcttgtcctttcttttttgttgttaggaaaaatggggcgatcttgctactgtttcaagtttaaggcggcggcagatcagcgcagtcctcctgtctcttcacagatgattggctggaaaaacaaattctgcatctcatctggtggttgcgtctcaacggagctgacgtgatggtctgacaaagatgtttcaaaccataaattagtcactgacaaagcctgcttctgttgttcgccgaaattcttttagaagactcaggccctgtttagatgggactaaaacttttaagtccctattacatcggatgtttgaaaattaattataaatattaaacgtagactattaataaaacccatccataatcttggactaatttgcgagacgaatctaatgagcctaattaatccatgattagcctatgtgatgctacagtaaatattctctaattatagattaattaggcttaaaaaatttgtctcgtgaattagcttttatttatgtaattagttttgtaagtagtctatatttaatactctaaattagtgtctaaagacagggactaaagttaagtccctggatctaaacaccacctcagtttgattactgaatagtagtgattgattttggtcatttggggcgccgtctgcatgttccatcctgcctactggtaaagattagtgatggtaatacaaaggagtacatatgttcaatgttcatagcaatcctctacaattgtcctttcagatacaaaatttgaactgaatgtgattttgtgaaatgtgaaaaggagaatggtgaaaatacgaaacaatttcgaccaatcctaagggacgtatcactggtgaatgatgttcaaaatttatgttgggatgatccaccaccgcatgtgccttcctgcagaaactccatatctaatttagcgaagttttatgcaatacacccttactcccttaggtccatgaagtgaaatggccaagggggaaaggttttaacagggagatgaaatggtggggatatgatggaggtttagatcatacttgcaatccagctagagcaaatgcaagtgatgatgttggcctagtctaagagggcactacagtgaagatctagctcaaggatcaatgttgtgggacatgttgggggatctagcctagatgtgtctcacaatgaaggtcatgagtgtatatatccttaaccaccacaatgtgtgttgcatggcatgggagcctttgtcctccctagtgccaacaccatcgttgcctccttcattttggtgatgatggggtagttgtagctcatggttacccgcctccgggtttggtcatgtggtacttccattccctacactcatttgatttgcccctcccctgccttttgtgagagaccaacactcagaacaaaacccagagatgcatgtattgtgcaatggtgtgcagaaggtagtaactgggaatcaataatgttgttacgcatcatcctcaccaaaactcaatggcatcgccaattcaccatcaccacaatccgacttcttagttttcttaatcctgtgtttaaaaggagcctttttggtcttattgtgacacattttcgtggtggagtcaggagagagctcctattgactgtcagtagttatgagagcatctccagagctccctaatatcagcttcaaaagataaattttaggaatctagaaaacaggtctccaagagatgcccaaagatggtaccaatatttacccacacctaaaaccagaactaatctgaaccaattttgggcacctccatgcactcccaattgatgaaatcgccggaggtttttgccactcgtgccttttcttcccctgtcgtgcactgccgcgagatgcccgagccatgcctgcagacttgtcgatgccctcgtcatcccctaccgcagctgttaggcacgcgcaagatcaccctgctgcacaacatagctgagccgctagcgcgcaattggttggtagcgcctaacgccgatctcccttttatcagaaaaatggaaagacaaacggttgaagcagatctacttgagatgatgtggcatgttttaaaatgattggaaaccaaatttaggggcactcttggagtagaaggtgatatttgggcccaatttcttttgggatggtcccaatccaagaattttaggagttaaatttttggatgctcttggagatgctctcagtggtaaattttcggcaacaaagctgaggtattccatgatgaaacttatgatttttttttttgccacacgatcaaatccattttcatatcacaaatttaattagctaaagacttgcatgcatatttcaatgaccgaacttataactacataaactccaaactacaccaaacagaaacgatcacaataatgttccaatagtgcaattaattcagctcaccaaggatgtctttttctctctttgaggtcccaaccactaacttctccagggtgtacattaccgttttcaaggtgaaaactgatccctttcggtttaccgaaaaccaagcgaatactactttcgtaggctctatttgaaaaccggcttaaggctagtctcaacacaagacactaaatatagttttcataaacttctcatcatcaagaaactagtactagacactactcttttaatgcaaacactattttttcatacttaaatttaatgctacttatttcacatgatgttttggatgttgtgtagaaaccatgtcttagggcacccgcaatggttatctataggctctctacaagagatctatgtcagcatattttcctacttggaagagattaaatgaagagagagagcaaagctatctactaacctggagatagtctataaagaaaaacgaggcaatgaattagatagctatagatacccatgtagacataccattaaagtggtttactattaatctagtctattgctgatatgtacatggtagcaccttactttaccattgtgggtgctcttatgcaagacctggtttccttatctttcctcatttattcacttgtcacattattttttatactaggtagcagcttatttaatactatggacaccatactagtctttgggttggaaatggtctaaagcaatcggttttcaccttgaaaactgatccgtgtcggtttaccgaaaatcgagcgaataccacttttgtcagctttatttgaaaaccagctaaaagcgatcggttttcacaaaacagacccctaacattttgatgaaaaccggttagaatcgcgaattctgctcccaagctaatccattttgatcccccatcgcattgtcctcgctcgtacggaaaagagaatcaagatatgaaaagtttgaaacagaactggaaatttatttgctctttgatggccgattccgatgtgcaactgttcgtgcggtggatacatactgcatgccatgtcaaccacggaattcaattaaactcactcgtcgaatgatgttgaaattgaattgaattgaatgtcgatcggtcaacatcatgtgttaattggaacgcgtacgtacgtagatacatctcctactatcgcattattgttcttttgatcagaaccggacaatgccagtcatctgcacggctactatcagatgtataaagacaacgtatatgtacacacagtacatgtgtcgtcacgcaccgccttatggaattaattaaactaacttaattaaaagcagtccataataaaagatttagtatattcaaaattacttgtaagcatatgcatgggtggctagtaagttgcacatgtatggaggacttgtacagttgtataattgtatgtgtcttatgaaaaatttgacagattaacttgtagcctgatagactgccttctttttagttgaagaaaaaggtcacaaattgaaagatgtgaaggggctaaatgatctattgtatgtgtctatggcgtgtaaaatgt

SEQ ID NO: 13513 - DNA, 2498 bp, Oryza sativa
  unsure (1)..(2498): unsure at all n locations
nnnnnnnnnnnnnnnnnnnnnnnnnnnnnnnnnnnnnnnnnnnnnnnnnnnnnnnnnnnatgcaagagacaaactgtattggtaaaagtgtagaaattgtttcatctagataaaactcatttcatctctcacttcattaatttcttactacatcatcaaaaaatactggcatatgtcaccctgtttagaataaaaattctattgggaggggcccaaacctaaagtcgtgtacttctaaacataatatgggccgtactatgttttgggccactcacgaagcccagcaaaaagaacgcgtcctaccttgaggcccaacttagtaacgcagatccagaattccagaggcctcttcgcttcacccaaaaacccaaaccccaccatggccgccgccgctgcctcgccgtctccggcgacgccgccgcggatcctcctcgccggcgacgcgaacggccgcctccaccagctcttcaagcgcgtcacctcggtaacctcctcctccgccgccgccgcgtcctcccctcccatctcgtcgtatcctctcaccggctgccgtcggcacaggtgaaccagtcgacggggccgttccacgcgctgctctgcgtcgggcagttcttctcccccgatgccggcgacggggatggcggcggcggcggggaggtcgcggactacctggagggacgcgccgccgtgcccatcccgacctacttcaccggggactacggccccgcggcgcctcgccttctcgcgaaggccgcgtccagcgcccgaggcttctcccccggaggcatccagatatgccccaacctcttctggctcagaggcagcgcccgcttcaccctccatggtttctctcttcgtctttccatttctcaattgtgttggactaatttgtttcattaacttaggcgtaaatactgtgctcatagatgagtagctttacatctccaatgtctgaagtaaaatgttaaacctgttcaattgcagcatcttttcttttgaagctgataaaatattccatgcgagctattgtagaaatgggctggaaatgggatcatcgaaacaaatgcttgctttagcaattccatttattggattttctcacctttcgttaggtttatctgtcgtttacttgtcgggaaggaaagggccaggagggcctggctgctacagccaggatgatgttgatgcactacgggctcttgccgaagagccggggattgttgatttgtttttgacatatccttttttctttctatggcattattatttcttagctgcttgtgttaaactgaggtgttgtcgtacatgaattctcaaagtatcaagtttggtgctgagttcccttgacgataatgagattgcactaacgaatggcctgctggagtggtgaatggagttgatacttctaatgcaccttctcagatatcggatcctcatggatatgatcctgtagttgctgaattggttgctgagattaagccacggtttggtttctgaattcatattttctatatccctccttgaagaagaaagtagtgttggtggtagtaattcagattttagagttcaaatccattgcactgatgttctccgggagtaacgaaaactgtaattttgtgataaaactgctgctaaatctgtagttttgtgatactatgccttaactctatagttttgagataaatgtgatgctaaatctatagttttgttatacacctccttaaatttgtagttttgcagtagtttggtcaaggtatttgtagttttgtgaaattcacacgaagaaccttccatatgacgttttattctcttttaggcttttagccttctaacaacaaattcacgaattaacattaaaggccaaacatgactgaattgccatgtatatatgtggtgtgtgagttaattctgaaatcagtgtgtgtatcacagtcaaatgccccttgtaacacaaaaggtgaaggacttcaatgcagaaattacatttatttctttgaacaatatgaagacatgcataattttcttttatccaagcaaatacactagtattaagctagtagtttaaatgttgactagactaactgaaagcataatcacggaatatgtttacatttatataagtctataagatacaatgccaaccaaaagtataccgaatttgtaacaaaagtctgtttcctgcagatatcatattgcaggttctaaaggtgtattctatgcaagggaaccatatgtgagtgattccgctgcacatgttacccgttttattggacttgctaatgttggaaacaaagagaagcaggtacatctatatttggccaaatcaacttagttcttcaaacatagtttctggttataattctactacattttcttgtattttgttcataatttagtatacatattaagttctagtactccctccgtttcacaatgtaagactttctagaattgcccacatacatatagatgtaatgaatctaaacacatacatatgt

SEQ ID NO: 13514 - DNA, 9884 bp, Oryza sativa
  unsure (1)..(9884): unsure at all n locations
nnnnnnnnnnnnnnnnnnnnnnnnnnnnnnnnnnnnnnnnnnnnnnnnnntcttacccctgaaacggaggaagtattagttttcagttatatttatcattttcagaaatgaaaatcttcactgatttattagtgtatttcagaaacctgcaacttatatggttacaatatctgtttcctacatctttaagtcaggttttcagttagcaacaacttcaacaatcagtttccaggccttctggcaaagtgggtccacttatcatgcgcatggtcaagttgaccattacaatttaccatgtgtacaaactggacatgcacatatggctccctattggggctagggagaggagataacaatatgggtcctaggatcaaggtttaactaaaatagagttagttatgcacttacttgatggtggctttaccctgcgtggcgcactctcttccaagaccacgtcataagagcaactccagtgtggggcttaaaatgattttaatgcaaaaagatcgaactgtgtacactgtggcagtcgacgcatgcatgtcagagcaaaaatcaaactccaaagtatattcaaactcaaccgagtaaatagttcgttgccctgggccattggcacatgcaggcagggcagaatgtagtgattggaggaacttttttcaacatgggtcccacgattcgattcaacactacagctatcgaaccaaacctttattcaacttcggtggattgtagcagtcgaatcagcagtggagctgctctaaggccactttgcattgtaaatgccctagcagtcctgagttggccgtttgagaaatacaactgaacctgccttgtcaaatggtttagatggtagcagaattgcagttctgtgaacaaaatttgtgcactgattttgtggtagcagaattgctgaaatcatcccctgaagttgtagataactgatagttatgttaaatttctgttatcacatttactcttgatttgttgctattattcttaattgtctactcattattgcatattctttttcagaaatttattcatgcaatttctcctactccagcatctaccatgtccagtgttgatattcacgcaaggcctccaaatactactttatccccatatatttctccagcaaagtcagttcctgttgaagaaactccaaagcgtcctgctgaggatgctgatttgcaatactggcgttacgatgtcaagaagcaaagacatggtgaagccggtgggaatcgtctatgtttcaaatttacatcatcaggatcctgtcctcgagggagtaaatgcaattataggcatgatgaggaggccagggagcattacaataggaatgtctgttttgatttcttaaacaaaggaaaatgtgagaagggtcctgagtgtaggtttgctcatagcctttctgatgagggtgctgttagggatacaaaaccacgtaggtgagaaaatattccaaatctctcactctgtctgaagcacacatgcacaatctgccaccccacctactcacattgcacttttacaaattaccccttaaacttcttagtattaaatatcaatcaaatcctaaatggatagacatataaagttaaattgagtagtagtattataatatattttatatttttttatctatagcaaagcacaagcattcggctagtatactaagaattctgattatctattgtgggattcaccctgtatttttgtttactacagcgaacgaagacgtgttgagagcagttgctggttctgcttgtcaagtccagatgttgaatcacatcttgttatcagcattggagaaggttactactgtgcacttgcaaaagggccacttgttcaaaccatgttctagttataccagttgagcactgctctagtacactaaagatgcccgtggaagctgaggcagagcttgggagatataaggatgctctggccaagtattttgagaaacaaggaaagatagctatatacttcgagtgggtttctcagcagtcccgccatgcaaaccttcaggtgaggacatttttttcctgatatgttgctccatgcttccatttaaatgatgctgtcatttggaatttggatgcttgtatgcgatctcatttgttttttgttcatactggatggtaatccactaaatttctgcgcaggctgttccagtaccattgtctaaagcatcaagtgttaaaaagatattccatttagcagcacagagactgggatttgaattttctgtagtgaatccaggtgaagttgtacctaactttatctctcttagtcagctgaatagaaaggggatagacaaaaacaatcttaggctgcgatcgttcccctgggttcccctgggttgggaacgtaaccctccggcacggaaaacggaatggtccattagcacgtgattaattaagtatttactaaatcttttttcaaaaatgaatcaatatgatttttttaagcaacttttgtatagaaactttttgcaaaaatgcaccgtttagcagtttgaaaagcgtgcgcgcggaaaacgaaggagaggggttgggaaccttgagtatagaacacagcctaaatgggctattcacacatcaatgagcatactgtgatgccaatacatcttcatgatgttgcttctctaaggaagtcttcctaaaagtttcaacaattgtgtatcacgtggccaagttttatgttgcttataattcgatttgccctgagctctctctttgttttcagatggtgatgctaaccgcgccagggaattgttaagatcagagtgtgacagcaaatcaagcttgttttatgttgagctaccagaaggttcagtgcttttacatttggttgacagtaatgagaagttccctgctcagtttggccgtgaggtatatataccatatgataatcgttaaggcctttttttgtctgaaaaataacctacatggggatggaaagaaaataatgatatcgtcgaaacctaactgtcaatctacaggtgttggctgggttgctaagcatggcagatcgtgcagattggaggaactgtaaggtttctaaagaagaagaaatccagatggtggatgattttaaacaagggtttcgtgagtttgatccagctgaatgacaatgtgcttaagttgctaatttgtcaccggacaagaacgtgctgctaaacttgcattgtatttttgtagttgaaagtacttaggtaggccatatttgagaaatggaccgactttgaggtccattattgtaatttctattgattgattcgggaacaatttttttttcagttaagagttaaaatttggccgtagtgccacgtttgttcttcgagacttctcgtatacaatgtgatgatctgaggcgatgggcagtggtcgaaattcttatatatcttttttctttagacctgtgtcctaaagtaggaaataacacatttttcttgtgcttgtcgatgcagaacctgattgtttttttcgcacttaatgtgtagttggtttgaggaaaaaaaagggtccaattagaaaaaaaaaaagaaaacatgaattcccaaaaaaacgagaatggaacgtactagcgtttgtttgaacatatgacaaatttgaccgcgatatcttttatcgcttcctattttctaaaccttgacttttgaaggagaaaaattagaataaaataaaaaccatatttaaaatcatttctcgttgctcgagtaacaaaaaaatagaataaaaaaaatcatatttaaaattatttcttgttgctcgagtcacgttagcctacaagggataacaaaatcaaacatttgtcacgtgtcagcagccaaaaaaagctcgaccaaataactataaaatcgtgcataacctcattaaaatattgataaaatatattaatactatggatatcagttcacaaatgcatgttagaactattaggagcggccaaacatgcatcagcccatgcccaccctaccccatgtctaggcatcccacttctaccgttgtcggagtaaacgatttactcatatcacgcgcccctaccactcacctttattcgagtaaacgatctacttcaataataaaaacaacttccctgcttccgatcccaccctacatggcgcatcgtgctcccaccattaccagaataaatgatttacttcaataaaaacaacttctctgcttccggtatatattctatttttctcgtacccaaccaaccactctcgcccccatttctttttttttctttttttcggatctgaatcgatccaccatcccagcccacaaatcggcgacacaccatgaaggaggacaatgacaccttggcggttgatggcggtgatcggcggctgttgaggcgacgacactgcttggggcctcgctaccgaacgctgggcagcaccttaactagcaaggaggtgttcacctgggccaatagcaaaaaccagcggctgctccatgtcggcgacattgatagaacaaacaagtaaggaattgacactgattttcatctgcatactctccttcaacttcacgtatgaagccccaaattatttttttgcaaatcaaattaacttgcaatctgcaatattacctgatctcaattgatgggctacacaagtcctacatttgcacatcgtgctccatgtggctggctgcagaggatagggtggagtccgccggtgatggaggttgtttgctatttttcttttactcgtcatctctatcgacatgaacgagaatgtttttgtatttttttcgtgcttgctagatgatggatggctgctactgcgcaacgtcgagctcatctctagaccacaccgctacatccttccatgattccatcatcgactactgctcgccaactggttgccctctccactaccagtcacaagacacataccatcctcttcatccttatagcaagatccagcaaagccactagacggatttttgacagaatcatttttttcttttctagtttgattcacctgtgagtaattttatcgcttgtgtgtgattgagcctataattttttcattcgtatgactattttgtgatatagatcactagtttttactcttatactgtatattgaacacatcagtaaacatattactacacggtggctacgagatcatggctatatcgataggaaagtgtaattattttactcgcagaccatgaaatctcaatttttactcttatgtattgtgtattgaacacatcagtaaacatattactatacggtggctacgtgatcctgggctatatcgagagaaaggtagtaattgttttactcacagaccacgaactgtaaacaatatttataatattggtaaaataattactagcattgtaagctggtagtaattcttttataaccatctagatatgacgtcatacgatgttgagacattcatgtgagtaaatatgttacttttaaatgagtagttgtgagaggcattcgttacttccaaaatgcgcagagatactaggagaacaaactcagaaaaaaaaactagaagctaaatattttactaaaacgcgaaaacataataactacatagaagaaacgaaaaaacagaaaaaattactaaaacatgaaaacagaataactacaaagaaaaaacgcacggataaggtggaaaggagaaaaaaaacaaaaaaaaaagtaggatgcagagaaaaaggtggggtggtaaaaaaacaaaaaccggagagaatgttatacggcgctcgatctattattccgcactctagcgctaccgtaaacatttctcgagtttatctccgtttcttttctgtttttttccgttacaacgcacggaccgcaacttcgttcgtcgaacgattttcaaacgtgcaacggctactgcaaaattacgaaccgaattacgaaagaaatcgaaattctcccccgttaataatccacgttttccgatgcatccatgactcattcttcgtccgttcgaccgatcgacgcgtattgtttggatcaggtttgttcatcggccagctagctatacctgcaggtagctcgatccaaattaaccaaaaaaacaaaagaggttaccttaaatagcctaattgcgcaattagccaccactaatcacgcagcgaaacacggtcccctcctctcttctcctccactcaccaagtcaccatcgcaccgacctcgccggccgcggcggccgcggcggcggcggaggcggaggcggaggcggagccagcaatgacggcgtcttcctccaccaccaactcctcctcctccgtctccaccgccgacacctcctcctccaacccaccgccgcaacacgcgctccaccgccaacacatcgccagcagcagcgctagcagcggaggcggaggcgccgcggcgccgcttccgccgcgcgcgcccccgcgcgtaggcggcggcggcggcggcggcgtagggcagagccaggcgtgcgccgcgtgcaagtaccagcggcgcaagtgcaacgcggactgcccgctcgcgcgctacttccccgccgacgagcagcggcgattcctcaacgcgcaccacctgttcggcgtcagcaagatccagaagacgctgcgggacacgccgccggagctccacgccgacgccatgcaggcgctcacgttcgaggccaacgcgcgcgccagcgaccccgtcggcggcgcggcgcgcgtcgtcgtcgagctctgccgccagtacgagatgctgcacgccgagctcgccgccgtccagcaccacctcaagctctgccgccagcagcacgccgctgcggcggcggcggcagccaacgatccactcgtcgcgaacgtcgacccgctcgctgacccggcagcggaaatgctcttcgccggcgccgtcgtccctaaccagaacgacgacgccatggtcgacgcgttctacgccgaccaacaaaccgccggcgacggcgaccaagagcaatacctcgtcaaggacgaggcactagctgcgcaaccgccgccgcaacaaccctacgagtacttgaactacgggacggccggcgacgagggcagcagccacgcctggtacaccggcaacggcggcgacgccgacgcctcgccgccgatgggtttgagcgatcagctccagcagtgccagatcggggccgcgccgccgttcgatgtgaagcctgagctgccggcgacgatggaacacggcggtagcgtgttcgtcgaacagccggagcagaagattctgccggcggcagggtcgtcgtcgtcggcggcggcgcattgccagctggagcttgggtgctcttctaatgcttggaaagttggaacacacgttattaattaattaattaattagtttctcgatttgattgattcggatatgatgaaatgcttgttgcatttcaaattttggcttgttgagttaggagttaattacaaaaataatcactagactagcttataaatagtcaagttttaattaatagtagatgatgtatctatgaatgagagtgcaaataaaaggctctgtctattaatgaggttaatgaaattttctacctccaccaaggaacagaggaaatcaccttcactatcaccgtttgagtttcgccatctccctcaaatcattggcaagagatgaattctgatccagttatgtccatgcattattcgactgaaatttgaggaaatctgagaaacaaagtttttacatatagatcttttcaaggaaaaaaggagaataaataataatgttgtacaaatgtttttttaaatcaaatttactcctttgttcttgcgagagatatataagtatcaaattaatcataggtgatgacggaaaaaggctatgcgcctatgcgacgtggctcctctattggattgtgatgggctgcctattgggctgggaagccagggagacctgcggctgggccaaatgagtaaggctagactatgggggtttgaaaattctgaaaaatatataaatactagaccactatttttttttcactagtgctcagtcctaagctgcctcaggtccaattccacccatggtgagaagagcaccagaataatagtgagaatgattcatatttttgttcttttggtgaaaaaggaaagaaaacacatactatcttcatttttttaatatagacaaattttactacataacattttaatttcgtggttttaactgtagaacactgcacaaactcactttttttttgaaggggggacactctataatataccgtggtaatttttcagcagacaccgcaccgattaaaataatgtatccgtgttgacaacgtgttaggggggccgattttttatgtcgagtgaccgaaatgcccttgcaccttttggtgatattgaccaggtcggcggtgctatttgccgacaccgaaggcgaacagcggcgattcgcacgttgtggccaaaagaaaaaaaaatgtagaggaggtcaagacgaacacaacggtggtacatgcagacagaatggccacgggagtcaacgccggttgcgatgcaagcgggttggagtttcggcatgtgtgtgcatgttgtgctataggctcgatttggctaggggagtgcattcatgtggctctggggtctctaacggcagccccaacccttcatctagaattgtgtttatggcattaactatattgtcatatatgacttttagcttatgtggcactatattaattaagagagagagtgaaaaaaggaagaaactgggtctcatgcaagatacagcttcaacacaagaacctatgtactagacgctatcaagttttgcattgggagataatagtgtcttcataatagatgaagaataaatatgattggtagataagagagataatgtatttattaatggcccactttaagaaaccatgggttgtagagtgtagtttctattgtgatgtcttagggcagtcccaacccatagtgtctataagtagtgtctatgatgctatgtcaataagacccccgggggaaatagagatgtctcctacgttacccataatatgtagaagtatcgacgtaatttcatagagtcattcgatctgaatgttacatgaagaacataagccagatgacggaacgcggagacctaggatgtagaacatcataacatgagcgattcggcagatttggattcctttcctatatatccactcatgtggtacttcatcatgcgattcatataagatccatctgtctagagatcgtcatatacatctagaaagccgtatgctttggaagaagcttgtacagtttgggaagaggttttttgagagaaaagaagaatctacttcaaccgatatgcccttaggcacggccatacataacatagaaatcacacgtggaaggggtggctaattagctagagcagcaggtgttgtagcgaaactgattgcaaaagaaggtaaatcggccactttaagattaccatttggggaggtccgtttggtatcccaaaactgcttagcaacagttggacaagtgggtaatgttgaggtgaccagaaaagtttgggtagagccgggtctaagtgttggctaggtaaacgccccgtagtaagaggggtagttatgaaccctgtggaccacctccatgggggcggtgaagggaaagcccccattggtagaaaaaacccacaaccccttggggttatcctgcccttggaagaagaactaggaaaaggaaaaaatatagtgatagttttattcttcgtcgccgtaagtaaatacgtaactaggaatatggaaaattgcatttttggaatttgcaataatgggatgggcgaacgacgggaattgaacccgcccatggtggattcacaattcactggcttgatccacttggctacatccgccc

SEQ ID NO: 13515 - DNA, 3047 bp, Oryza sativa
  unsure (1)..(3047): unsure at all n locations
aattcagacctcgggctcgaggacgtagttctcccataaaaaaaaaccatgtgtcatataacaattgatccaaaatatagtaaagaaatggaataatctttagatccatctaagatttgattcccggtaaaaaaatagaatagaaaaatatgggacaaaaaataaatccacttggtttcagacttggtacaacccaaaatcaccattccttttggttcgcacaaccaaaaaattattctgaaggtctacaggaagataaaaaaatacggaattgtatcaagaactatatacaaaagaataggaaaaagggctcgaatagaaaaatagaagcagactcaagtttcgaagtaattacacataataaaaaaaatggactcaggctcaagttccgaagtaattacacatagaaattcaaaaagaaatcgatacaatccatgtcataatacatattggattccccaatttattaaagaaaaaaggagcaatcgaagaattagagaaagatctacaaaaagaagttaattctgtaaaccagagacttaatattgggatcgaaaaagtgaaagaaccttatagacaacctaacattcttgcagaatatatagctttccaattaaaaaatagagtttcattccaaaaggcaatgaaaaaagccattgaattaactaaaaaaaacagatataaagggagtaaaagtaaaaattgcaggccgtctcgcgggaaaagaaattgcgcgtgccgaatgcatcaaaaaagatagacttcccctccaaacaattcacgctaaaattgattattgctgctatccaattcgaactatctatggagtattaggagttaaaatttggatattcgtagacgaagaataaccaaccctgtcttcccattctgttcagtaatagaataaaaaatgacaagatacttattttccctaaaatccctgaaaaaaagaagaaattctacctctttctataagatttaatgaaaattgagaaatcttttaataaaattgctatgcttagtgtgtgactcgttagttttttttagggttcaaaaaggggattaaaaaaatagaatgaaccctactatgtaattatataaaatgaactaataaccaacctattgcttcgtattgttgagatcctaactaagaaacagtcactatatgaataaatacatctatcataaatgagtaaatctatcatatacgtgtagcaactgcaattttttgtttttaaaaaaataggattctaagttgtgaagcaaaactaaaggggatgtagataaaaggaaggatgatagaaagaaggaagagaaataagaaagatataggattccaatatgtatggtctatgaattacatcataaaaagcaatgtgataaagcatcaatataataaaaataacaaagaattcgaaatcgtaatttgattgaaacaagaaatacaaatttcaaggaataacaaagagtgtcccgagttaataaaactgagaaattgacttggaaagaaattttttggaagctccattgtgagattaaaacctaaccattaaaggagaagccgtgggaacgacagaacctatgactggataggattttcttgaaaagaatcccaatacttcattgggtgggatggcggaacaaaccaaaaaaattgtcttatttgataacaaataagacaggaaagagtaaatattcgcccgcgaaatttttattgaattagaatactttaccgcgattcaataagagtaaaatacaaaaaggagattaaaaaaaagaattacattaaatatagaatatagataaataaacatacacatctagatatattctagatcctctttcttgactatatattttagtattttaataaattcaatattaaaaaccctaacctttcctattaatgtgtatctatccgtaatattttagaatattgtggaattagagaaatttgcacactttctcatttgattcgcgaggagctggatgagaagaaactctcatgtccagttttgcagtagagatggaactaagagagaaccattgactataaccccaaaagaaccagatttcgtaaacaacatagaggaagaatgaagggaaaatcctaccgaggcaattgtatttgttttggtagatatgctcttcaagcacttgaacccacttggattacggcgaggcagatagaagcaggacgaagagcaatgacacgatatgcacgtcgtggtggaaaaatctgggtacgtatatttcccgacaaaccggttacaataagaccgaccgaaacacatatgggttcgggaaagggatcccccgaatattgggtagccgttgttaaaccaggtcgaatactttataaaatgggcggagtatccgaaactgtagctagagcagctatttccatagctgctagcaaaatgcccatacgaagtcaatttcttcggttagaaatataacccccgccaaaaaagtagtattgaaaataaaaaaccaggttcttctttctggaaagacaatatttctttcatccttttgcattgaaataataaattgaaatcaaaataatatgattcaacctcagacccttttaaatgtagcagataacactggagctcgaaaattaatgtgtattcgagtcataggagctgctagtagtcagcgatatgctcgtattggtgatgttattgttgctgtaatcaaagacgtagtgccccaaatgcctctagaaagatccgaagtaattcgagctgtaattgtacgtacatgtaaagagttcaaatgcgaagacggtataataatacgctatgacgacaatgcagcggttatcattgatcaaaaaggaaatccaaaaggaactcgcgtttttggcgcgatcgccgaggaattgagagaattgaattttactaaaatagtttcattagctcctgaagtattataaatactagtagacaagatatagatcaaataaaaaattagtagattgtgnnnnnnnnnnnnnnnnnnnnnnnnnnnnnnnnnnnnnnnnnnnnnnnnnnnnnnnnnnn

SEQ ID NO: 13516 - DNA, 1441 bp, Oryza sativa
  unsure (1)..(1441): unsure at all n locations
aataatatgattcaacctcagacccttttaaatgtagcagataacactggagctggaaaattaatgtgtattcgagtcataggagctgctagtagtcagcgatatgctcgtattggtgatgttattgttgctgtaatcaaagacgtagtgccccaaatgcctctagaaagatccgaagtaattcgagctgtaattgtacgtacatgtaaagagttcaaatgcgaagacggtataataatacgctatgacgacaatgcagcggttatcattgatcaaaaaggaaatccaaaaggaactcgcgtttttggcgcgatcgccgaggaattgagagaattgaattttactaaaatagtttcattagctcctgaagtattataaatactagtagacaagatatagatcaaataaaaaattagtagattgtgtttcacgtatatgctttagaatccaaaacgaaaagaaaaaagagaacgtgttgattatagaaaaattaggaggaacctagaattagagtcttatgggcaaggacactattgctgatttactaacctctataagaaactcggacatgaataaaaaaggaactgttcgggtagtatctacaaatattaccgaaaacattgttaaaatacttctacgagagggttttattgaaagtgttcggaaacatcaggaaagtaacagatatttcttggtttcaactttgcgacatcaaaagagaaagactagaaagggaatatatagaactagaacctttttaaagtgtatcagccgacctggcttacgaatttatgccaactatcaaggaattcctaaggttttgggcggaatgggaattgctattctttctacttctcgaggtataatgacagatcaagaagctcgactaaacagaattgggggagaagtcttatgttatatatggtaatcgcctcgcccatagcggtaatcgccccacctatagttatagtacccaaattctatcttgaacttcctatttttcaaacaaaaatacaatgtttttttatttgaaaataaaaaaagaaaaataggagaaaaaaaagtagtgtctatgatgctatgtcaataagacatcacaatagaaattacactctacaacccatgatttcttaaagtgggccattaataaatacattatctctcttctctaccaatcatatttattcttcatctattatgaagacactattctctcccaatgcaaaacttgatagcgtctagtgcatagattctcgtgttgaagctgcgtcttgcatgagacccagtttcttcatctcttcactctctctcttaattaatatagtgccacataagctaaaagttctacatggcaatatagttaatgccatagacaccatcctaggtggagggttgggannnnnnnnnnnnnnnnnnnnnnnnnnnnnnnnnnnnnnnnnnn

SEQ ID NO: 13517 - DNA, 1986 bp, Oryza sativa
ttcctatttttcaaacagaaatacaatgtttttttatttgaaaataaaaaaagaaaaataggagaaaaaaaagtagtgtctatgatgctatgtcaataagacatcacaatagaaattacactctacaacccatgatttcttaaagtgggccattaataaatacattatctctcttctctaccaatcatatttattcttcatctattatgaagacactattctctcccaatgcaaaacttgatagcgtctagtgcatagattctcgtgttgaagctgcgtcttgcatgagacccagtttcttcatctcttcactctctctcttaattaatatagtgccacataagctaaaagttctacatggcaatatagttaatgccatagacaccatcctaggtggagggttgggactgcccttattgacatgacactatagacactacttatgggcactatgggttgggactgccctaaggtgcttaccaaggtccaacaaggttggtcgcagtctgaacaatagcaagggcatccggaacggcttggcgacattgtggacaccgagcgaatggcgacggcgtgcttcggcaaacgatctggaaagccaacatatctaggtgatcagtgaattcctggggattctatggttgcgtggaatcgagatgcaactcaccggagagcgggggatcgacgttggaagccagtggccggagttggagaagaaaaccccgatctcctcatcgctgcatccccaaccaaggaagataggggcgttgtagagggcggttttcaggatggtgatggcgcaagggttcagccggatctgcactgaggcgaccggaacacagggtcgacgtcggcggtagcgtctgaagcgcgcccgcaagctccttaggtgtggtcagggttcactcttatcgtttgaggactttgtattggggtcaccgaaatcccgaaatttccgaaattttgagcaaaatttagttgaatttgaacaaatattatccaaattcatgaaaatattgaaaaatttaaaaatttcggccgccgaagtaatatcgtatcggaggtgaccgaaatgaccaaaatttcaaaaatttcggaaatttcggtccgaaatttccaaccctgggtttggtcacgttcccgttgatccactattcaaaatggattaggaccaaaataaaagttgtcaggcatggcacgtaaaagacaaaatggaaagagatcgagaagaagctattcagtggaggattgtaccatcgtctccttcgcggccgccgacagatcggaaggaggagaccttggaagctttctgtcttggtttcaactgctgagacatgaacgtggaagacgagaaatggttcagggagcttaggggatgtaggcaagttctccatagaggcgtcggtgggggtgaagtggaggccgggctggagctttgccgacgtggcatgaaggagcttccacgacgtcttccgcgtcaatgaccaggtcaatatgaccaaaaggcgcaaggtcatttcggtcactccgcataaaaaatggggccccctagtgccttgttagcacggttacattattttaattgacgtggtgtccgctggcaaattatcatgattataaaatgtcttccccaaaagtgagttcatgaggttggatgcacaggaggaatggagaaagaggaaaagcaagtgattggtgccatgtaacttatgatctatttgaaattatctggtagtttggatttcaatgtcttttagagaaaaaaggaagctagatggaatagacgcatatagtcataaatgcggcccactcaaataattataaatacgcacgcacatagatcataaatgtggtttctaaggcctactcaaatagacagaggccaataacaaatcctcgatcttaataaatacctactaaaaatgtatctgcatatgcgcaatatttgtggtcactgatgtttaaaccttgttagatgaaatcatc

SEQ ID NO: 13518 - DNA, 1886 bp, Oryza sativa
tccgtggccgcgcccgacacgccacccgcgcagcggccggagacgaaggaggaggaggaggaggacgcgaactacatgagcatggatgaggcgtacgcgctggtgatggcggcgcggcagcggccgccgccgacggaggaggaggtgaggaggtcggaggtggacgccaaggcggaggagctcgtcgccgagttccaggacgacgagcagaggcggcagcgtctcgactccatcttcaactacacgcagatgctcaagcggccatcgccgacggaggagggggcgaggaggtcggaggtggacgcggaggcggaggagctcgtcgccgagctcccggacgagcagaggcggcgccgcctcgactccatcttcaactacacgcagatgctcaagcagcgcgcggcggccgcccgccgggcgcaaccagcaccggcggcggctcagctttgactcacgtggttcatatggtttaacttcatttgattctttgatcaaatcaggaattcaggattcatttgcaggagaagaattcggatcagatttgagtttgctcttgtgttttgtatatagtatttggtttacatgtgtgcttggcttgtcaagttttgtgcagattacttgcagtgttgttgctgcaggaaaatttccctttttcagttttgggcttgtgtgtatatacggtactgttctgttgtataattttgtacacacattttacatgtgattttggacatatataaattctttgatttatttatgaattcattcatgttttacgtaaattgatcaatattgtgtagcatcatatatgtattattttacggatggggattctctgttacatcctctggtcactaagactgtgttctctctccggcacacaaaacgatgttcgtattaatacgtaattaattaagaattagctatttttttaaaaaatagatcaatatgattttttaagcaactttcgtatataattttttttaaaaaaatacaccgtttagtagtttgaaaaacgtgcacgcagaaaatgagagtagggagttcggaactcccagcaaagaacgcagcctaagtgaagattgtggtatataggacaccaacgcagtgtccctaatgtaatttttttttgccaattgttgaatatttacagaacaaaacaaaaattcgagaaaaatctacatgttctgtattttctatgtatccaatctaattagttaagaagacattggtattcaaagtttaaaggtttgaccacatgtttacaaactacttcaaacgcattgcctttggtcggcaactaaaaaacaacacggcaaattctcaatacatattatagcatactctacaatttttttttgaatctctatattagtctattggtcaaaccaaaagctagtatttcattgttgcaccaaagcatgtgactaaatgaaattcatatgttcttttttatttgatggcttttaaattcgtactaggcattacggacagggcctcctctaattcaaagcccaacacttgtaatccgctcaagcccaaagggcccccagaagatttgccccctctagttgtctgctctatcgcgggctcggcctttcgtcgaacagctggtgcgcgtcctctcatgtcgagcacctgaccgccggtcacgtagcggcggcggcggcggcggcgcggcaagatgctctcccgcgcccggcgcctccaccccaccctccagcgaatcctccggccagtcccccctcccgcccatcctcctcctcctccttccccacctcaccgccccgtcttctcccaaacccctaaacccttcttccccttcctccgacgccacctctcgaccaaaccgccgtcgccgcaggcgccgccagagaagtcgctgg

SEQ ID NO: 13519 - DNA, 1760 bp, Oryza sativa
  unsure (1)..(1760): unsure at all n locations
agctcgctgggtcgcgtggcaatgtgtgggcagtgggtgcgaggaatgttggcaagtatacactgatcaatgccattgcccggtgctccgggattgaaggcggaccgaccttgacgaaggcgccggtgccaggaacgacccttgatgtgatccaggttgatggcgttcttggatcgcaggcgaagctgttcgacacaccgggcttgcttcatggtcaccagctgacatcgaggctgactcgcgaggagcagaagctggttcgagtgagcaaggagatgcggcccaggacatacagattaaaggtgatatatatttgcacatcacccactcaaccccagtcgtgtttgtgataatgcgcaattgacatagttgctgctcattttctaaatttcagcacaaatttcttgttaacgagtctagattttctgtagttctctgcaacagaattgaagatactttgcttaagctaaacttttgttcccgcattgaaagtagttcggtaaatcaattattgaggaaatgctgtggaattgaaacaagcgaacagacattgcatttacaatgttcttgtgacatactagtcacatagggaaaactattatcaactccatcaagttccacaaattgttgtgaacaattctagcttgttctagtcctttataacaaaattgaatctgcttttggttaaaagctattatcgattcgaccaagttccacaaattgttgctttccccctaaagacagtgcagtaattttgtaactgaacctgacaagcacatgatactggattggacagaaaatttgcaccttttgcacttatgaaattctaagtcttaaacttgtgacagtttcagttcttagacttatgactgggaatcatggctgactcaatctagatgtgatcctttggtttccaaacactcttctattgccacaggattcttcactcttattatgtgtcatatgagatgatgcatgcttatctaaaacttgttggtaacctatgcagccagggcagtctgtacatattggagggctggtgcgcctggacatcgaagagttaactgtaggatcagtttatgtaacggtatgggcatcaccacttgtcccacttcacatggggaagacggaaaatgctgccgctatggtaaaagaccactttggtttgcaactacaggtatatttattacctgaatgaactttattttctcctaattcatgtagtattgcttaagattataacacaaagttctacatggtgtctttcctgcagcctcctattggccaacaacgggtaaacgaactaggtaaatgggtgaggaagcagttcaaagtttctgggaacagttgggatgtgaattccaaggatattgcaattgctggtcttggctggtttggaataggtctgaaaggagaagcggtattaggactatggacatatgatggtgtcgatgtcgtctccagaaactcccttgtccatgagagggcaacaatatttgaggaagccgggttcacagtttcgaagattgtctctcaggcggatagcatggcaaataggctaaagaaccctaagaaaataaacaagaagaaggataacaaagccaattcatctccctccacagatccagaatcttcaaatccagttgaggctgtagatgcttaaatgatttctattcctttctaggacaggagttcccgaagggnnnnnnnnnnnnnnnnnnnnnnnnnnnnnnnnnnnnnnnnnnnnnnnnnnnnnnnnn

SEQ ID NO: 13520 - DNA, 17006 bp, Oryza sativa
ggtctgaaaggagaacggtattaggactatggacatatgatggtgtcgatgtcgtctccagaaactccttgtccatgagagggcaacaatatttgaggaagccgggttcacagtttcgaagattgtctctcaggcggatagcatggcaaataggctaaagaaccctaagaaaataaacaagaagaaggataacaaagccaattcatctccctccacagatccagaatcttcaaatccagttgaggctgtagatgcttaaatgatttctattcctttctaggacaggagttcccgaaggtgaattaagttctatgatgttggcatttggtcagttgaggattgatatacagagccataggttgcacaatttatacttgttcagacttagatagcatgctgctctccgcacaagtctttttttttttccctgggatcatggattttatgtagtcttgttgtgggcttgtaacattaacctatggcttttatgtactcaatgaacttctaccactatggctttggagtttggaccataagtacaattttgatagtcaacttgatgaggagtcagtactgaagaatactcgttgtaatgctgttatggctgaacttctgaaaccggcatctcacagctttgttatgcctgctttgaacacaggaattttacattgattttataggaataccacaggaatcaattgaatcctcatggtaaattcctgcacttcaaaggaggccatatctgaccatctcctaagttatttctgcttgaaatgaacatgagcctccagaccgaaactttaaccttaccctgtttggatgtatgaagtaatcaatcactctgctctgcatgctgaagctaatattagactttatgatgtattgcacaaaagtaagtaaagatgatctcaaatgccagatttgtttggcacataaagatggtgtactcttttcaacccaaatcatgggatgccatctttgacataaagtacaacctttatggattaatttaacgaaagcatctatatgaccacttcatattaataaggtcggttgttaatggtgtgcttaaccagaattgggaaagaggaagcattttggtctaaatgtgttttgtttgctcatgcattttggtctatcagtgccaaaccatgtattactccatataactacctctatctacttcaatcgaaggccaaatccgactacctacaataaaatgtttactaacccctgaactttgataatggtacaaataattccatgatggttttaaagcaatttcgccaagctaactgcacgtgtgacttcacaatcaggcaagttaaagtggcacccaataagacatggttagaagagaaatgtagatgagctaaatatataacttattacaagagaagaaaaaatatatatttccattgatatatgctaactctaaatcaagagtagtacaatcatcattagacaatattgctgttgccccactacacgctgcatgcattgcactatatataccaaagtaccaaacaaaaccaattaccaagaaaatcaaaatcagaattgaacaagttgtgcataccgaatctagtttaagttattcaggttgtcaggaacattcaattacacataaaacaattcaattcatgttaaaaaaaaagcactactccctccatcctaaaatatgtgctccttctaacattcaaaagctaaattatgaggtgagaaaaatgaccctggatgtcacttattaaatccctagattattggaagtggaagggtcgttgggataagacggggagaaatttgaatagtgattgatgtgataaataatacaaagagcattctttccgaacaaattttgaatccgaaaggagcaattattttgggatggagaataattgaattaatagtaaatttcactttgaactatctttaataacaaagtttctccatgaattaaggttgctatttgttactgtttggacctgtctgtgtccaaaatgtcaccagactaccacaatagtaatgatttagcccaacaaatttgagacaattagtggccgtccattattgcgctaaaagtttgcttgccaataaatggaagttgtcacttccagtaaaaatatactccaatagaagttgcatcgactgtgtcattaagccgacaaagcagcctctgggtggaggtggatgctactcctacaaagatggatatgtggcacccccttttgttggtctttggaaggaggaacaagttcatgtctcactagctaactagctagaatgagttccaattattgatcatgcatattgtaatgtggtcacaacctatagcttagactctaccaactaaatgcaccatgcttgagcgtggccaaatatatttctcaccagtcaccccagagggccagagacccaaacgtgtgatcggaatgtctttaagttaaacttttaaaacttttaagtaccaatatatttttaagtacaaatttgtattaatttatctcaaaagatagatttcataatgtttattaggttttgcaaatgaattgcaatagaagctagccgcaaacgctaattagcgactagtcccactctctttccaatttttttctctttttattgaatttttcttttcttttgggctccccctaaatttatggctcaatccgagatagctgatttcttgtgtatgatttttttctatacaaagtttcaacaccagtagaaagtttctatatgctagtacaaagtttccatattgtattgaacacggcctgtttgcctttttcatgtgctgttcaattttttctagatgcttatgtatatatacaaactctgtatattatgcgtacaaactttttatgtctaaaatgtatacgtgtacacaaactttgtatattatgcgtgcaaactttttaggtttaaaatgtgtatgtacacgtataattttatttgatattatataaaaataccccccccccaaaaaaaaaaaccaagcacggggagaccataatggggtgcacatgaaaatctttttttacgtccatgagtaacatgcatggcgtggagaacaattaattccattgaagaagtgtatcgatttttcacttttgctataaagtagtatatgataaaatccttatttatcatgaaagttgacttcttattcttaacatgaatcatgttttggaaaataaaaaattgcgtgaaaaattctacaatgacaaataaggaacaaaatatattgagaagcgcagcatgatggtaccctgcaattaattaatgatgcaaaatttcatctcatagtcgtagtacgttctagtattaaaagataataaagatgaattttacatgattgtatataccttgccctattgaacaaatatttttcccacaataaaaaagagagataatttaaatatactttttttgtgtatttgaagcacgggagtaccaatctttttggaacttaattgtatatactccatccgttccattttaagtgcaaccataaattttcgtgcctaactttgatcgtccgtcttatttaaaatttttttataattagtatttttattgttatgagatgataaaacatgaatagtactttactcgtgacttatgtttttaaatttttcaaaaacttttgaaataagacggatagtaacgcgaaaaaatcatagttgcacttgaaatgggacggagggagtatattagaagtgctctcccatgccgtggtgctagctagaggtagatctctctttatcacacctacctagcttagctgccttttatgtcttctctgccctgtcattttactgtcaataatcgaaatcgaaaccaatcacactcgcgaccgaccgacgccctagcctagccactgcacgctgtttccaaaaagaacggatgaactttttgatagatcatatcgatcgatcattaattggtccatcttttacgatctcgattgattgattgattattgatgatctggttcgttgccagatgatcattcatgcattatgcacgtacgtacattggcggagccagaaattttctaagcctagggcttgagtaaggctcaactaataagatattggctttctcaaaaacaatacaaggtgatttaaaaggatttaggcatgtttatggaggcaagcctagggcacacctctgcgtacgtatgttctgaagttgaagacaacttatgtatgcaaatatttaatttatgtattcttaattcttgcgatgtttcatttgtcacttcttaaaaatacattttcacatgcgcatggctataaagccattatttctaccggcgtttaattaccaacccgctgatggctccgctattttctttgagggaaccgtctatggaaataaaattttcccatttcaaaatatcatatttcacgtaaaaaaaaaaaactcctaacaccccatatgggttattatatgcccacgcagttgcaagccacgagtcatgcttcctgtagtcttcaacaattgaacccacgacctcaagtctagcatgattctatattaccatcgctctcatactcacaaatgaatatcaaaacgaatatttggacccaaaataatttgaaataaaaaaaattcaacttcaaagttgtagtcttatccagggctataatttttatataaagtttgtccagccttacatttttagatgcggtttcttaagataactgtatgcaaaaaaaacattttttcatgtgattttagaccacaagactacttgtcattatcacaagagaatttttctattattcacttttagaaatgaaaccagcttctttggaaaaatcgttttctaatagtgtttgcaaataccaatgcaaacacatgtatacatcatgctctttattaaagcagcagatcgacttggacatccattaattaattatctatatatctattatgcatgctctattaattccttattgactaagttttcgatcgcagcacacgtagatgaaccagttgacaagcaataggaagggaagggagattcgattttaggcgtgtgaagcttcggaatgagggaatctagctcgagcaattgtttatatgcacgcataagtgtataaatgtaacttaaatatatacttttttgtgccaaaagtaattgttggttttgtcttcggattaccaagatttgatcaacaattttgttataaataaatttaccatcgaagttgtttcacaattagatttatataatcaaaagtaatttacaaatatctaacaatcaaactaattccctttgatgttagcacttatataaaaatatgaagtttatcttctttcagtcaaactgagagggagtatcaactagctgaggaccaattactgatgtttgatgccaaactcatgactaagtgatgccgagatgtcaatgtcccttgatttgatctgcctgcatacacactactggtacagcttttgagagtgccaaagctccccaaaaatgatttttgaagctgactggtagtagcaactactcgcgccgtgcatgaatatgctctagggattagaagaaatagaattttgtggtgctaggcttattctattttactactttataattaattgtaacctcaattttttgtgtggctggcatgatcttcgaaattcacaagcatcacactaatatgtttttcttttcttaaataatttctgattgtcgaaacatgatttcggcaataataaaagggggtagcgcaaccaatgataatgacaaagacgctcatcagcatttgcatagtaggtcaaccgtcaaggtgaaataataagtcggcgaaaacataatcatccattagcaacagcggagatgtcagggccgatgaagcagaggtgctggtgacgatgtcagtgacaataatccatcaaattaatgttatggctattgtagatgcttcacttggaggagagttgatgttgttgtctaactcgtccaaaccgaaatatttgaagttgttgaagtagaatgtctgctccgaatcaaagatgaagataatgactcctggagttgactcgttggttgatgaattgatttcttcagcttgacataaaatttgtcaaattttgagccttgtatttgtgtagcccccgactctttgattagttgggaaacaactgaacatagagtcgagaactgtagcttcttgtcgtcgaatagtcattgcttgattgaagatatgtgttgaagatgtccaagtagaaatccggtggtgaagacgcgcagttgtgaagataaaagcaccagtcggcggcggcataaccagtcggcgacggaagacgatgatgtccatcagtagtggtagctgtataaccagacgtagaggtaagggcactagtcagcagcagacgagacgaccggcgatgaagatgtaggtgcccaacaacagcggcataataggccagccgtgtaggcggtgacaccagtcggcggcggatgaggcggccggtcggtgaagacgcagacgcccatcaacggtggcataataggccagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacgcccaataacggcggcataaaggccagccgtgcaggcggaagcaccagtcggtggcggacgaggcggccggtcggtgaagacgtagatgcccaacaacagcggcataaaggccagccgtgcaggcgaaaacaccagtcggcggcggatgaggcaagccggtcggtgatgttctgactgatccattcctggagcgtaagagataagcttaaagccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgcccgactagtcataaccaccaagcatcgggagtcggcctaggcacttcccaaacatgcatatgagtgacatgagttcgtcattaatggaacaaagtttcacggatcagaatttactactcaggtacttttgcaattattaagagcagaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaagcaatcaagataaatattataaaaaatatgatataacatctgtagcccccgactcactactcaatggaagaccaattggtgtagtgaggcagaggaaaaggaaaaatatcatataaagaataaaataaatgatgacttagctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacgggaacgaacgtgagccaacggtgaggacgtagacgcccaacagcggcggcataataggccagccatgtagacggaggcaccaatcggcggcgacggaggcaggccggcggtgaagacgtagacgcccaacaacggtggtgtgaccaaccaaccatataggcgaagacaccagtcggcggcgacggaggcaagccggcggtgaagtcgtagacgcccaacagcggcggcataataggccagccgtgtagacggaggcaccaatcggcggcgacggaggcaggccggcggtgaagacgtagacgcccaacaacggtggtgtgaccaaccaaccatataggcgaagacaccagtcggtggcgacggaggcaggccggtcggtgaagacgtagacgcccaacaacggtggtgtgaccaaccaaccatataggcgaagacaccagtcggcggcggcggaggcaggccggcggtgaagtcgtagacgcccacagcggcggcataataggccagccgtgtagacggaggcaccaatcggcggcgacggaggcaggccggcggtgaagacgtagacgcccaacaacggtggtgtgaccaaccaaccatacaggcgaagacaccagtcggcggcgacggaggcaggccggcggtgaagtcgtagacgcccaacagcggcggcataataggccagccgtgtagacggaggcaccaatcggcggcgacggaggcaggccggcggtgaagtcgttgttgttatcagcaatggcggtggcgaagacaagccggcagagtggactcgcggccgatcgaccggaaagctgagacgcctcgagtccatgaccagcatcaatcgcctcaatagtgccgcgtaattatatgcgaacaacaacaaaaaatagcaagagattaatctgagattaaaaatcaatatgataaataatgataaaaatcagattgagtttccccctgactgatttggatcaagtcagagaagaggagcttgaagaagtggtcgacgggaaggaagtgaaaactcccaaagcgaaaacgaagtcggcgactcatgaaattgattccatcgcgctcgttgataggaaactcgacgcaacccctacctggcgcgccaactatcgaaacatgatttcggcaataataaaagggggtagcgcacgagacctaaaagtggatggatgcagagacaaaggatttagacaggttcaggccctctcaatgagaggtaataccctactcctgtttggggatttgaatccgccgagtgtgtattgatctgacgatcaggttgtgtcatgcccctagagggggctccctgccctccttatataggttggggggcagggttacaagatagaaaccttaaccaatacggtatcggtttcctaaatctactttacaatcttatcaaaccaggactttaggccgttccataatatacagggaaacgtaatacccaagtcatgatctgttacatattccatagatataagttatcccctatgactagtcggataaccatgccgtattttttccaatgttacaattctctattttatatttgtattattgtctaaatcttatatttttcttatttctctgttttctcaatctaatatttaggaaatcacaagtggatgtcttaagaaaagaaactagcggccactagttagcaatatcagcaggctatatacatgccatgtcagatctttggatgagttggaagataaagaagaggagagagaatcagagtgggcgactaaattagcgtcgacagcaggcccacagtacgatgcagggtggaccccacctgcattctctcccaatcaatacatgaaagaaggagatggtgggcccaatatggtaaataaaataaagttcatctctagtacatggctgtggattagagctaatctattgtacacgccgcgagcgaatctcgtgcaaccccatgctaagcctacgtaactagcaataatcctacttcttactgtttttactgattcttaatagtaaaataataataataatatacaaattgatttgaaaattctaaaatataggttgaaagtttttagtttggatttgaaagttttaaatttcaactgaaagatttacatgagttgaaagtttttaaaatggttgaaagtttttagtttggaataggatgtttcaaaatttgagttgagagttttcacatataagttgaaagttttaaatttgaaatagaaagttttaaaatttataagttgaatgttttaataaactagaaaaatgcccgtgcgctgcaatgggtgaatgctattttaatattattattgttattgggtttagttagggtaaaattcactgtgggaattcgcttggattttgtttttagaaaatcatgaggtggaattaggagtccgtcatctcaagttagcatgagagttttttaaaagtaatttcttatacgactcctttgtattttcaaaagcaaacgtgtttaaaatccaacttttatacgactcctgtatttccaaaagcaaaagagcttaaaatctaacttttatacgacttttttttatttccaaaagcaaacaagcttaaaatataactcaaacacggatatgtacttccaaaagcaatcaatcttaaaacctacttaaacacggacgacgtaccaaaataccggcaaaaacatatttaatatttataatagtagagaagagatgagttaaaagtttccaaaattatgataaagtgtaaaatttgaggggaaagttttaaattttgtgttaaaattttttaaatttgagttataaattttaaattaaaaatagaaacgtacacgtgcgccagcaacaagctagcgcatgcgcgaggtagcgatctcgaagaaacttgccgatgacatcatttcgtttgctgtgggcccaaggcgattgtgagccgaaagccaaaagcccaaaaacaaccgtgggcacaaaagccgagcccatataaatatggaaaaagtacaccggaggtccctcatcttgtcactgaattacaaaatcatccctcaacccaaaatccagatatataacatctcttaacttacaaaaccgagtcactttaggtctttaggtgattttgaacccggttttatcttacgtggcaactgagtcagcgtgggacccacatgggttccacatgtcaatgactactttctttcccctctctctacctctttcctctctctcttcttctctacctctcttcctctctctcttcttggcaaccggccatgcgggaggactgaggagcgcggctgacgacgggcggggagaggagcggaggtggagacggatgcggcggggcgccaccggcgatggcctcgccgtcgcctcgctctccgctctgcttgacgagaagcaactccagcgctcgcccaaacccaccctcccgagtacgctgtccggcttgaagttcctcgtcgccgccctgagctctgcgaacatgaagattcagaggttggggacctccaggatcctcccctccggctccgggtagagcgccccggcgacgccgatgactgcgccgcctgctgctcccagggcatattgttgctgctactgctgctgcttggtgatgcggctcatggacgagctcgaccttccgacggtgatgcccggtggcgctgcttatggaagcaaacacgttgtgtagtgccatgatgggactacgcctatttgctggagcggctgcttctgctgcgaggtttgaaatttgattaaaatatgttgtcaaagaaccaagggagaagaaatgccacaagcatttgaataccttgccagcgtccatggtggccttatgttggtgccctcacggtcgcagcagcttcagcctcctcggagccgaaacagtcccccatgggatcagctgggagcgaagctcgatcaaatcgagttgattattgttcgttacctcgctgcgtactgaaacttggcaagtaacacgcgagacgctagttgattctttcttgtcaatcagtagcagctctcgactcagcatcccgccaatgagagccgccgccgccgggttgggagcggtggagggcgcagcacccagggggacgcgtggccgagcgctggagtcgcctcccgtcaagcagagggagagcgaggcgacggcgagggcgaggccgtcgcctcgcccttgccggtggcaccgccgccgcgtccatctccccctccgctcctctccccgcccgtcgtcagccgcgctcctcagtccttccgcgcggccggttgccaagaagagagaggaagagaggtagagagagaaaaggaagtagtcattgacacgtgggtcccacgtgggccccacgctgactcatctgccacgtatgacaaaaccggggcaaaaaccgcctagggacctagagtgaccaggttttataagttaagggatgttatatatctggtttttaggttgagggatgattttataatttggtgataagatgagggacctctggtgtactttttcctataaatattgtgggtgcagacccaaacattaaagcccaaaactaaaagattgacggcccaagaactagcccagagaaaaattatggcccaaggcccacttctcatggccgctcatatctcctcgaccatcatctcccacctctctcatcggagctcctctcctcgcctccaatggcgctgctcttcccaccaccaccccacgcgctctcccccaaaccccccttcccctccactctccgctccacgaggtcactgcgtctccgccgcgccaccgccgccgccgccgccgccggggccggagtctcctcctcttccccctcgacctcctcgccggagaaggccccggcgctggacgtcgccagcgggaagaggggtggtaagaagaggaggtccctgaagccgagcttcgagaagcaggccatccgccgctggtccgcgagggcgccgtcccagcgcgcctccttcccctggcagcagcagcagcagcagcagcagccgggcggaggtgagggtgaggccgcgggcgatcaggaatccggttggagtgggagctccacgctgcagtccatcgtggattacttcgacttcgactacgattcctcggatggtgatggcgatggcgatggcgatggcgtcgtggtcggcggcgaagcggccgaggcccaggaggatgggccgcgtcccgagccgagcttccttctcgggagccggccggtgtcagcgccgtggatgcacggggaagaagagcccatgacgaaccaattggtttctgacgaggaagggttggatggggatggtgcttccgaggataagatgggtttagttgatggagacggagacgaagacgaagatttggggagtgaggaggagacgctaagtgagagctcagacggggaattctccgaggattatgcagcaccggccgcaaattcttcttctatgatggattcggtactggaccatgtttcttcaggtggtgggttttatagaggtactaggcggagtagcgtaaattcaattgttaacacaatgaggaattcgatggaggaaagtagtagaaatgctgcgattgagtgtcccgagaccgaggattttgtccagaagctcggtcctgtgctcctcccatgggagagggagggggatgtcgataggccgagaaagcgcagcaacacggagctggctgagaggactatcccagagcacgagctgcggaggcttagagatgtggcattgaggatgaaggagaggatgagggttggtccaggaggggtcactcagctcattgtggagagcattcatcagaaatggagggtggaagaggtggtcaagctgagatttgaaggacctccaagcctgaacatgaagagaactcatgatatactagaggtgcggttaccttttgctgtctcatgttttgttcattcacaattttttcgtggcgtgaaatctgatagttactttgttatcttgctcttatctatcaggagaggactggaggaattgtaatatggaggtcagggagatcagttgttttatataggggaatgaactacaaccttcgatgtgtgcagtcgtatacacaaactacagaggttaattttgataaaagagttagtagtaatagtgttgaacctatccatgttgaacataaatttcagaagtcaggtgcagatggactgaatcgctcagcatatattgtcaattcctctgaaaaacctacagagacatttgatatcgatagcttcttggatcagttgggaccgcggtataaagattggtctggtcgtggccctattcctgtggatgctgacttgcttcctggtgttgttcctggttacaagacaccatttagactacttccttacatggttaaaagtacccttcggaataaggaaatgacggctctgcgtagacttgcaaggcaaactgctcctcattttgctctaggtatttcagtgaacttatctgagtagcttttcatctaccgcatagtattcaatttgtcaattaatttccttcttttcacacttcatgcgtaccgtgtggtttagggagaaacagggaacaccaaggattagctactgctatcgttaaattgtgggagaaaagttctattgcaaagattgccatcaagaggggggttccaaatacatgcaatgacagaatggcagaagaaatcagggtaaaagatcatgataactattatcagtagtttgcctgtttgcattcctgtctccacagtgttatgtatgtgttgaatcaaataaacatggcattgcttgataagtagctattttgctgccttaattagttcttttgcttaattcacactttttgaatccttgaaatgtcaaatttctgagaaagctgagagtaacaatctgacaaagaacgcttaagaaatccactaatggactttgctttcttctcctctgcacttccatactaatttacctcttcgcctgcttgttcttgtgacgtattgaatgccttcttttcttgattcgatgcatgactgatggttaaccttgaaatatgatcattgtattagtttctcttgcacactgcagcctatgcatgttttgaatctgtgtaacggaacacttgcagaaattaacaggaggagtgcttctatcgaggaacaaggagtacattgtcttctacaggggcaatgatttcataacacctaaagtaaggcaagtcttggtggagaagcaagagcaagcaatcacttggcaggatgaggaagaattggctcggcttaaagcatcagcctcgatcagtgtcaaacccaaagtatttaaaaatcccccagttgctggcactctcgcggaaactagagaggcaaaatctcgatggggagattccattaatgctgagctcaggaaaaaggagaagaatcacatgattcttacaaaacatacctctcttttgaggaacttgaagagaaaattgattttggtatgctcttcaaaatgcatctctagaaacaaaagtttagtattttaatttcattactcatttgtaagtagcattttagctactttttcctccattgcacaaagatatctttgtgattatttgtgtaatatctactcctgtgcaggcaaaaacaaaggtcataaaagcagaaaaggccttggctaaagttcaagaatttctctctccagcagagcttccaactgatttggaaactgttacagatgaggaacgcttcttacttcgcagaattggcctgaaaatgaaggcctttctaatgcttggtacaactggcacttctcacttaacagttgtgatataaaatgcatgtggtgttttatgacttgtctatatgcattaaaattttctcaggaagacgagaagtttttgatggaacagtacagaacatgcacttgcattggaagcatcgagaattagtcaaggttcttgtaaaggggaagagctttccacaagtaaaacatattgcaatatctctggaagctgaaagtggaggagtgctcatttcagttgataagacgacaaaaggatatgcaatcattttgtaccggggtaagaactacaagacgccccaaattttgaagcctcgaaacctattgtcaaggagaaaagcattggcacggtctatagagctccaaaggcgggaggtaattcaagtgcaaaatctgattttctttttccattattttattttttgaactctatgtaagttgtatatgtatttaatcaattacatggtctaaaataatctagggattaaatcatcatatctcaaatctgcgagacaagatctggaagctgaagtctcaacttgtaagtcatttatacacgagttctctatgacagtatgacttatattttcttatagtagtaaacatttcttgatgatgttctcttcctatgtcatgaccatcaggtacgaatgcaagttgctggggaaaaaccagatgcggagttacttcaaacagttgaggctgatttgtctaaagatgacgataaaatagaggtaatcatgcatgaaaaatgctgagttcaaaagcactgctgcaaattacattttgttaatacacacttatagctcgcggtgtttggtggtgttgtgatcaccttcaaatgccggcacatcgctagtggttgacaggtagcttctgttgttgcaggatgaaggagaggaggcctacctgcaaacttacatcagtgaggatgaagaggaacctgaggatgatcagaatgaatatctctgaatcttaactggcgaaacttcggtgagtccgggagaaaagtcagtagtaaagcattgcatgttcatattgtgaaatttctgcagtgttactcaagaggcaggcagttttaagattcatctatggattattgccaacacaaattgacctgcaacagcattagtggcctttgtccattgcgagatcaacgacaaaggatgtagcttgagtgtgtgtggattgtggtgcatggtctgcagttgctgccattcctttttttttttttttttaccttggctacttccatagctccatccatgcctgatgccctgatggccttctacatcctgcagatttgaaaaggtttctgtcaacacacgatcaagttgtctgctgtgcagaagtttgcaaagtggcagtgtataaat

SEQ ID NO: 13521 - DNA, 2834 bp, Oryza sativa
ctgcagttgcctccattcccttttttttttttttttaccttggctacttccatagctccatccatgcctgatgccctgatggccttctacatcctgcagatttgaaaaggtttctgtcaacacacgatcaagttgtctgctgtgcagaagtttgcaaagtggcagtgtataaatcaggctcgtgtgagttcgtttcattttgcagaagctgtaattatatcatgccattttagaagaatcctccggtccacgttagattcatatttacaacatgaacatgtgaacctttcgttgatacggaattttgaacggttttctgcggaatctctcaaagctgagagcgcgattgctaatccgcgcgcgcacgtttccggcccgccgccggcgcgcgcctcccactcttttttttttcgtttttctttacccattttttttcgctttttccttttttctgattatttttttaatttttagcatgttttgagtttgaaagttttaaattttgagttgaaaattttcaaatttgaacttgaaagtttttaaatcttaacttgaaagttttcaaatctcgatttgaaagttttaaaaattttcaaatctggacttgaaagtttttgaatctcgagttgaaagttttcaaatctcaatttgaaagttttcaaaatttcaaatctggactgaaagttttcgaatatcgagttgaaagttttcaaatctcgatttgaaaattttcaaatctggacttgaaagttttcgaatctcgagttaaaagttttcaaatctcaaattgaaagttttcaaaattttcaaatctgtacttgaaagttttcgaatctcgacttgaaagttttcgaatttgagttgaaagttttcaaatctgagttgaaagtttttaaaatttgactttaaaatttaaatcgaaaattttcaaatctaacttaaaatttttttaatctgttagtaaaaaaaatctccataatctttcctaattactattattagtgttaagtatattaattaatagagatagttaagtatattaactaatagtgttaacagaggtagttaataggggaggagtgctcgctagcagcgagcacgcgctagctaggagtccccagctgagagcacacgcagctaccaaaaccaagaatttttttcggttttagattttttttaaatatttacataaataatctatcggccaaaaaaattacaaaaataaaccctgtcgcccacctctggggcggcaagctaacgtggcaaacgggggaggaacaggcgttgatggagggagggttttttgcaggaaaacccttgccgccctctggtggggcagcaaggggcccgaatgcaaaaaagccagtcggggctggccattctgcaggcggtcccttgccgccctctagccgggtggcaggcctcgctgcctataaaaggcttgccgcccagcccccagccctcattcctcccccctcaaatccagtgaaaaaaaaaagaagagaggggaggagaagagaagaaggggcgaagccctgtcggattcagacgccgatttcaggtaatattcatagatcctatatgtgactattgagataaatagtgtgtattttttaaaaatttgtttgaataaatgcattatatttttagggttttagttgtactaatctagaagtgcgtattgtagatatcggtaactacgtagatctactagtttggaatcaatacattaccgttgcattggcttacacaagaagatattacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttttataaaaggatggttaatgaggggcttgagagttgatccacagacaagtgacataacaatcaatgttatagtaagtcgggcaactgagggtttttattgggaattaatgccaattcaaaactctcgagtgtggagatggtatttggaaaatgcattgcaacgcggtggcctctagctttggttctgtttgttcacccgaaggatccaggtgtgcagatgaacatggatgatggcgagggaccaagtgctgaagtaaatgagacttctgtggaggaggtcaatgcacgagaggacgggggcgtagtagctccactgggcattcaaccaggtggagtggccgacgagggggaggctgtcggtgccattgtggatgaaatggagagggaggattctgacaatgagcgtgtagaggaaggtgattcgtcagacgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagatggttgtccctggagagtgcacgcgtataaggggaaatggaaggattattggacagtgtcagtcattaccaagcatacatgttttctacctggtgttcagaaataccacaggaacattacatgtgcatttgttgcatgtgagatgtatgtgcatgtcatcgataatctcacatatgaaccaaggtcaataatccgacacatcgaagag

SEQ ID NO: 13522 - DNA, 1111 bp, Oryza sativa
gcgtagggatgaatggcaagtatcaggttttgtgttgtttatcacgggctgaaatcctgaatgctcttgttggaattttgtgcagagtggagcttggaataggcagctttctactgtgaatcaaaagcgtgatgaacaaagataaagttcatgacaaggagactcacagaacgagcaacgatataagtcataaaacatctgtggacaaggttaaggcccccaatctgtttgaacgagccaaggaagaggttgaggctctcgttggagctgttcatgataagatggagcacaattccagtccccatggaaataatgctggtaatttgtttgaaccaacggtgttttccgtaatttaatttctgtgaagatgctgagcaccttttattatccccagaaagaagagtaggattttaaactatctggcagaaaagatggaaaaaaggataggatagaggagcatcggctaggcccaaagcacccagagagacaattcacatctaagcttaatgttaccatcagtccatcacagtatcgcacgatcctttgcctcatcacctaagtcacgaccttagctgcttaacaacaggaccaaaaaacacaaagctcatataagataaacgcacaagcttaagctcttcaatgcctaataggccgacacgtagttcttcagtaattatgtcctacttccttcgttttacaatgtaagtcattctagcattttctatattcatgttgatgttaatgaatctggatagatatatatgtctagattcattaatatcaatatgaatgtgggaaatgctagaatgacttacattgtgaaacggagggagtacaaaatctgatctagcaattatgcgctacagcatactcaattgacaattgctaaattttagcttgatgttttttaccttgtgtattgagttccttgtataatatgatgggtcattaatcatgcattgggcatatatcagaatttatttctctttgttgaaaaagtctggttttctgtaacaagatttttctgagataacacaaacacaagttcaagaatattagcatcttcatttttctcccttttattgcaaaaacatccttttcagtaattgtt

SEQ ID NO: 13523 - DNA, 5331 bp, Oryza sativa
  unsure (1)..(5331): unsure at all n locations
ccctcgaataattatcgcaacattacgcgaagcaacaactcaaatagatatttcatattattttatcaatgaataagatctcgtcgttggcttctcatcacaaaaaaaataaatataaatttattagaatattgttttaacctattttttaaaactttataacagttattttatttgtctgtaccctcaaataattattacaatactgtacaaaaacaaatcaaatagggatttcatattatattttttaataatgaaagatctggccgttggtttctgatctaaaggcccagcccaaccagccgctgtctcttccccccactcctcgactcgctctcgcttccgaagcagcggcggcggcggcggcgaggcgagatggcggcggcggcgttggcggggatggacgcgcgggggtgggacgagcggcgtacaggcggggcatcctgcgggagcgggacctctcctgccgcaccctcttccgcgccgtcttcttcgaccaccacgacgacgaccccgacgtcctcctcgccgccgcctccagcgacggctccctcgcctccttctccctctcctcctgcatctcctcctcctcctcccatcccaccccacaggttcgttcgttccccacacccgctccatgtgccgcgtcctcgtgcgcagctaaggtgttcgatcttttgttttgatttgattggattcagacccacccggatgccgcggtctctctggttgatcccgtctgcatcgtccaagcgcacagtggcccggcctacgacgtcaggttctacccggattcgcagcagccgctgctcttcaggtgaattgctgtgctgctgctcgtcttctcggtggccgtttttgttcaggtgacatggcatgacatttggcgacgtgatccgttggttgtggcagcggcggggatgacgggcgccttcggggatggagatggcacgagatgcagagctgccttgtgccgctatctctgcaaggtgctgcaaaagaaccctcacttcttactaggattgacttggttaattagtttggtgtgtgctttacctagaagttctacctgtacttgcttgcgcacaccccacaaagaaaaggctaaatttttaacaaagatgtaaaacattttgcaagtcccatttccttttctagtgctctagtgcatgttttttttgtggggctaatgcatgttgtttaataggttactttgtcattgcttttctttccaggggatcatttggagccagtacttgatttggtgaaccctcagcatgagtaagtattctgtgaaaaaggacatacatctgataatcatttgacatatcgtttattctagagaaatatgcacttgcactctcatcctccatcttttcagagcttttgttttcgattttgtaggggtccttggggtgctcgctctccaatacctgaaaacaacgccattgcgattaacaaacaggtcaacaccagaaagtctgcattttcacttcatccaaagaagcaaaataatctcttgtgtgcatttttgttcatcgtgtatattatatagaaatgatgcatattgttacttgcttaaaaaaagatatcttattcagttattctttctcatcattcttcttcgcaacaggaaggatctgtttatgcagcggccggggatgcatgtgcttattgctgggatgtggtatgtattttcttgaggtaaatgcaatatatagaagtcctgagctacatggaaggaactacagatttcttatgattcatgtggcacaggcttccataattttctattttctgtgtgcctgcttgagaaaatatctgatagtaggttttacaatgtcttgttctttcaggagagtggtaaatgtaaaatgaccttcaagggacatactgactatttgcacagcattgcagtccgcgaagcgaaccgccaggttggtttgttattattgtactgatgtagtccaataccattttcccatagatgtcttgccttcattttgtagtaacttttagttaatagagcctttcctttttcaggtagttacaggatcagaggatggcacagcccgtatctggggtgagcagtgcttttgataggataattttgtcttgtacttgaagtgtgccttctcatgttcatcctgttctaactggtcattttgtatatctgctcgttgattcaagcaaagaaaaagcaccaactagctatttgtctttttgtactctttaattcacatctggtgatctggtcacaggtcacatcatattcacaaaatttatcctctctcttatgagtttaccttcagacaggtttagaaagatttggcactacatggaaatccataaaaaggcattctcttatttctgctctttgtgcactgcagattgcagaagtggaaagtgcactcaggttatacgtccggtgaaaaacaagatttttgaggggtcatgggtcagttgtgttgccattgatgcaagtgaaagctggctggtaggatgcacttcaagctgatataacaatgtgttatgcatcatgtattttacagttattattatcttggtcctatttttcccaggcttgtggtacttctagtggtatatcagtttggagccttctttcaaatgagtgcatctttaatgtggattgccatgctcctgttcaagatttgctgtttgacagaaaccaagtaagtctatctattcgtcatgttcaagctagagtttagcaaaccagtaaaattgcccatggttagaaatggctcatcttgtatttcaaagatgggctggcaaaaaatttaggacggatcattccattctttagtctttgtgagtttaacaaatgctatacctgtagtaaattagtgttcccctagtcaattatttccattaacaagtcatatgatagttccacaagtgcatgatttatctatttaaccaatgccctttctaaatttttttatgcataattgtttgccaaatgaaagtttgcataattgtgtggatatgaaattattatcagataatctctcagatatgcacagaaaatgcaataaattatttcctgatgatttatgacatggttgccaaaatttgaagctttgtgatgttattgttggagagaaacagaataaaatcaaaagcttttgcttccaaacaaatataagagtgactcttcagccaactagttattattcctgcaaggaaagctttttattattgtctgctcacatctattagagatttaccaaagcaatgttgagtctggcgatagacaatagagcagcacgaaggatgcattgtttcccaactcttgtggtttaggaattatcaactgtttgttttcttatactccattttcaccattcagatcttagcagtcggtgctgaacctctgctctctcgtttctctatcaatgggactcttctttcacaaatcaagtgtgctcctcactcagcattttctgtctccatacattcttcaggggtatgtctgtctgtctcttgattctcattttgaaatgacttgggtatctgtttcaccctacttctggagtctggccgatttgtcctgagtttactacctttgttgtgcagatggcagctgttgctggatatggaggccttgtggatgtaatatcacaatttgggagtcatttgtgcacttttggctgccggagcctggataagtaagatctattggaacaattagctaagcactcttaatagtgtaaagaactggaaaaacactgccaagatctaattaagtactactactagtaatcatacacttgggagctgttcagctgtaacactagttcatctctgtgctaacttatgtaattcacagttgtgccgttgctgctccgatagagatgactctagatcccttaagtttattgctgttacaatttccctaatgaattcccttgtacggattacctgctggttgctgcaacactgctctctttgctgactttctccctccatcccataaaatacaaactcaggataggattttaagatgagatgtgacacattttaatattcttcagattattcttagatagcctatccaaactcaggtttgtctttttatgggacaaaaggagtacatcagctttcctttggcatcacgtggcacttgtttctctttattaggcaatatttatcacagctccatatctagatttaaaatttatatgttactacctccgtcccctaatataagggatattcactattttttttttaacgtttgaccactcgtcttattcaaaaaatttgtgcaaatataaaaaacgaaaagttgtgcttaaagtactttggataataatgtaagtcaaataaaataaataataattccaattttttttttaataaaacgaatggtcaaacaatgcaagcaaaatgtctaaatcccttatattaggagacggagggagtaaattataatcacttaaaaattatatttcatccaaaaatggaataaatatttcattcagaagtaatcaatgtaattgccgattgaaaaatctatggatttgtggaggtggaaatatccaactccaaaaaaaaaaaaaaccttagatccaaagttatgctagctctaaaacatcttagatcggaagctatgccaaaaatcacagtaacctttagaagttttgatgcataattgatagcaccttcgaagctgtaagcctgtaataacaaattcttttaggagttaccaagaatgagtttatcttatgtctgagatatctggactgcaaaattcagtagcaaatgcacgagctgacagctgggcatattgacttctatcccaaaggataacagatcacattcttgctgattacagcacttggaaagctgaccaagatttgacaagaaaaaagaccaatttggcaaatggaaattcatagtgtcacaagcgtgcctaggcctttataatacaaacaagagctgtctaaaccagcaactaaaaatacaagtttttattatacaaacaagagctggctactccagcaactgaaaatacaagttttatacttaatacattgttgatgtcgacggatttttttccctagttccaccaccactgaccccatatatgtacaacattcgggcaaacgcatgcaacatacagaagcacccagtttctgaaaatatatacagcaaattcatcctatatgtacatgaagatatgaaaatatcatcagcaaggcttccaaaccaacaacagaacagatatgaatgagctccaagaatnnnnnnnnnnnnnnnnnnnnnnnnnnnnnnnnnnnnnnnnnnnnnnnnnnnnnnnnnnnn

SEQ ID NO: 13524 - DNA, 6925 bp, Oryza sativa
ccgcaaacacgacagccttgcgcaagtggctgtccttgttctgcttccttcctttcttccttgttccatccttcctttcttgccctggcgtcactttttctttgagcatgatccaggggagttcagggaacatggctgctatctggtgttccttcaacctgagctggaggcatatgttctccagctgcagcattttcagccattgcttgcacgcaaagagatgagaggcctgacggaataatagcttgatgacatggtctttctcatcataagctttcttggcagccatctcagcctccctcgcgcgtgtttgtgaatggcggagtgcatccagcaactgggtcctctcagcggcactccgatatgtcggcttgctgcctggtgtgcgatcatcagaactacaagaatcctgtgtacccctgcatccgaatgcgattatgtcaatatatggaccataaccaggaagaagcttggacaaacaaattggtatctgggactttccagggatgagaaataacacgacatggaaggcatgcatgactaccattacttcaattttggatcataacaaggaatcaaaagattcacacaatttcatacatacaaaatcggaataaaatttgtgtttgctcattttcagaactagtttcacacatacaaaattggaataacatttgtgtttgttcattttcagaactagttcgtaatgtgatacgtgaaaataataagccataagatttatccttgtaaagcaaaacatcggtattctaaaagtgggtctactgggctgttcacaaggaacaagcacacctacttgttatcacgtaatcacctgtttggccctctaaattggccagttagaccggatttccctaggtttgggaccaaacaaaaagccacataccactttcttaaaataactagtatcattaagaatttaagacggcgtgaatccaagaaggaagacaccggcaaatcatagtgaattccagcgattgtgaaagaatataacatacccacgtgcatcatttctttgatgttgccagcctccaccatcagatgaatttgtctcattggtgcttgaaatgctatagctgcacagcatagtgtcatactgcactggaggtgattctttgccagtataaggtccataatcatccttgttttcatggttgttcaattttgaaccatgagcacgttgggtgggtcttggcagctcatttttgcctacgttgtgcatttcactttctgcaactacggaagccaaaccatccgcttcagctacctgccaccatggccgagacttcctgttttcttgccaaggtgcatccatctcatagcatgccgtctgtggtttctttggatacaaaggatcaaaagttttgaagtccatatgttctttgtcctcatgaagataggtggcacttcccctgcatttgagggtcatttcagaataggcaggaagactcttgagctcttcaaaacctgtctcatatgtttgtttcataaaagctgttgaaactatccatgggggctcaaaaggatcagctgttttcttaggattgatgtcctcaagtttggacactggtgcgaaactttcgactttctttacatcaacttccccacacatataattcaggtcctcgctagcaagcacattctggcacccaaaattgggctgcaactgaagccaccattgggtatcttttggcagattggagttcattgcattccagtttaaaggcataaagttggggatatggcagtcttgcggatttgtttgatttccattgttggtctcatgctgttgcccagatggcgggcagcaaccgagtttcggagctctctttgcgtcctcttgaacccggcagcggttagcagcacgctgccaagcagcccttgtttcagcagctgccattactcacatgctaagaaactgcaccctgcacatcagaaaaattgtttgtcaatgtcctcagaaaaagttgttcatcagcactacttccatagaagctctaaagaaaacaaatgatagtattaacagcctattttacaatgttttcatgacagaaagtgcatgcatcatccacgctagaaaatttgaagaccgatccatcaagattcatgaactgtttgctcaaaaagaatctacaaccataaaatgaatacggacaagcacaataacgagaagacatgatgctcagatatgcaagcaacgtcgaaataaatgaaatgaaatgaaatgcccatggcaaagaaaacaatcactactaattacagccagatttgaggcggtaaacgattatccaattctccgacagatttcactgatttgaggtaagggacgaatcacagatgcagaaatacagaaacaggtcgaattcttcgaactaggaacatttcaaagtacttgactggaccaaatgggcacgcaaaatgaaaactgaacccgagatgctcgagcaagtcagacaaaatcgaaagattccgaatctccgattctcctcgctccctcctcccgatgatccgattctctaaaattttacaggtgaaggcaaaagccacctcacctggatcagcaaaagactcggaagcttgaacaaggctgcaagatcaaggcaggttcttggacgaagaggctccaacccgacgacgatgacgatgactccttcggatcaccaccatctcacggccggatctcgcagctccctcgccgtcgccgctgacagactgaatctagaaaagcgaacccctaaagcggacaagaagaacacggagaagagaggaagccaagggagaggagctaataaagaagggatctttgctcctctccggataatgacgtgaaggcaaagcaagcagcaatcctaccagaagaaacaatccatccagcaataataatagtagtaataaagatttcaattactcccaaaatcaaaactttttataaattggcaagaaagaccaattaagctgccgtttctgcgctgctcaccgcccctgaaagcgccattttttctcccacaaagattggatttttggtccggttcttcctctcccaactcccagattttttatttttgttcttctcctcgcgtgtcatctcattttctcactcatttttcattttttttgttgggtctttagggggagaggttgtccaggaaagggggcaaagatccgtgccgtcccgtggcttcctggatcaatttgggtgatgagaatctgagatatccacatccatttatgggagtgacgtgggcttctctcccgctggtgaggtggggacaggtgtttccttgctgatgcagccacctcaacccccactgatgagtgttgtggcaaagcagggagccactggaatttatttctcgaacccctctctctctgccgcctaaagcaatggaagtaagaactaagaagaaaagcaaatggttcataggaaaaagaaagggagtccctgtatgctgtgatgaagtgctgagtgactagtcaacttttttttaaagagtacagtaagaaccaaaagagtacggtttgagttttttttttttttttttttgcgggggagtacggtttgagtctatataaggttattcaaatttctcaatttaactttgagagtgaactttagaataaagttatgaagcggcttgaatctcgatccatctctttagttatattttaaatcattttaacccattccatttttttttaagttgagttacaacagtttaattgggttccagcattaaaagaggtggatatcaaataagcccaaaacaaattgtaatatgcattgccaatacatcataagtctgttagtgataagtcataattttaaaatcgggacactaattttacattaagtaattttatgagatattgcaaatttatagtgaaatttaattagttcgcgtgcactatttaaacttacggcacaaccctagtgccctccttccaatccaaaaatgttagtataatctgttagtgggttgaccagatatgtcactggctaattgggttgtactagttaaattaaaggtttgatacatagaaccaacatcactaatctattttttcttaatacaaacctttgatggtttatatatttcaaaccatgtattatttataaattccatttaaaccatcttactctacttaaaaggtatgataaaacgactttaatattaattatttttaaatatttaatagtaatttgctcacattataaaagtaactcagttgagaagtaacttttcataaaataatgctaaagtaattacatagggataagttggaaataagaaactatatgaagtaaattcataagtaaaatgtagagaatattcataattatatacatggattttcttatttgaagtaatcactatattatttttcttgatataagaagtaacttttcacgatattaaaaggaacgatattgttatagggaaataactataaaaaatagaataactctcaatgatataagaggcaactacactactaggaaagtactatattccaaaatatgaagcacaactatcactaacacaaagaccaaaaaaataatttaatcacttcctcggttagatcacattgatgcatgcaagtaatgtgaggggggttgatgttagaggatttaaaacagagcaaatttggagtacgaggagcaaatttagagtacgaggtgctagttaatgtatacatgcatgcacgcattatatcatgagacagagaaaaaaagtggttgagacatagagggagtaactcataaaaattaaaaatatatagtaataatttcttcacggtattaaaagtcataaaaatctacgatgcctcatgtttacgtttacgtggcgttcctctttttttctttattgtgtgtggtttgggcttatgcatgagaggtgagcgcataacagaccttttctataccatgattaagcatttgggaagttggctggctggctggccaagtagcacctttggatgttgccaagtgctacattttgaattgaatgcaaacttgagagcgagcccaattgaccaattggacaaaacgaaacgccaaagatagatgtgaacctgtagaaaacttgaggatcaaattagtatcacactcctatgtagattttcacaagaactaacctagaccatttttctcttcatctcttgtaaattcttttatagagcacatagtaaattcattcgaactttctcgattatttctatcaacggaacgaccccacatctctttcagctgtccaatccaatatggccacatgggttagacagctacgtcggtgaagtgcccaactttttcagcaatccggatgctgccatgatgcacgaacttacaattctactcccagttccagttgttggtgaagtgaagattttcagcgtacatcctggtccttcaggcttcaataaatcataaaaaagagcatggaacatgctttgtttgtagtttatcccacacaagaatctaattctcgatgttctctttacactacactactacagcaaccaccttttacacgttaccgtgccaaacaaaggcaaacgatatcttttttttaaaaaaaaaaggagaaaaagaaaaagaaaaggtaaaggaaagataaactgtacggtgtaatctttatctgcctaactcgtcttaactactactttactcccaaaactgctaccttaagctgaaccagatcctgtccactaatcaagaattagtctttttttacctgcccattgttttgttgcaacttacaacgcagagtgcgccttcacgccatccattctccttaagcagtgaacagattgagtttaagaaggccaaggaatccctcaacgaaaccctggatgcaaagcaaagcaaagcaaacttattaagatgcaatcttaagtaatgttaatgtttgcaagcaaaggaaaacccagtgacccacaggaatcaatgatttctctgcatataattgctttcatttttctttttgaaacttctgcacgttgatctttagtgaacttgacaaaataatcgttgtcttgagctgtgtgcgcggttgcttcctattcgaggttcaggcaaactggccaatgtttagattcaggcaaactggccaatggtttgactaaaccacatataactccggcagtggttggtccacgactaggacatgcccctctttccccaccataagcagcaatgacccagcttatagacttatagttatagctttataagttggggaaaaaggcagcaggtatttccgatgtgatgctgtgaatttatattgcataaataaatacattcttcaaagcgatagatgatgttatgtggttaacaacctaggttaagttattgttatccaatgctaccatgggatataaaatagagttgtaccttccgctagaagccaagatcaaacgaagggcaatcatcatctgttaacgtcaggtcgcctgcagataaaaaggggtaactgccacatttttcttccaccactctgtaatctgaactgagctgcaaatgcatatgtagtcaactagtcattgattagcatagtataatcaaacagtaggtgctagtactcacagcatgatcttatgatgcaaaacaatatgcagctgtggacagttataaaaaccaagtaatttgattgctctcatgaatctgaaactaccttaaattcacaaacggcagtctttttccaagaaaggttatataggatgcaaacctggtctgcagtttcacctttacccgatggagggtctgagctagtagtacacatagctggtgcagaatctgccatgtaagaccaatatatgtacgtttactcttggatggcaaaaaaccctaaaagtaaagcacaattttgctctaactccacaaaaaggaaattaattgaaacagctt

SEQ ID NO: 13525 - DNA, 5017 bp, Oryza sativa
gcagaatctgcgatgtgtagaccaatatatgtacgtttactcttggatggcaaaaaaccctaaaagtaaagcaccaattttgcttctaactccacaaaaagggaaattaattgaaacagcttccagtacctttagacttcagtttgatggttccttgttgaaccttgactctgctcttttgcattggatacatcagatgttggggtatccaccatgtccaattccagactatcaaaagttgttggtctcctataaagcataattcgagtaaacccattttcttattcgacttgtcatgttagatattactactttattgtccagaaggcaatcttctaggatataactgaagatatgcacacaaaatcttacatgactgtctgatgatcataagttggatgggcactccctgataactcactctgaagagtagtgcatattgagttccttggctgcagagtttctaaatttaaacaagccagcactgatgcacgaagttgtgtagcacaatgagacattcgagagttcatattaacaccaatagttctgtttgaactgttgatcactgaaatgttagaagctgtcttgctatgatccgcatcacgagctatatttgatccaaaggatgctgaggagtgtacttgtgaagctggaacactttgggagtatttaatttccgatgggggcctcatgatagacagtatttgggatgctaaaaaagcatagcagtgttattaatatgaagcacatgatcaataagtaagtagcgtaagtcattcaagttagccatgcaatccacaaaggatcactaacatacacttgtaaaaatgaatgaatttcttgaaagtactctactgcgtgaattgttattgtatgagcacaatgcaggaactctttgcattttatttttattttatgctcttcagattgccaaagagaaatatttgatgataaacaagaaagggtaaagcagaacgaccactatagaagcatacagaactgtttcagcttttatttaaatttgatgaagtcataaagaatacctcaaatatcccttgtaatatgtaaaatcacatatttaaatagctacttaccagtaaataaacctgaataattaagctacacattcgcaggaataagggacgaccattttccttatcagtaatacaactatgaaataattactgcaagatgcatgcaacagagacatatctaatctgaccataaagaatgtcctgaaagtacgctgctaaaaggcacctaccagaaagctattttgaaatccatatcatggagtttctgaaataatcaaccttaactgaaactagtcttaatgaacaaagccaatattggtcacaacaaccttagcattgcacaacagaagagagaacactgatagaatgtgccagtaaaagtttcacttgagcagacttgtcttgtattttattttctgaagtgcacatatatcaaaccaattatctatttaatacaataaataaaagcattacaaatttgttaaaacaatggctgattggattgtcttactttcggtgcttgggtatagggataatagtagccaggtgggtgcatagattacttatctactgttcgtgtagttgacatacatgaaggaaacatgcaacataatttttctgttgcgtggtcaaacctattcaaactagaaagtaggtaaagtatacataccagttctcaaagaatcatccgtgttaccaaaagttgttctgccagcctctctcctcaaaaaactagtggaagatcctgatttaccatcctgaagatctgcagaaaataaataaaacatgggcatttctggattagagtatgtcaacagcaggagggtaaaaaataggtgcaagtatgctacatcaagtctgtttaccacagaatcctagaggactgtccactctatcataacttgatttgccaacttcttgtggattatagcttgcagcatattctgttttatcttgcttattatctgcaaaaactggggaaagaaccagcactttaactatataaaaatataactactggaagacagatattgtgcataaagttaaacccaattaccattaaattgatgtggatcatccaagttactaaatgttgatttgccaaggtctgtcttgtagccaacagtaaaatctggtttagccttctgagtatctgcaaacaggcaaacagcagccttactacctaaagatacatagggagtagtaggacatagaactaagtgtttatgatatcatgttcaattaccatgaaattttagtgtatcaatcatgttagtatgtattgatttggcaaccgttggcctgttgaaaccattactaccttgtaatctactcttttgaaaatctgaaaatttgtagagacaaatgaattattacattaaagtatgtcataagcagcaaagtactaatgtgtggaactctgtgatcacatacgattgaacttcagtggactgacaaattttggagatttgtttctcccatctgtcctgtcagttgtattatgtccattcgctgatccagtttgactcaaaaccacctctgaagggtgtttagactctacatctgcacaccaattaatgcagtaaaataagatgtgatatagaaaaaaaaggaatatatgtttaaaaactacatttgaatattttcagagtatcgtaagctacagagtggacacaaatgaaaactaaccattcttttgttttcttatctcacaaacttcgataagataattaggcaactggtatttcatcccgctttcaacagattcacctgacttgagatatctgctgccaagcactccaccatcttcatccagcagaacaatctgaacatccaattattaaaaaactataacaccattctacaactagcaaaatatcacagcatttcattacatagcatctagcagtgacatcgaaaacagcaatcatatattgccaaaccttgcactagaaacttctcagtgttgatattaataagcatgaaactaacggattgaatgctaattgctaacctgctttgcatgcgaaccaacttgcacaagctttatcacaccatcatggtacttctttgccttctgtgttagttgggtggtatataaggcactccattctacaaagaatgtacattcactattagctttgaaatatatcaataatttacaatttgtacatatcgcaaatatctgacatatacagagagaacacatgaacctttaaattcagagtctgttgaacccataatgcttcctgagctaccagcatccacaactccaatctttgaagtttctggcttacttgaaccagcagtatttgatgatttactgtcctcaagatctatacttgtagagacaaacatttcgcactgtgatatgttggacaaggacaatcatagctaactgatgtttaacattaattcattaaatcaatcttaaaaaaaaacattatacccatgtaccatgaaatttctgtggactggtaaatttgagtggtttactcgttggacctgatcctgttttgttacttgtattctccccactccttggtcttgtttgcaccataggttcctccgaggaattagtttgtaaacctgcgtattggcaatgcagaaataacaacctttcaatatgtgggcaaaggaaaaaaggaactccaattaggcacagcaaaaatgttgacgtctcacaacgcacaggtccaaagattagatacagaaatcgtcaatatattggaaaatgcacaaaaccaacctttgtttacactcttcgcctcacaaatctcaataagatagttagggaaatgacatttcttcccagtttccaaagattcccctgacttgaggtacctggtggctagcactccgccctcttcatccagcaaaattatctggacgagtaatccaaaacaacatatcacatcatttttccccagtccactaccacagcattctaagataaactggtctcatgaggatcaagtaacctaccaccaatctatcatccattagctacccaacaatcagaatatgccgtataccaaattaccaactacgaaatgcgcattctgcttacctgcttcgcgtgcgaactgacctgcgcgagcctgacgacaccatcatggaacttcttcgccttctgagtcagctgggtggtgtacagtgcggtccactctgcaatcaaaagcacacccgattcattcatcagattacgcccattctgttcagcgatcaaacaccttgtgagcatacgcagagcaggcggctcgcaaaccttggaaactcgaacccacggcttcatccttgccaccgccaccgccaccccccttcgtgttagggtccgcgaacgcacggggaggccgcgagttcaccgcgctgggacgcgccctggcgcttgcgccgccgcggtggacgcctcgggaagcgggggatgcggcggcggaggaggaccccgacccggggtggggctcgggctcgccgacgtcgacgaggtggcgctggaacgcgagcgaggcgccggggaacacctcctcgccggtgcggagcgtcctgcactcgacggtgccgcccgcgtcgtcgaggaggacgaggttgacggaggcgcggtggaggacgatggcgccgtcctggtacgccttgcgcttctgcttcacgtgcttcgtgtacgtcgccgcccaccgccgcggctccgcctccgcctccgccgccatcggagacggcgagctcgatcgatgggtgggggaattgagttttcgcggagagaattcgaaaatggagagaagagggaagctgcaaaggggaaatttattgggcttgatttgggcctggaatggtaagcccggcccagtactaattctgggcccatctagatcgtgggccatacggaaatcacaggaattggttttgggagtttttttcgtttttagattttttttaatatttacagaaataatctatcaacagggtaccgagctcgaattcgccctata

SEQ ID NO: 13526 - DNA, 7219 bp, Oryza sativa
aattttggccgcccataaagagcttgcggccgtactttttgcatctggatcccttgccgccccaatagggacccagatgtaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttattcgacgtattagtactcggataatttatataggcctatcgcagtctgggtcgtagaaacattatatggacttaaacaaggagaattatgtaacatgaagaaatagtagtacaatttgaacatgatacaactatttacattgtggttaaatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctatattgctctagtaattcaagctgcacaacacggctaggtggagttagaacccttctggtgtctatccattctctgtattgacatctccttggtggttcctgggaggaaagaatagatgtaaagcaagcaaagttagtaaatgttgtgagaaaataaggattcatgtaatcaaaatattcttaccatgaaatcgtcgtcaagaatatttagacaaacaaagaaccttcgacccaatgttgtaggatttatggaacgaagaacctgacaacgatcaccacacctgcatcttggacgggcttcccatggagggagtgccgtagttagcacccgccagtcgctctgttgttcacgacattgtcgttcataagccgcttttctctgtaagtattgctcagtattttcggatgcgaaataccagcgaccttcttgtaaacaagtggttaggtcgagaatgggattttctgtatcgacccactcgatgtatgcgcaagccgtagtgcgggtctgccgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacaccccgacgtctagccattgacaaaagccggtaggatttgtaatgaagcaagtggggaagagagtactgaatgtgactgagttctgaaagattgtgaggcctcactcgttaaggcgacttatataggcgcaaaaaatcgagtgatacccctgacatgtgaacatggtggggtatggtgggtacgcctgattggcgccgaaagttacagcctgatcggcgccgaaagttacattggtcgtatgcgccaaatggcgggcaaatactcgtatcgcacgcgaataaaggaggctgcatcggtgcggcagaaagtagtcgtgcatgcgccgaaaggtatcgtgcacatataacaacaacgtagtcattacacaagtatacagtactggaaagtgaagcaaataaaaaaagagaagactgctctactggccctgccccgcgccgcgaccacgcttggtcctccgggcctgtgctcgcacgtggtcctgggagtaggtgaaacgatccggtggcacagcacgggtagcacgagtgtctggcggaggagaggcctgcgcctggtcctgcgtatgcaccggcggtgcgcctcccagctgtgaggggccgatgacgtcctctgtcgagcctgaagcgaagtcgaagtcagtgatgtcgaagagcaaggtggaaggcagcaagcggtccgataaggtcctagcatggtccagtggtggaccctgactcgacatgccgggtgcctgtgacgaagtcccggtgtactgccagaactgcactacgggtaccggaatccccgcgcctaaacgttggattgtcgttgaaccgtcaacgacgacccggttgatgtcgtcgacctgcatggttaatttgttcgtacatattcgtaaaatttcacgaagagaaagacatgaaaacataaaggaatgatgcgatgcaaggtactcacagcacgagcgaagtcctgggcgcagtgcctggaacgtcccaagctgagccccctgcaccgcagtaaggtgagaccggtgtcggtgatctatcgccgggtccaacaactgaggtgtatcctgacgtgccatctctgaaaaatatagtgtttcgtgttagacaattcaaaaagtagtaatataaaacaaaagataacttgcaaaattatgaaatattaataaaatcatgagaataattatgtacaacaagagtacaggctatttaaatatagcaaacgttactaatggtacataacgatgacgtgcaatttaacatatatgtagagttcgataatataacataacattacgtgtcgaagtccaacatacatcagcatacctaaagatgttaggcgccttagtctgatgttacatcacgagacctaaagacatgacatgccgaagtctgacattacacgacgaaacataaacacatcgataagttcgaaacgaattacaagcaaagccacatgccaacatagaacataagaactacaccacatagctagacgtggcacgacgacgcctaggacgtggtcgagtggaggtagtgccttcacccgtagggcgagctccatctgctgctgatcctgatagtcctgcctccgccgcacttggtttctccttgtctttaggacaatgcttgtaggtgtgcccatgttcatcgcatttgctgcaacgcttcaccctgccagcctccgactcgtccatatcgttgcggatgcgacgagtcctcctccttccagccttgcctcggagcttcgatggtcaggaatattgagtacttgtcacgcccataaatttagcccaaatttctagactattttgtgtattaaatccctgtccatgaccagccagggtacacaaaacgacaagtaatatacagttccaaacgtaaataaagcgtaaaatacttacagaagaagcccttagtcctcgcaccgaaacgaaagcagcagcagcggaaaaagacgatcctagcggggcttcagctccactccacaggcaaaactcaactggggtctgagccttggtcttctaacttcgtcttcagctcagaagcactacacttctgaaaagggggaataatagcaaagctgagtacaaccaccgtactcagcaagccacaccaacgatgcagacgtgcaaggggatacaaggatggtttgtggctatttgcataaaggcggttgcaaaacattttattgagcaaaacagtaaaactgttgagtaattaaagtaacattaaatctccactgatcaacgctacaccacgttgaacaggcccaaccaacccacctgaactacagtgtactgggtcgatttattaaggtaggactaatcacggtgaatctagtcgaccgcccataaccgcgggcacggctattcgaatagttttactctgatcagaggtgtacaactgtacccacaagacacagccccacgacatgtttccgtgcgccgatatgccaccacgacataccggaaagaggccgtgacaggacccttcgcataaccccctctaacagatcgcaccacaccttagggttcgcccccgtccccagcaggcaacgggcagcccccctttcgtgccgcagtgaatccggaagccgatcaaccggacaccccggccgacccaactccatcacgcccaccctcgcctgggtacgtcggctagagaaaagctacactacaagcccagccgttgcccacgctggcttgtggtaagtacgaggaattctttcagggtttcccgtgaaccggtccttaattgccatgggagcgactagcaaaaccatgcacccacagcccaccattcactcgcattttagttggataattacgaccatgaagcatggccagatgtctcaagcacgcagctcattctgatactaaaaaggtctaatactgtaattatcccatcatctgagctagtggtaattaagcatggctaagcatatagttctagctaggtcacataagtaacacgagctagtcgatttataacccaaacttgacaaaggacagatatcaagtaaacatggcacaagcgagcagataggtaaaaccctgaccccatgtaattagcaaaacatgcatatttatttgcaaacagtaaaacatttataaattgggatcaacatgctcaaggggaatgtgttacttgccttgcttcttcactttgatcttccgaactcttttcctcgcgaccgcggacttccgaaacgacggattctacacgctggcacgcaaaacgaggaaaaactctaataaaaaccaagaaaacagtacataaaaactaaacaaacatgtagagctcaattttagatgaattttgcaagttgaatggctcaattcggagttctaatgaattagatatgaattttagaagttttgagccatttaaatgaatttctagaattattaacgaattattgtgtaattattatttatttttacaaaggaaaagatcatcgctgacgtcagcaagggcggctggcgccgacatgtgggccccatcggtcagcgacacaagggcgtcggtccaccgtggaccgggaccaccgaggtggtccaccgccggtccacgggaaccgacggcccggatcggcccaaagccgatcgggcggccacgaggcggcgcagccgggacacgggcacgacacaaagccgacccgatcgaacgacggcgcgtggcggcgtgcggccagacgaccgccggcgacggcagcgcgtcgcgacagcgggcacgcggagcggcggaggaggggaaaaaggaggaggcggagggagagctcaccgagggctgcggcggcgagacaaccacagggaggcgaccggcggcggaaaggatggcggcggccggcgcgggaggcgacgggaacggcgttccgacgacgcccgaccacaacgaagccgcggccgagggccggcaagaccttgattttggaaaaccggctcccgtgaggttctggacggagtggagcggcagccagggtgcggtggagcgcggcgacgctgcgcggcgacggctagagcggcgagaggtggcggctggaggtggtatagttgaggcggctcgggtggacagtggaggtggaatttcggtgcgagattggggaaaagaggtgtaggacggggtggagctcggcgcggctatgccgacggtggcgacggcacggcacggcggtggctgaagcggcgagaagcggcggctggagccggcggatggcaatggcggctcgggttcgcggtgggaggatggctgcagcgatgggatggggaaacggagcggaggccggggtgcggcagggcgaggcgaagccgaaggaaccaacggcgtggcgtggcgtggcggtggctacggcgacggcggcgtgtagccggagttcgccggcgggcggcgtcgcgcggagcggcgtggggagcacgggagagggcacgaggagctcggggaggagggggaaacggaagaggagagcacgagggtgctttttataggctcggggaggaggaatcgtggccgggcgtggcggatttgaagcggcaacggccggcaacgtgggcgacatcgtgggcaaagtagggctcgatttgacgccaaaaattggggaaaagtgggggatttggtggaggaggtggtggggaaccgattttactcggtttgggcgcgagggcgcgagcgggagggcgccggatttggcgggacatgggcggcaaccgccggccatggcggcttcggcctgggaagccgaaggtaggaggagggcctgacgggtagggtcgccgggcccacctgtcggggaggaagagagggaggagaacctagggggttatttaaactttgcgtgaggggaaggggaaacgggccgacggcccaagagaggagaggggaggccggccgaggaagggagagaaggagggctttgggccgaaagtggcccaaagtgaaggaggggagatttttaattgtttttctttttatgtaattggttaaaatgaactttgtgcttttaaaattatttcttgagttccgaaaattcatggaaaaatccggagagtgttttagggcaaaaagaatattacaaaatattctcggccaatgatttttaagggaaaattttaattttcccaataattcacttgattaaattgattaacttttatttaatttttagaaaatgcattatttaatgatttttaatcccgaacgaaaatcggggcgttacagtacttcatcgttagtctctgtgaactccccagctatgccgaacccataaatctcgccgctccatgtatgatatattgcttgcttactgaagtactgtgacacatatactgcatctggtatgccacactctgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacctgtgctgttgggtactttgcactagagctcgatgtttcatggcctttttacgcaactcctctagctttttctgcatgaaagttccaaacaaaatgttgttgttcggcatagagggaagaactgcctagaaccgatccctaaaatacctgcatgtcccatgtaaaatgaactccactatgccaactagtggcagtccatggacaccgcgcatcacccagttgtaaacttctgccaaatttgttgtcattattccatatctagcaccacctgtgtcatacgccttggcccatttctcttttggttcatgcagaatccactgagaaaatttccgaatctccaatccagttcttctaaccaatgttggactatccattgggagaggtccaagagcttgaggagggtcagcaacggcggtcgatggag

SEQ ID NO: 13527 - DNA, 1262 bp, Oryza sativa
  unsure (1)..(1262): unsure at all n locations
nnnnnnnnnnnnnnnnnnnnnnnnnnnnnnnnnnnnnnnnnnnnnnnnnnnnnnnnnnntagtccgtcatctcaagttagcatgagagttttttaaaagtaatttcttatacgactcctttgtattttcaaaagcaaacgtgtttaaaatccaacttttatacgactcctgtatttccaaaagcaaaagagcttaaaatctaacttttatacgacttttttttatttccaaaagcaaacaagcttaaaatataactcaaacacggatatgtacttccaaaagcaatcaatcttaaaacctacttaaacacggacgacgtaccaaaataccggcaaaaacatatttaatatttataatagtagagaagagatgagttaaaagtttccaaaattatgataaagtgtaaaatttgaggggaaagttttaaattttgtgttaaaattttttaaatttgagttataaattttaaattaaaaatagaaacgtacacgtgcgccagcaacaagctagcgcatgcgcgaggtagcgatctcgaagaaacttgccgatgacatcatttcgtttgctgtgggcccaaggcgattgtgagccgaagccaaaagcccaaaaacaaccgtgggcacaaaagccgagcccatataaatatggaaaaagtacaccggaggtccctcatcttgtcactgaattacaaaatcatccctcaacccaaaatccagatatataacatctcttaacttacaaaaccgagtcactttaggtctttaggtgattttgaacccggttttatcttacgtggcaactgagtcagcgtgggacccacatgggtcccacatgtcaatgactactttctttcccctctctctacctctttcctctctctcttcttctctacctctcttcctctctctcttcttggcaaccggccatgcgggaggactgaggagcgcggctgacgacgggcggggagaggagcggaggtggagacggatgcggcggggcgccaccggcgatggcctcgccgtcgcctcgctctccgctctgcttgacgagaagcaactccagcgctcgcccaaacccaccctcgccgagtacgctgtccggcttgaagttcctcgtcgccgccctgagctctgcgaacatgaagattcacaggttggggacctccaggattcctcccctccggctcggggtagagggcccggggaaccccgatgactgcgccgcctgctgctcccaggggcatattgttgctgctactgctg

SEQ ID NO: 13528 - DNA, 632 bp, Oryza sativa
ttcaaatttgaacttgaaagtttttaaatcttaacttgaaagttttcaaatctcgatttgaaagttttaaaaattttcaaatctggacttgaaagtttttgaatctcgagttgaaagttttcaaatctcaatttgaaagttttcaaaatttcaaatctggactgaaagttttcgaatatcgagttgaaagttttcaaatctcgatttgaaaattttcaaatctggacttgaaagttttcgaatctcgagttaaaagttttcaaatctcaaattgaaagttttcaaaattttcaaatctgtacttgaaagttttcgaatctcgacttgaaagttttcgaatttgagttgaaagttttcaaatctgagttgaaagtttttaaaatttgactttaaaatttaaatcgaaaattttcaaatctaacttaaaatttttttaatctgttagtaaaaaaaatctccataatctttcctaattactattattagtgttaagtatattaattaatagagatagttaagtatattaactaatagtgttaacagaggtagttaataggggaggagtgctcgctagcagcgagcacgcgctagctaggagtccccagctgagagcacacgcagctaccaaaacc

SEQ ID NO: 13529 - DNA, 574 bp, Oryza sativa
tctgtaagtatttacgcttatttacgtttggaactgtatattacttgtcattttgtgaccctgcctggtcatggacagggatttaatacacaaaatagtctagaaatttgggctaaatttatgggcgtgacaagtactcaatattcctgaccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctagctatgtggtgtagttcttatgttctatgttggcatgtggctttgcttgtaattcgtttcgaacttatcgatgtgtttatgtttcgtcgtgtaatgtcagacttcggcatgtcatgtctttaggtctcgtgatgtaacatcagactaaggcgcctaacatct

SEQ ID NO: 13530 - DNA, 1378 bp, Oryza sativa
aaatcacagtaacctttagaagttttgatgcataattgatagcaccttcgaagctgtaagcctgtaataacaaattcttttaggagttaccaagaatgagtttatcttatgtctgagatatctggactgcaaaattcagtagcaaatgcacgagctgacagctgggcatattgacttctatcccaaaggataacagatcacattcttgctgattacagcacttggaaagctgaccaagatttgacaagaaaaaagaccaatttggcaaatggaaattcatagtgtcacaagcgtgcctaggcctttataatacaaacaagagctgtctaaaccagcaactaaaaatacaagtttttattatacaaacaagagctggctactccagcaactgaaaatacaagttttatacttaatacattgttgatgtcgacggatttttttccctagttccaccaccactgaccccatatatgtacaacattcgggcaaacgcatgcaacatacagaagcacccagtttctgaaaatatatacagcaaattcatcctatatgtacatgaagatatgaaaatatcatcagcaaggcttccaaaccaacaacagaacagatatgaatgagctccaagaatatgatcttcattcttctaacatcatgaagcacatacctgaagctttatctatcacctattcgatcgaagtgcgcgctaggcgttaatctagccatggtggtagatgataatggaacttacaacctgggcaagagccacccgagagtccagccgagaagcagtccagcaccaacgatgcctacaccgaccgcaaacacgacagccttgcgcaagtggctgtccttgttctgcttccttcctttcttccttgttccatccttcctttcttgccctggcgtcaccttttctttgagcatgatccaggggagttcagggaacatggctgctatctggtgttccttcaacctgagctggaggcatatgttctccagctgcagcattttcagccattgcttgcacgcaaagagatgagaggcctgacggaataatagcttgatgacatggtctttctcatcataagctttcttggcagccatctcagcctccctcgcgcgtgtttgtgaatggcggagtgcatccagcaactgggtcctctcagcggcactccgatatgtcggcttgctgcctggtgtgcgatcatcagaactacaagaatcctgtgtacccctgcatccgaatgcgattatgtcaatatatggaccataaccaggaagaagcttggacaaacaaattggtatctgggactttccagggatgagaaataacacgacatggaaggcatgcatgactaccattacttcaattttggat

SEQ ID NO: 13531 - DNA, 263 bp, Oryza sativa
catatgtactcctttgtattaccatcactaatctttaccagtaggcaggatggaacatgcagacggcgccccaaatgaccaaaatcaatcactactattcagtaatcaaactgaggtggtgtttagatccagggacttaactttagtccctgtctttagacactaatttagagtattaaatatagactacttacaaaactaattacataaataaaagctaattcacgagacaaatttttaagcctaattaatctataattaga

SEQ ID NO: 13532 - DNA, 668 bp, Oryza sativa
tgcctgcacaggagtagatattaccaaaataatcacaaagatatctttgtgcaatggaggaaaaagtagctaaaatgctacttacaaatgagtaatgaaattaaaatactaaacttttgtttctagagatgcattttgaagagcataccaaaatcaattttctcttcaagttcctcaaaagagaggtatgttttgtaagaatcatgtgattcttctcctttttcctgagctcagcattaatggaatctccccatcgagattttgcctctctagtttccgcgagagtgccagcaactgggggatttttaaatactttgggtttgacactgatcgaggctgatgctttaagccgagccaattcttcctcatcctgccaagtgattgcttgctcttgcttctccaccaagacttgccttactttaggtgttatgaaatcattgcccctgtagaagacaatgtactccttgttcctcgatagaagcactcctcctgttaatttctgcaagtgttccgttacacagattcaaaacatgcataggctgcagtgtgcaagagaaactaatacaatgatcatatttcaaggttaaccatcagtcatgcatcgaatcaagaaaagaaggcattcaatacgtcacaagaacaagcaggcgaagaggtaaattagtatg

SEQ ID NO: 13533 - DNA, 5454 bp, Oryza sativa
ctaagactcccggccgagtgattcatggattcacaggtcatagtaaaggtgaagctagccattctaaatccaaccaaatctcaacatatattaatgatgggctgtacatggtggtggattattggaaagaaggcccagagggctcgatggtctacaagtacaagttgcaaaggatcccaggtcaacccgagttagcattacacataatcaaggcaacgaggaagtccaaagttcgcgaaggtgtttgtgtgcctgatatatctcaaggaagggagaggattcccatacctgcgatcaacacaattgacgatacgcagccaacagcatttaagtacactacggaagtcatatatccacattcctatgcaaaagaacctctgaaaggctgtgattgcacgaatggttgctcagactctaatagatgtgcctgtgcagtgaagaatggaggtgaaatccctttcaattccaatggtgctattgttgaggcaaaacctctcgtatatgagtgtggcccatcatgcaggtatgacgtgcaaaagcttagcaatccaaaataataacaataactaaataggagtaacatttgcatcatattctgataataccaaagtagattcacagaaccaggaaatatttctcattgcttctgaaatttttaccctttcaacaagggctgacatttggttgcagattcatttgtcagtgaaacaccctgcaacacacaaggaacataaaattgttggtggcatagtttaaaatttctcataaaaccaaccattttcaccttaagtctgtaggttttcacaccagaactattcatttacagcagatcattaggttgaagggaataataaaatatattctcaatcagagagctagacatattatcataacagcgaaattggttcattcaccttaaattggtaggtttgcatatcagaactactcattcacattgcacaattaggttaatttgaaactacaagttctgttccgatgctttgagctaactaatgctaatatgcattgtttgcctgaagttaattgtttttcgcgccagaattattattagattaaacccaaattgtaaattctgtttgaaagctgtgaaataccaaatgctcaaaccaacatattgattacagaagcaaccaattcacgtcaagttaattagtttttacaatagaatttatttgtttgtattggaatatcaagttaaaccggaagtagaagttctgttctaaagcagggagctaatctagctaatctaatgttcaaaactatgtgcaggtgccctccaacatgccacaacagggtgagtcagcatggtatcaaaattccgctggaaatattcaagacggggaacaaaggttggggtgtaagatctctgagctctatctcttcaggcagtttcgtatgtgagtatgcaggtgaggtgctgcaagaaaatggagatgaacatgtagagactgatgagtacctttttgatattggtcatcactatcatgatgaagtttgggaggatcctaaatttgaaggcattttgggtctagaatcttctacgtccaagacaacggaggatactgaaggcagtaaaacaacggaggatactgaaggcagtactatcgatgcatcaaagtgcagcaatgttggaagattcatcaaccacagctgctcgcctaatctgtatgctcaaaatgttctctgggatcatgatgacatgaagaaaccgcacatcatgttctttgccaccgagaacataccgccgctgcaagagcttacttacgattacaattacggtaaagtcgaggataagaatggcaaggagaaggttaaaccttgcttctgtggttcgcctgattgctctcgcaggctgtactgagatgctgttggttgatgatgatgatggcgacaatggtgcccatttttcagtggaacactgttctgtcgtgctattgatactttgttttacctcctttatttttttactcgttcatcttgcacagttgcagtcatgggtagcatgtaatgttctcttctttgtctttatctcctgaattgaactcttaccgcatcttttggagcaccgactaaattgcaatggaattgatgttaggccattcccatcccaatgactaggatagtgtccatagtattaaataagttgcgacctaggataaaaaatgatatggcaagtgaataaatgaggaaagagaagaaaaccatgtcttgccacctaggatgaaaaatgatatggcaagtgaataaatgaggaaagagaaggaaaacatatcttgcatgagatatgatttctacacaacatcgaagacattatgtgagataagtagcactaaatttaagtatggaatagtgatgtttgcattggaagagtagtgactagtactagtttattgatttggagtttatggaaactatattagtgttttgggttgggaatggtcacaacccacaagttccttcactgctggcaaagaacggatataaatttatttcgtattattcgtctattatacagtacaatgcagactacccctatgagcatcttcgaagactggaccgattgacgaagtcaccacgactggaagagtagtgactagtaagtttacggaaactatatctagtgttttgggttgggaatggtcacaacccgcgtgactacccctatgagcatctctacccctatgagcatcttcgaagactggaccgattgacgaagtcaccacgactggaagagtagtgactagtaagtttatggaaactatatctaatgttttgggttgggaatggtcacaaccttcgaagactggaccgattgacgaagtcaccacgactggaagagtagtgactagtaagtttatggaaactatatctaatgttttgggttgggaatggtcacaacccatatctaatgttttgggttgggaatggtcacaacccgcaagttccttcactgctggcaaagaacggatgtactgtgactacccctatgagcatctcttcgctgtcgatgggtacgtcgtctaccactgaaagcacaacgccgttaaatcctggaaaattcgctcccatggggagtcgaagccaggacctcaggtactactgagcctcttgtaaccactaggttacaggccctttcgctcaatcactatatatttattcgtctgtcatattcaatctacagtttttttttcatttgaccaacattttctgtgttttgcaataggctagtcctgatttgataaaagcaatttatatatatctatatttttcacaaatgaatggtacgccatttataactgaccggatgaaaagacaaaaaaaaccaaaaaaaaaaagaagtaaactgtattcatgggacatcaacttgatatactgtgcaatttagttcacttacaaagtgagcgtgctaatgcaataattaacttagcaaatggatatcttgcaaggtgatatgaatgcaattcacgaatttactaagcgagtaacgaagcgagtaacgtactgggtgaatgacttgcaaggtgatatgtgagtgcaatttagtttaagaacttacaaagtgagcgtgctaatacaataacttagttcaagaacttacaaagtgagcgtgctaatataataacttagcatgtggatgacttgcaaggtgggtacaattttggtatattgatacaacaacatattgtgtcaacacacttgcgcagatttatataagcatacttattttttaaaatatagtcactaaaagtcaattagattttaccatgtagaaaattgtgtatttctgttgagatatgagaatgtgaagataaattctaaaccggtgatgcaaattgattcaattctttatagatttaatccaagattgtagggtaatatttgcatgattgttacgtcgcattgacaatttgacatcatgagaaaactcatctagcactcgttaaccaaacaacatgtaactagtcaagttgttacacacattttcttgtactggaatatactcactaacttattatacttagacattcaatttctaaatttttttaactaaattacacctacataccaagtttttttttaccaggagtgtactttttacttaaaaaaagaatgttataactttggactctcaactacgaaacctagctaactttgaaaaccactcacattttatcatgggtcttatgttattcgatgaactggcgtctacatggagtcaacgtgattgaagagtaacgacagcaaaatacaatgaataataaatgtcaatcttgttttttttcctttgtcttttcccctaaccctatatataatttatttaaaattgctaactatgatgccacatgctgccaagtcatccagagccatccaaatttaggtcgaagaagatatttttagaagttccttttatagtaacaacaattttaacttttaaggcccttcatttttttttagataatgttaaggcccttcatttgaaggaaaaacataaaaaaattgtagaattccaatcttatatgatttttcacatatatgaccgtttgaaacaaatgattgaaaattatagaatcctatgaaattcctaagtaatgttgctatagaacccctttgattccaagaaaagttgtaggaattttggaggatttcatttctaaaggatttcctagatagccctttgaatcaaatgaatagacacaattaaatcttaagaaatttatgtggaatgtctcatgttatgcaaatttttgaggagatttaacatagggtagaaattcatgaaaagtttcctttgaatctttatctcttctcaaattcctatatttttttcgcggtctaatcaaacggttattcatatggttatcttgtgttttgcaatcatatacttgcattcctgtcagatcttgtctttttcctatttctacgcttcaaaggaacacgtggcaagttttgggtgtttttaacatgagtccaacctactggaaagtttactttgaatgtatcttcgtcattcaattcaattcatacgggtttttccgcggtccatcaaacgttcatttatgtattttttccaatgttttacaattctctattttatatttgtattattgtctaaatcttatatttttcttatttctctgttttctcaatctaatatttaggaaatcacaagtggatgtcttaagaaaagaactagcggccactagttagcaatatcagcaggctatatacatgccatgtcagatctttggatgagttggaagataaagaagaggagagagaatcagagtgggactaaattagcgtcgacagcaggcgcacagtacgatgcagggtggaccccacctgcattctctcccaatcaatacatgaaaaaggagatggtgggcccaatatggtaaataaaataaagttcatctctagtacatggctgtg

SEQ ID NO: 13534 - DNA, 583 bp, Oryza sativa
atataaatatggaaaaagacacgggaggtccttaatctagtaaataaattaaaaaatcatccttgaacccaaaatccagatataaaacattttttaacttaaaaaaaagagtcactttaggtctttagggtgattttgaaccgggttttatcttaagtggaacctgagtcagcgtgggacccacatgggtcccacatgtcaatgactactttctttcccctctctaaacctctttcctctctctcttattctctacctctcttcctctctctcttcttggcaaccggccatgcgggaggactgaggagcgcggctgacgacgggcggggagaggagcggaggtggagacggatgcggcggggcgccaccggcgatggcctcgccgtcgcctcgctctccgctctgcttgacgagaagcaactccagcgctcgcccaaacccaccctcgccgagtacgctgtccggcttgaagttcctcgtcgccgccctgagctctgcgaacatgaagattcagaggttggggacctccaggatcctcccctccggctccgggtagagcggggtaccgagctcgaattcgcgc

SEQ ID NO: 13535 - DNA, 1239 bp, Oryza sativa
aaatttctactgcatgaaaggtataaacacaatcaaacacaccaccaaaatctccctgaattcatgccacaaacatcaatttctacagttcttggaaccattcatcatgcatggccgaactgaaatgatggcattacttaatctctgtgaaatgattttggttaatacacacaaacatacgaccaaaatctctctgaattcatgccagaaagttcagtttctacagttcttggaatcattcatgcatggctgcaatgatgtcgctacttaatatctgtgaagaatccttgttaatacaaacaaacatacgaccaaaatctctctgaattcatgccagaagcatcaaatttctgcagttcttggaacaattcatcgatcatgcatgactgacaactgaattcttgtttggatttggatggatgcaggggtgcagtcggtggagataaacaggaagcagtacaaggtgacggtgcaggggttcgtggagccgcacaaggtggtgaagcgggtgcaggcgacggggaagaaggcggagatctggccctacgtgccctacaccctcgtcgcccacccctacgccgccccggcctacgacaagagggctccccccggccacgtccgccgcgtcgacgccgtcatgcccgtcgccagctacggctccgccgccgctgccgccgcgccggaggagcgcctcacccccatgttcagcgacgagaaccccaacgcctgctccatcatgtgaattactgtaactgaatattagtgtaatctcttcagagttcagatgaatgtacgaaatgtatgtgcagatatgagagattgtactccctccatcccaaaatataaaagaatctagaatctggatagttgtctagattcatagtattagaaaatatcacatctagtcatagattcttatattttaagatgagagtagaaaggagggatttttctgcggttttggtctcttgtcgcatgtgcattggaatcttgcccatatagctttatttatactactccgtatatatagtttaattaggttggtagattagattacaatatacatatatatatggagttgtgtgctgttatgagacatatggttgagttaataaaatacatgatatgcttgtacttggtggtgcagctggatttcttctgtccggccattgccttttggtaatagcaattagaataagcaagttaattaaaggtacgtttgattggttggcggctaca

SEQ ID NO: 13536 - DNA, 880 bp, Oryza sativa
  unsure (1)..(880): unsure at all n locations
nnnnnnnnnnnnnnnnnnnnnnnnnnnnnnnnnnnnnnnnnnnnnnnnnnnnnnnnnnnncgtagacgcccaacagcggtggtgtgactaaaccaccctataggcggaggccccagtcggcggcaacggaggcaggccgcggcgaagtcgtagacgcccaacagcggcggcataataggccagccgtgtaggcgaggacaccagtcggcggcaacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataatagaccagccgtgtaggcggaggcaccactcggcggcgacggaggcaagccggcggtgaagtcgtagacgcccaacagcggcggcataataggccagccgtgtaggcggaggcaccactcggcggcgacggaggcaagccggcggtgaagtcgtagacgcccaacagcggcggcataataggccagccgtgtaggcggaggcaccaatcggcggcgacggaggcaggccggcggtgaagacgtagacgcccaacaacggcggcataatcaaccaaccatgtaggcgaagacaccagtcggcggcaacggaggcaagccggcggtgaagtcgtagacgcccaacagcggcggcataataggccagccgtgtaggcggaggcaccaatcggcggcgacggaggcaggccggcggtgaagacgtagacgcccaacaacggtggtgtgaccaaccaaccatataggcgaagacaccaatcggcggtgacggaagcaatccgggcgtgaagtcttatacgctcaacagcggc

SEQ ID NO: 13537 - DNA, 1575 bp, Oryza sativa
  unsure (1)..(1575): unsure at all n locations
nnnnnnnnnnnnnnnnnnnnnnnnnnnnnnnnnnnnnnnnnnnnnnnnnnnnnnnnnnnttggttttctgtctgggatgttctacagatgttggcctatcttcaagagagtcctggaggagcgccggagttgttggccctctctcctcgtttgtacctcggctgatgcttcttcaatataagtaagtatttgagattcccttctggtatttaattaacttacttaagtgagatgtattgtcatcgttgtgggttcgtcgcttaatatttatattgagtgctctaatactaagactctggataaagaagaaatttttttggccgaggctagagtagtaatcgataacgtagacgtggtgtttaggttagaggttgccttcgtttgttgtgtgctccatagaaagtgaggtaggcgacaggtggtgacagttcagtccgtccttcgtatccctccacgtatgggtacatcatagagctacaggtcgaactcagctggatagacatagctgggagagctggtatccgaagcaatcgatagagttttacctttaacttaagtatactccctccgccccaaaatttaagcatttttggattctgaaacggtctccgagatgctactttgaccaacaatatctataaaagtaagatattttaaataaaaagagttatatattatgatagtttttttaatgataaatctagtaacatcaattttgcacgattgatcttttttattttcttgttattactccctccattccataatacaaggcataactactttttaaagttgtttcataatataaggcgtgcatgcatgcatgtcattaactagcacatattttccattcaaatattattatttaaattctccaccatcaagatctctaattttattgggtgcatgtattatatttattagggtaatccaaactatgaggtgataataattatttcttggtctttgggttaagagtggttgtgccttatattttgaaatggaggaagtaatagtcaaagttgaaaatatttgacttctcactattctaaaaatgcttatattttgggacggagagagtagttaattaactcataggaatcctctagcctaagcctaccatttattgttgtccttagttgaatcctttttctagatgtacatacatatttcttgtgatttgatatccttaaaatactccaaagtgaagttctataatagtatccgtgcaattgcggacttatctgtgaccataacaaataccagcacgctccgacattgctagtgagtaatcccactacccacacaaaaccccgctgctagtttcatttcctatatggtagtataaattttcgaagagaaaatgaactagaagtgagataagcgggtaaaaaaatcatgcttgcccatcctacttgcatccctaaccccaagatactcgagctccatagattaatcactctcagcaaattgatcatgagttgataattagcagggttacaataatatgatataaatcttgcttagcacaacctttagtgaagcagatattgtatttaagttcaaatcatgtag

SEQ ID NO: 13538 - DNA, 2449 bp, Oryza sativa
  unsure (1)..(2449): unsure at all n locations
nnnnnnnnnnnnnnnnnnnnnnnnnnnnnnnnnnnnnnttccttctccacgagaccctattaagtattaatacacatcgaaagtttagtttagattttattaacgtggaaatcccataattttactacacacactgtctctaggatagtcatttatctatattctctcttttctagatatttagaatatagataaaggactatcctagctatattaagtgagagttagtggttaattggtggataagattgaataaaatttgagttgattaatgtggcaacctataatagctgtaaatccgcacagcctagcccggcagacccacttattacacatagcaatctacttatacttttgtgctcgtttcatgtaaaagggttaactcagaagttgtatggttagagcgacaaggttttataagttggttttactcttgctcaactcataagatagtaccaattaagtgtacatgacactcataggccacatcctaattgggcccagagtgtcacacaaatagtacaccaaaaatctcttatatcatcgataagataggagaggcaaagtcccttatatgacaggatgtaggtatatatttggttaaccaagaatactccaatcacaaaatctattgcactttaggatgtgtgtagtcaaacataaaaatcataaattactaacgatatatgcaaaactattgagacatgatatatatatgtaaaaaaatgaaattgattagtagattatattttcaataattagtcaacaagaatgcctttatgtagatatattttcaataattttccatagatctatttgaaggaaaagttatgctaaaattacatatgcagagatgattatgtcaatgtctcatatatatgacaagtaaaatagaatgggatcaaaggagtatattacctcagcaacaagagattgtagtgattttccaagcaaaccaaaaatatcatttacatctccactatatgggtcctcactctttcttccataaattgttagtaccatccgccccccatccactagttcctcgtggcgtaacttgaggaagagagagacgtccttgatgaactgctcttggaatagcttcaccacgtgtagtggggtagtcttggtgatgtagatgttttcttcatttagatatgatttttgcttcccattaagttgctccggcacctaaggaagtgatatagcacttgtaatatataacattatcatgacgattatgtgacttaataagagtggagaaaatacatgtttgaaacttgaaagagcattttgcattatactatcatcaacattacctacctgtgagcgccaatgaagggacaacgaggagtgaaataggtgaacagcttgaggaggaaaaagcctggtgtaataagatcctggtgccccatagatatggtatgcaggtagtatatctcctttgtgatttgatgcccccttgaatgtgaatgtgttcaatatccgaaagaggtggttgaagtcattacccggtaggtcatttaagaagaactgaagatccaccgtatcactttgtcccaaattgttttggtgcttcgtaaagatgtttatcacctcagagacaaaatgtaatgtattctgtcctgaagagcaaccaaggtcggcaacaaccatgatattagctagaagggttgcgtacagttctcggattgccttatcaaggacaaacttagcctcaatcatagctttcgcctagcaccatatatacatacatgtcaaaattcatttattgttataattaaacattggatctttagaaagaaaaggagaaggatagaccatctaatatctatgtataggaactcttttttttgttagatagcatagtactaggaaaatactttttacaggcagccggtaacccattttacatgcttttaaccaactgcctgtgataatagacctgtagaaaacaaatatttcctataggcagattacacaggcagttctttaagacagctgcatactataaaaatacttacatggcatatgtaggagagttatgacaaacgaaaataacgtctaattaatagtgtttgaaagaggtccgagcaactttctacaattaatctagacgctgatcagggagtagtgttccaaatggatctatatgtgcactccatgcatcatggatggtgcaacttagtttttccttaatcatggcatggtacaagtattgttgccaatgtgaattgatgctatctcattgcttattacttacatgcaagctgttgacacaccaagcgagggggagggggggggggggtaagggagggagagagatgggtagttacttgaaccctggaattcttggcgtagctaatttctccttcccctccaaccatgtgaaagtcatgttctacgttaacattcatcgtggttgtgtgttccaatgggaataatagct

SEQ ID NO: 13539 - DNA, 8251 bp, Oryza sativa
agaataagggtgctggccgaaaaaaggaggaatagtagattcgtcacaaggcgaggctggcgttgttcaaaggtcaccccctccccccagcagcagtggtggcttggcacagctataaacaaataaggaagaggcccatgatggcgaggatgccccttccccggtgtgctggtggttcctagcggcgaaaccgacgatgtggtggtgaggcgatggggtgccgtgatgaaggaggtgaggacattgatgtcggccgaggtcaacgcagatcgaggtgattgatgggttggggaggagcttgaggccgccggcgtcatgaagtctagatccaagtactgaagaggtggtggtgagatctaagttagggtggagcggtggcagtgagagctacccagcacacaacaaagaccacatttgtttaatatcatatagcaaattttgcctaggttttataaacttattgtcatgtaaatttttgaaatcaaagttctaaaggttaaacaaaaacattcattcgactttaacatagtcacactcatgttgttgttgccaaaatagcaccctcttaattttaacaccactttaggaaggagaatgaactgtattagctcgttcccctggtgtacccttttaattaacgaaaaatataattaatcattggcttgtataggggaaaaaatttaacagataatttaaattaggggtccgtcggtatgtgtagaacggttaacagtgagatcttcaccttactagttatgaaaaatatttggtgacatataagagaagagtgaaaatcttaacatcgcttaacaccacctcgtaacctctaaaaaaagttgtgtggcattgggatgaccaaggaagccgaaagaagagtaataaagttttctttgatgtgctaatggttagagtcttcgtcttctcatacgttaatttagagtggttacaaaagtgagtgcaagaatatcggtctacaaagaactatattagggaaaccattgaagattttgatgaagtagaaaagctaggaaaagggtttatatcggccgatccattagaggaaatagatataggtgatggaaatataccaaggccgacttttgtaaacaaaaacatgaaagccgattataaggttaacgattataaggttaagataatcgagttgcttaaagaatacattgatagctttgcatgggagtaccatgagatgccggaacttagccctgatcttgttgaacaatggctttcgataaaaccaggatttaggccttataagaaaccacctcgtcactttaatcctctattatatgatcgggtcaaggaagagatagaccggttattgaaggtggggtttattaggccatgtcggtatgcggagtgggtgtctagcattattccggttgataagaaggggagtggtatgattagagtgtgcatagattttagagatttgaaaaaacctactcctaaagatgaatattctatgcctatagctcacatgttttttttaccgtgcctatagcccacatgttgatcaatgattcttcaggacataaggtgattagtttcttggatggtaacgccggctacaatcaaatctttatggcggaagaggatatgttttgttttcgcccaatggtacatgctttgaaacatcggtttgtttggaatatttttgtacaaataatcaagccgaatatgatgctttattattcatcaaaaaggcagggggcatgcgtttacacctgaatttggcacctaggttcaaaacaaggaaaattgccaagatttgagaaagttgtcggtttcctctactaggccggtctgaccgccatatatgggccggtctaacctgcagcatttggccggtcgtaccggcagagtccgagaccgactctgttttcgtcgagtcttgagattccttactcgggaggctatgttttgggtttcctttggtttttaccccgagttggacatggaggagggcctctagagggcaagacaaacccctatataagagacaatgccggttcaattgtaatatacaacacacaatctacatacaagctattgaatcgttttttcctatatcgcatatacttttctagtttagttcgtccatctttgtcaatttgcgtcacaaatcgtctgccttcgctgcgagaatgcgaaatcctttgtagatttgtcccataaaccttccgtttgcccatgagacgggtagttatccatcattctatctaaatcggctccgctagtcagtttaatctatcaaaacccatcttagtctagctttcctatatcaccgcaaggcgtttaggtgtctcgatcgtgattatcttcttctaaaaaaagttaccaactcttgctagatccaagaaatgacggcgaatttagtgacatgattaatacagtatacagtaagattcgtttcctttgtatagcacgatatataaaacctttgcttgtggacaaaaccattgcttttctcaccatgtcaattatctgtcatcaaacctgtttagttctgattctttcggaagcaattataaagttatcccctcaaaaatcgtttgtttccgccatgtttgcaatcagatacagcgttgtggacattttggtttatactccctaaacgaacactatcgggcacacactaacagcagttgcagtaactgtgcaggcgagctgtcaagacagaatgataaacaaagcgaactcgagcttgaggcctgcttttatcgaaaagaaactatgaccctgtgtccatgagagaccaattttcttccgttgaaatggaccaaaaacagccgtaatttaataaaacgaacatgaaaaagataaaataaatttaccaccccttgaaaaataatataataatttattttgttacaaaccatgcagtataaatacaatttggattttataatttacaagcaattcaatgatttaattattataacattgtgttacacttctctttactactgtatgaatattatttaaagcacctaataataaatattatgtacaaaatcaactaccgtcatgtcaatacttaaactcaaaattgtcatgtggtcatccgaggatggatctaattaaataaacaaaacagataaaaaaatatttaccctagaaaacaaatacaaataattgtttcggttgcacactttatatatatacatagcaaatagttcagttcaacaagcaagagtgaaatggagtgagaaataaaaataaccttttagcaatcaatctccaacaacaccaaaaaatatgttctttactcgatcagcttgagaggaaggggatgagctatatatagagctcataggtgtcggtggtgttggttcttaactagaaccgacacatatgtttgacagctatataggtactgattatttaagtgggtcctccaatgtctacttccgggagtgaatgtctcaaaagtattggctctaaactgggcctcggaaccaaccactatgatgggatagaataaaggtaaatttttgctacgggacattgagatttcgttgttttagctataagacgttgcacaaagtcacttttggaggaaaatactctgtaattttggttatttgcaagagcacaccatgctaattattttagtgttttaatgctgactaggcgagagagggcccactttttgacgcgtcaggacaaaattaaccctggcacgccgtgtgctcaagtgcatagagcacagcgcagagcgccgctgtcgaggtcttcaccagagggggagaggaagctagcgatgtcgggaaggaggagggaaagccaacgaatggatagtgccaaccgacggcggcaaggaggggaaggggaagctaatagaggagttagagaagccggccgcagcggggaggaggacacttgcatctagggtcaccgagggccacgcgccgccgcaactcccttcacgcattgccggggacgccgagggttgcgcaccaccccaatgtcctctacttgccgccggaatcaccgcagtttccttcgtgtcgccaccgaagctccctccctccgtgtgcagcggctaccttcacgcgcacctccatcagcaacacgagccaggccgcactgtgcccatgtgcactgagggtagccagactgtgccaccacccacatgcgctgagggtttgccaggctatgccaccgtggcggagtcagatgatgccaggagggagtctgatgttgcagaagaatatgactagtggacctaggtgcatttttaacctttcacactgtctatctctcctattcaaccagaaatcaatattttaatgtctgcggtgtccatcagtcaataaccatattttcagaatgcattccgccaaaaatcaacttttgatgtgtcctagagctaaaacacaaagtcactgtgtcctacagcaaaatttccctagaataaaaggtgctagctttttgctggaacatgcacctttctctggcaggaaagataggtgaagattcagttaaaaaccggcaactatttggtcacaggggtaccggtttctagccgttggcgtcctattggcacgtgtttaggtgggaaaagtattataggtatcggttttagtccttcttttagtacgtttctataataatgttagtgtattgctatattacgcgtcatcgaaaccgattttttttctacggggtcaaaaacttgattactctgatttttggcccgttactgggctttcatgcaggtggcctacttgattatactatcagtctccgtacggcaagcactcccatgcaaatcttgatcgattcagcaacgaagaaacaaacaacaggacaatagtaaaggaactggctgtataaaaatcgatggttactatttctgtttctgatggtggtcaaacgtggggagggaacactagaatcgttggtgtatgagatttcactcaccatttaaattctgatgtttataaatattaaacatgtagctgggctttcaataagattttaatgaaattagggatgtgatgatggtttccgtcttttatagcgtgcgactatttcataaactaggaaggtaacccgcgcatttgcgtgggtaagtatattttctttacacgcgtttgaccatttgtcttatttaatatttttatgaaaacatgtggaaatgtaagtcatgttaagttataaaccaagtcaaaaaataaattattattatttatttttaatataaataaactgccgaatgtgtaccgaaaattcaacggcgtcatctatcgaaaattgtacctttaataatcgtagttttttccaaaaatattatttattgaaattaattatttttaagcaattttgttagatacacgtgtttatagatcaatacgtactcggtctctaaaatatatgtatatttggattttggtacggtgtttgagatgctagattgtttaccatttggtcctttccaaaaacttattttaaaaatagacccataaaaaacttattctagaaatgatcctttttggtacgccagagtagctggtgttatcatgccccccctccaccccaaggcgccagtgccttttgcacgctcctcctgggtggtgggtagcacttaaccgacaggccccacccctcccccctccctctccccatccattccccccttgtcccatgcgcaagcctgagaagagctcttgctctctcccctctcacctctccttctaaaaatccactcgttttggagacattttttgcgggaacttttggggacatcgaagagcaagatatactcctcaattccccctctcaaatttgttttgtcctttgtgttggtttttagtcactctttatgtagttgcctgagtgcttgttctctttgtgagattaataagtagttgtagcttctttgaagtaaaggccaggatttattccattatcttaaaaaaaaatcttctcccactctttctctttctttggttttaattggtgaaatttatagatcagagaataattctataaccctttttttccccaaatttatgaatttgaccgttgaaattggggatttgttgattagagtgctatatgtgtgcaatgtacttgttggtgctacgattttttttaagtatgtatgtggtaatgtttattaagtttaacacgtttggtatgtcaatattttatatatgcttatattttatacttataattttggaacaaaagaagtgcatgatttcttaatccacatattaaattgtactctaatatttgcacatcggtttatggtatgtacagtgttagaatatgcatccatgtaccatattttttttaatataggtctaaattaagaaatactaattaaattattttttatttaattgttagctagaaaataggagaggttagcttaaaaaagaggacacgggagaggagggagtacgtacatgtaactatttctaaacataatacatctacaatttaaatagtgggtcctgcagttaaggggaaatcaacggttgagattttttagaatatttagaatctttttaatttattggagtgccacatgatggcttaggagcgtttatagaaatcctacatggcggcttgagagcgtttgtaggaagtttcatggacttttagcatataatagattttttaaataatacggacggtcaaatgttaaatacgaaaactcacaagtgcacttgaaataggacgaagggacacggcacttgaaatgaaacgttggataagaaaacccagagcgacacagcattcaacaaggtgagaactactcaagtctatccaatatccagtttccattcaagcgtatagcaggacgaccggccgggtgatcagtctgcctcctcggcagtacgagagcgatgacgcgtaatcgagaggttcaattaaacaattgatcacgcgtaagtcgtgacctcgtgtgacaatggcacgatctagctagatccactaaattggcggcgaatttagcgagatgattaatattcagctgtttcggtgtcgctagcgacagtgggactgaagggaagacgggactgtagatcgattagtttgactgtagatccatgttgaggcgcgacgacattttagtgcgtggtgtcggcagatgtactggtcaggatgtaacatatcccctgacgtctgtaccgccctctagtgttctactgtactgtactgctaattaaacaattagaattactagtcgtctacccgtgcattgcatgggttattattgtcggtgttataaaaataaaaaaaatcataatttaactatatgtcgacattttatgccatgttggaattttaatttagttattttactaatttaatttataaattggaaattaataagtacggagtttgaagtctcaattatcccttatacatgatctattacttttgaaattgtaattaataaatataaagcagttcctgggttttgtgtgaatttgcaattttcctttgtaaaaaattatagttttctgtcttaaaaaatacattgttcctttcttaaagaagaaagagttttcctatgattttaattactgatcatacgcagtgcccacactcaaattaatgaagtagtcgatctattgcaaattctagactgatcatacattgttaggttgctataaaacataaatcacataacagaactggcctatcagcaaatcacactgagatgtgcaagacgggagaagcaacagaagaaacaaaaacattactgcaagctacctgcagatgcgcatagaacatgtcgaacctctgtagagttttcagcttaaaaaaataataaaatcacacctaagatttagctgggaaggatcatccctgatataatcagcagcagttggagcccaaatcagaacaaagtgtatttagaacgtctcccatctttctagcggaagtctcatgtgctcatgtacgttcccatttgctcacagtctaattggatcggatggagtccaaattcgttattgatcaggatgaagcgcaacgggagctgcttttcatgatactgtctcgcgttctgttctttttgttgcgagaggctcaggttggattttttttttcaaaacacaaattggatgggctttcaaataggccttggattggctctgaaagaagcccataatattaaacatagtgatcaatggtcaagatgtgcaatctagttaatcaaggctagattttctggtaatatatatgagagctcgtaggaagtgcc

SEQ ID NO: 13540 - DNA, 32266 bp, Oryza sativa
ttgttctttttgctgcaaaaggctcaggttggatttttttttccaaacaacaaatgggatgggctttcaaataggccttggattggctctgaaagaaggcccataatattaaacatagtgatcaatggtcaagatgttgcaatctagttaatcaagggctagatttttctggttaatatatatgagagctcgtaggaagtgcccaattagtatatgtatagatgtatagatagatagatagatagatagatagacgtacgggtataggcaataacagattggattatttttttttttcaagatgggctttcaaataggccataatattaaacagattgactcttaaagaagcccataatattaaacatagtgattaatggttgagatgttgcgatctagttaatcaagggctagatttttctggttaatatgtgagctcgtaggaagtgactaattagtataggtatagatagataggtagatagatagatattgatatagatatagatatagatagatagatagatttcagaaccaatataacaaatatggattacggagaagtatcgatcgatcatatatcactcataaaaaatacattatttaacggataattatggcaaatcataggtggaaaagcgattgatatttaatcttattctcatctcagaggaaatatgggggctgctaacactattaaaaaaggattttttgcagatggcctgaaaggggttttcacatgcagtagggctagacgcacgcaccgaatggtctgcgaaaatcactatttgtacccgcacgcgaaaatctgtcgtcagcacacaaaaataaaaatccgaaaaaaataaaaaccaaaaaatactaaaccctaaccctagaagccgccaccgtcctcctcgttgtcaccatcgttgctggaagccgtcgtcgtcatcgtcgccgtcgacctcatcctcatcgtcgtcgacatcgtcatgggggcgtagggggctaggggcggctaggttatcccgctcccgtcgctgtcactgtcaccggagccggatccgacgccctcgtgcctccccaccaccggatccgccgctgctgcacttccccaccgtccgatccgtccccaccgcacatggggagcgtggccgccgtcggatccacactgtcgcatgcctcctccgccttccactgccgtcaagagggagtagagtggagaggaggagtgggggagaagaggaagatgccatcgctaccgccgccgctagagcctgctcccgagacggacgagtggggagaggagtgtgggagaggagtgggagagagagagtgtgtgtttgtgtgctgggagaagagaggagtggagtggggtgatgggagagagagaggattggagaataaaaatttgcatgcgggagagttaagagcccgagatgccaaaatacccttattttaagtgggttgtctggaaaaatggatttttttatacggatgtcttaggagccctattggaaaatgagatttgatttttacagatgcggatacttatggtctgtctgtaatctattggggtgctcgttgaaagccctaacttggcggcacgcgtctctaccccgatggcatcttttttctattttatcctttttttctcctgatcatcttgtcctctccctctccattctatctcctctcttttatcctccttttcttttttttccctcttttttctcttccaaattcctctcataaatatcttccttttaaaattatcattatgttgtgtataaggaaagtttgttactttgcaaataatttccatctacaggtgaaaaactttcactaattgaataatcaaaatttaaatatttgatcaatgacgtatagcagaacacacacgtgtcaacttatggaatagccacctgatcgatttgaggctaccgatatgtgtagtaatggatttttttgtgtgatgacgaatgaagcgagcgcaactgagtacaatactatacatgatttctgactttgtattactattgctttgtttgtcttgttttggtttgccgttgaaattggaagagtttttattaatcatgaaaattatcttcccctattgcaacgcataggcatttttctaggctgaattaaaactacaactcagtgtaaaaaaaagcttttgatatgaaatatgaaacttccaactaaaatatcaaatctttcatctaaaaaatgacaaaattttcaattaaaaatctaaaaaccttttaagttgtgggctaaacttgcaattcaaatatttttttaaaaaaatcaattgaaaaactcaaaactttctaaccaaaatccctatactttcaaatcaaaagtatttcaattgaaatgtttcaactaaaaaaatcaacactttctactcaaatcagtggaagtttctacagatactcctatctgggtctgataaagaggaggaaaaaatgggcactgacatctcactaggaagaatgagcccacggttgtaagcatcttgtcgtggtagtctagtagaggaagaggcggtagggcgaatcagcaagggaggaggtcatcggaacacaaaagtctaggcttactggtatgccgtggtggaggaggcggggtaggggggagcaacatgttgttgaagagatgaaaaagacaatgccctacaagccactaggatgtgattagcttgccatcgtctggtttaagagaaggtaaaggagtaagtagatggtgcccaagtcagttgcgtcaccgggtgaagacagaacagtaaccatagaaggaagaaaagaatcataggaggaaccacggatgaagggattcgagcggtgcggaaaaaggataagtggataaggtgtgcactaatttagttgcgagggaacgtgtaaaatattggattcctgaagaaacatagccggtaactgaggcagtgatactttagcatgataaaaaagttcagtaaatcagcaaataacttgacggtggtacttaatttttagtggtagctagaaacacattcgaccatgcgactaatctatgcattgatcctttcggggaacttggatgtttaatttcatgctactgaaattaatagcaccatgtaagattaggaagctaaaataaaggtagaagaagcaaaattgttagattgtaatctatcaatcactttttttaacatatattctttctaatggcgaaacaagtaaggttccaaccttaaatgttaaaaaaagagagaatgttttggtctaaatgcttacctacatgaaataaagtgtgctttggtttaaattcttacgtaccaatgtgaaattataaattatatataatgtatttaagcacaatgatgcatctagattaataaaaaaataaaaaacaaagcaaatcaataattgaacttcacttgtataaaagttgcatttttttatagagaaatgacacggggataaaaataagacgtgacgctccactgcatttccgaacctcctgcagagcctcaactcatacaggtgggacaatctatgctgttgcgagtacacagacgtgaatgaagtctctatcaatggcatttcgttgtgtgtgggtatatctcatccaccgttggcgacaaatcaaacaagtcctctcatatcacgacaatatattgatttctctcattatggaggcccagtttgccaccaatgatctctgtctggccacgcatgtggtgacgccagaggaagaaggcggatccatccaccatagtggaggaagaaggcagatataaccactctagaagaagacagatccaatcattgaaatagaggaagaagccgcatgatgggcttgtttcaggccatcatttatccattttgctgtatttgagcatttcatcatctttttactaggattttgtacatacgtgcactatgttttcttcgatgttctacataacagggcgttgcaatcagtgcatctgatcaaactatttagaaatatatttcattgagcgatgaaatatttgtttgatgatatttcgtcgttttatacatcaagcaaacaagatcgcatgtatgcggtacaatcacatatatcatatatgtgagcatgattggtgcatacgtatgctgttggaattaatagatgggctaaggcccattcgaagattaattctttggaaaatcacaaaagcccacctcatgggatggtatgcatgtaaagtttagtactaccttacttattctaggagagggggacctgggatggcatgcatgtaaagtttagtaccaccttacttattctaggagagggggacctccttaaaagggaggatgccctcctagccacttgaagcatgtgtggtggagagaggaggtgaaacacatttgcgtgcgctagctcgcctcgcagggtcgggagagttcgacatgttgcgcatatttgatttgttcagccgagaatgctaattagcgaccagccgcgtgagccctcccccttgtgactgcacacgtgtcacgtgcggagagaagggtggcggacagcccgtggttttttttttcacagcgcacggtttctttttttttcttttttttcctttttttctttccatatcttttcagtattttcggttttttatacgtacatatataaattttgtatacgtgtataaaaaaatgtatatgcatattttttaagattttatacgtacgtgcatacaaagttttatacgtacatataaaaaccaaaaaaatacacgtatacaaactttgtatacgacagaaagtttatatacccgtatataaacttttgtatacgcttatacaaagcttttatatatagtatatatactagcaaacatgcccgtgcattgcaacgggtgaaaaagacgtaatgataatatacgtttttcattcataaccatgtcaatgacaatcagaaaattggaacatcttaaatgtaatagcccaacctcgatgatggcaaccttaagatgtttgctttaccaataattgaattattcatataacaacatgcatataatctaaaatattcttttaatctcattcttgcaaccaatcaaatcctacactgcctcgtatggtcaagtctacacaaaatagtgtcactgtgcactcttctctaaataacaattaaaatatgtttattttctaagattatttccatataatatgttatcaagaataatagctatacttcaaaaaatagtatgataattgcctataaagatgtgcagggtctccactataggagaatagatgacaaacaaaagtcgtgtaggagatgaaaaaaagtggatggagcctatccgaccaagtgtccatcaatttagcgtttttttctaacaattttttcctcgtatgctttttttttgcttttttacagacgtatttttttctcatgtgttttttttggactatagaactttttttctagcgtgttttcttttgcacttttttctggcatttttttcctcacgcattttttaaaccgtttttattttctcgcgtatttttttctttttaaatatacggtagaaacttctctttttaaatagttaggttatattagattagagataaagaagagatataaaaggacaactaaaacaacgaatagaaattagacttttttccgccgcgcttttttctgcctttttatttttttctcgtgcattttttttacgaacggtttttttcaccactttattacagtgtcggacctttctggatataataggattctttttcttaccgcgtcgcatataattcatttttctttgtaatcagacttttttttatttttttcgccctttttttaccgcgtcgacggagttggattcgtttcgatttttcttccccttttttttttgccttttttttgatcggacagatttttttttgccccgttcttttatcggactttttttatttttttttgcccggtttttcgctcgggtttcttttttcgcccggtcgatttttttaccgcgtcacatataatatgtttttctttggaatcggatatttttttatctttttagccctttttttaccgtgtcgatagagttggatttcgatttttcttccccttttttcctttttttttggatcggacagattttttttttgccccgttttttatcggacttttttttattttttcgcccggtttttcgctcggtttttttcgcccggtcgatttttttaccatatcacatataattcctttttctttggaatcaaacaattttttaaattttttgccctatttttttactgactcgtttcgtttttttccgcttttttttcccgtatttttttgggtcggatatttttttttctcccgttttgttcgctccgatttttttttggatcggactgttttttcaccaggtttttttcgctcgtttttttcgttaggttcctatttttttttgggtcggacagaattttattctcgccctttcttttcgctccgttttctttatcggactttttttttctcccttttttttatcactccgtctttggatcggacttttttcgtccggtttttttttctcggtttttttcgtctgatatttttgacgaactatagaagcccctcttatttttttaagtaagtagcgatagtgatacgaagaagagagactagagggaggcagctgatcgcgcgcgtgcacggccgcgctactagctgcgcatcagcgccccccgacttgagcgacatgtgagaagcttgtacagttatacgtgagttctcgtggccgtgcacctaccgtatacgtatacttatatgtatgccggatggttttccatgggtttaattaaagcagcggcaagctgggactaacaccgaagctgcatatatgggccggcggcctgttgtaggtcgttgccatttggcgagaaatcctggccgcgtacgcgtacaggcgtggatatccggccgcatatacacgatgagcgtgaagcgcaactacaggccgccggcccacagtatatccgcagcaatggcgcccggaggcttcggagcaaaccaacgcgtggccgcggcggcgccgaggagtgcgcggccggtgctggttagggttactcctgtgcctataaaaaggaggccatcgacaggcgccattccacacagatcatccactgccattcctttcatctcctcacactacacatagccatttcacatacactccacagcacaagtgcacaaccacaacatccacctccgattcagaatcatccacaccttcatcgatattcagctacagcccatctacacctcgcgacagcacagccatcgatatatcgtcctggtgacaaggcgctgcacgccggtggccggacagaacgcgtggacagcggctgcgcagaacacggaggggagcgcgtacgtagtcagccatcgccatggatatatatagcttcttgagtcttcttcttgttttctttctctttcagttcagttcatcatgcgtgcacgagatggcgacgagacgagttgccggtgctgcctgccggagatcgtgttggtccctctcgtcggagacgccggccaccagtgacacatgtacctgctgccgcgacgtcctcgcctcgccggccgcaatctctacctcacgacgtctctagctgggcgatgtgatatgtcatcgagacgctggacgtcgtcaacttgccggtcgcagcctcctcttcgcgacaccaccaacgtctgcttgccctcgtcggctttgccattttcctcacactcatcgtcgagccgctcgaggagaacatcagccggagcgccaacactcacgcccgcacggtgtcatctactccatccgtgccatcaaccgtttcgttgagtcgccgaagcgctgccaagcagtgctcgcctttgtcgactaatcgccatcgtgacgccaccactactggagaaaccatcttttggtcggtcgaccaaattctacaatagtccaggctccattaaaaatcgggacaaaaaacaatttttagtcctggtttataaaagcaacgggactatttgaaccaacaggactaaccgagactaaactttagtcccggttagaaaaccgggactacaggggttaccaattaggagtacaaagcatttctccagtagtgcacctcgtcatatcgtgatggagatcgtcagagtagccgcggacgccgcctcatgccgattcaggaggtcttgttgacaacaacgcggatgccgccaagctgccctgatgaggacatcctccactattacccgctggcaaagacaccaacgtcggacagcgaccgtgtgaggctctaaataatcccaccttgcttagcttgggaggaggaagctaccttaaaagagagagccacccttcccctattggactagtcttttagagagattgggcctttccctgagtgggtgtccctaagaactgttggggtctggtcaaccttaatttgttgggcctcggccaaccccacctaggccggattgttatcattcccgcgtctgtgaagcagggtttgaaatttcagttcgaaatttctaaaatttcgcccccactaaaatgctcacatctcgcccgaaaattttgattttttgcaattttttatgaaattggtcaaattttattcaaatttattcaaaatctatcaaaaattcaaaaaatttcatacgaaatttgtttgaaatttcggaaatttcggtactatcgcccaccagcgacagaaatgttgatttcgaaatttaaaaccatgttgtgaagaccatagagtcactgaagcactaccaagcggtgctcgtccatgccatcccatcagaggccgccggccggcatgccatcgtcatcatgtcagattgtcggtcgatcgccgcctacgctacctgtccccatggagcggagccgctgtcaaccgtgaggttatctcgtcttccttgtgggcaacgccctaacgcttgtcgtacccgtcagaccaccgtgatgccgtccgccgagtgccatcccgctgaagaaggtggccgacgtgcatgccgacatcgtcgcaccgaggatgccgccattgtgaccactgcagcaccacctaaaagacacgatggtgtcttcagacgctactgctaacgtcgtctgtcgagtgagtgttggggaataaccccatacttaggatgttgcataaactaatgtataaaatgactaaaatacctctaaaagggtgttgtatatgtataataaatcaatggcaaagaagtaattttctgttacatatgaataaaaggagccctccaagggcaagagagggagatctctcccccattccactgattctgaccctcttccatccactctcctggtccactcgggaccaagcttgggttttctcctatgggagagatgcccttgccatgcatgttggattttgcaacaacaatgaggagtgaggatgtctcactgagagtccactggctggcgacaccttcacgctcgtcgcggtctctttgggcatcgtcgatgactactcaatcatccttgccggcactgcctccttcttgacgtgttctctccatcttcatcgccgcaggcgtcgcgttatgcatccgtgtggtcggggttttcccgtgaagccactggccaagtcatccgtgaaggtccccggagatgagcgcgtcatatatagacggagccatatattgtgacacaatcctcacatgctagtgttgtacactgcattgtgtgtatgcttgtgcatgcatgcaactgtacactacagtgacacacaaaaacaatcaaatgctttattactaagctatactcacttggctgtggggatgtgtatcgctatatactaagtggagtccgctatctgcacctaccatctccaacgacttctccctttcctaatataatcccgactcaactgttgtgacatcaagctattcgagctacgcagctccacgcatgtcttcatcaagcaatctacaccaacatgtcgtttaagactgaggaggctagacgacgagggcgggtgaagacgatgctaagactatttcaccaacatcggcgcacggaccgacgaggccgtggatcgctgctggctcccacatctgcacatctaccactatcacaccatgtatggagagtgcgaagcgaagaagaccacagacagcttaatcggacgttctctcgcagacctagacctacggaggtaattaactaggagcttctcgagcacccgcatcggctgggcaccgaagggtacatcggcaaggagctaatatgagcccaagaggatgcagccactgcagcagcgaatgtccctgccccgttttcgaacatccctgaacaaagagctcgcaactgggcgcgggcatgtggtaaggtcaacccgaacgactctgtcacatttgagaacaaaagtgctgccgtcatctatcaggaactggtgagttcactacttaacctaactaattaccgttcgcatgaagtagaagtttgaataaacgattcttgtttttatagttggggttggttgctgaacaagcttcacaaagcgaggttgagtccacgccgaagaggcgcgaagatgacatcctcacaaaggcgctcggaaccaaagaacatcctggccggactcggggaattggcagcgatgtgccctggaagcatggactgccacaatacagctcccaatataggaaacggaaagtctccaaggaagagagagacgctcgtttgaaggccgagcttaaggtagaggtcattcaagaactagaagcaagcatggacgctagggtggaagaaagggttaaaaaggtcctcgccgacatgaatatacctcgaggcacaacacacgctatgcatccaactcctcgtgcacaacacaacgcgagtctgtcacagcgtaggagtagttgtgcatccacagaggtgccggcacctggtctctcggtcgcaccactagctgcagtggaccacatagaggtaaatgatgttatccgatccatatctaatcaaaaacctttacacgttccaatattaaattcaaactttacatatgcagggcgtagcacagtgtatcctactggctagggtccaaccaactttcgctcccgaagtcgctgagggcatggctttcaaaccctcggttatagataaggtccacaacgcagacttgctagctgggtatgccaaggtgtccatcgatacagtaaaggacacctggtcagtctatccgctgcctgtgccccccaatgatgaaatcatgactttgggcgatgcgcgcaagatgttcatacaatggcccaaagaagacatagttgtgaagatgactcctcgtccaagtcaaccgacggagcttacacctcccaagtctaagctatcaattgaggctccccgtggttcggcattgtcagtacctcattctcctagtggagctgctatggacttggcagatatagctcaaagcttggctccaattaagaccacaagaaaggccgatagttccccaccacttgtcaagggccagaagcgtcaacgcggcaaggggaagatcggggagttggcaccggtgccaaaaaggggcaaggctgctacatcgatgtcggtgagcaaagcgggaaaggtcgtgagggcgccagcccaatttgaactaggcatgccattggtggaggacaatgtgttagccgtgatgggtattgcttgctaagagctatataggcaatacatggagctaagtaatgccaagcggaaaatgagggagtcatccatagttggacatcacgaccagcagccgttcctatcgtcgcctgcctatataattataggctttgatgacctcttcgacttgttcaggatccggaagttggacactggacttctaaaatgctactccttgtaagtgcagaccttctatacttgtgatatgattggactatatctcctaattaagttagttctaatacgtaaatgttttaaggttgtgttggatcgagcgtcgtcgccttggtaattaggttgggttccatgatccatccatggtgaacgaggtcaatttactctagagcttcactgatgtggttgactatctcaaccggtgtttatgggcccaccaagacaaggagtacatcatgtgtacacacaaccaggattaagaggacaataccctttgtgcatattgtattgaagttaaggttcttattactaatgctacataaccaccgcacaggcaacattggattcttttagtcatcgtacctaagtggagtagggttacctaccttaactccaataagacgaaagattatgatttcactgaaatcaccaaggccttaaatatggtttggggcccatatgtggaaaagggtggtaggcacaaggagggtaaggacgaactctatcatgacaccaagtttgcatgtgcacaacagatcggagatcagtgtggtttccacgtgtgccacaacatgtcaacacttctaagagaggtgaaagatttcgacactgaggttgttgctaatggtgaataagctcatttcaataccaacattgctattctaaacgtgctaatctctgatttattaaacagaaaggtagagctggcttgaagatctcacccatcaaccctcccgctattagaggcgaagtgtccaccttcattcttgcggaaataatgaacaagaaaggatgttttcatgtcaaatagactcataaacttggctagataaattcttgtgatgtaaaaaaagttgtttttatgattctacattatggagtgcaatgtaatttactttcatatgtgcaatatttatggtagtttgctaaattgtcatcaaatttgatcaactacgatttacgttgtactattcatttgttctctcctttttttctaattgacaggtcgtggaggtcaaggacattatggctttaatcaatttgttaagcatatatgcagttctatgagtaacgaccgaaattgtggctttcaaggggtatgaatttgctgtgcaaaattgtggcatttgaattgcatatgtgaatgatgtcaatttttgagatggatctgtgatgttggggatctgtgatgtttgagatggatctgtgatgttatattaggggggtaactggaatatatttgtgatgtttctgtttttaaagggcatggctagcaaatcctagggctagccaatatttagcatttatttttttttctggaattaatacatcagtgacgggtcggaaccaaaattcatcaaaggtaacctcacctatgacggactcgcaaataaaggcccgtcagaggtgacctacctgtgatgggcctttactttcggggccgtcacaggtagatcacctgtgaccgcttctatctacggagaccatcacctctgacggcctttacttaaagggccatcagagatgagccacctgtgacgggtctcaactggccctaggctagcggagaccaacacctctgacggccttctagtaacttgcccgtcagaggtgggtgtcacctgtgacggccggccacccgtaaaaggtgactggactcactagtgaccactgatcactgaccatgctcaaagccgtcaaaggtgatggtttgggcccgtcacaggtgaccgtggccagtgtagtgattacatacccatagtatccatctagaagccataaacatgaaacaatcacggatatcccaacaaacaacccgaaatacagaatcggccggtcagaccgcgggctagccggtctgaccgcgcgatacacgccggtctgaccagcaaccactgcccggtctaaccggaccacatatccagcagcacctgtatatcacctgtaaaaaccaatcatctccaaaaccacttcgccaataatctctaagtatcaaaaccaataatcacagacgccacttgttcatcacagaataaagaatcaaaaacactttgattttacagtttttgatgtagtgtttggtggtgggataaacgtagatcgcaccttactctatcagatttcttaccactagtttcaccaaacttagattttattaaggagcttttacagcctaataacaatcttaaactttatctcgatcgaataataaagttgtcgtagataattttgtggcgaatagattacgtttgacatcgattgttagattctaaattcagtctagttttagtaaggccaagtaaggttgtgttcgtgccggtcgacgtcatcgtcaacgccatcatgcaaaaaaatgaaggaggagaggcgcaagcacgaggtggtggcgctgtacgagctagggcttcgacatgctggtgttgggggtggcactgttcgagagggctcctcgccgcaggtctcacacaaatggtgatacaatccaccctgttcaagcacctcaattggtggaagctttccggtgccgtgtggcatccgtatgatgcttttgatgcaggaggacgacaactggatgtaaatggtggaatgggttgggtttttaaatggaccgtcttcggttggattgaaatggggtaggacttggaatgggttggagcgatttggactcactgaaatatgggttggattggtttcgatgtcgtaataaatttttgggtaatttggaaccatgtcattataattttgcaaagtttgagatatgccatcggtatctcaatgacatgtaggacctacatgagtcaatgacatgtgggtcaggatgacatatcttaaattttacaaaattataatggcatggttccaattttccctaaattttttgggtcaaaaatggattctacccatcggttcaacccaggaataggagtggatgaactgaatggcctgagtcctactgtgcttgaggcggcggcggcggaggcggcacggcgtggcttggtgcgatccgcggcacggcgatcttctcggaggcggcgcgggagagcgcagctggcgcacgcacgcgaatagcggcggtggtggtgcggagcgcatcgaggagcagccgagctggtggcgcgtgcttggcgggatgggccatcgcggcggagcgggagagcgcagcacggtcggaggctagccggctagatgcggacaggagtgagggttcacctgcattgctgcgggctgcggcggaggccgcgccgtcgcggcgcttcacgtgcacgttacccaaatccttcgacaaactacaccgcggccatggctggggctcgacctactgccgttcgggctctgcgtggtggccggcgagctcgacgcgaacggcgaaacgcagcgccagcgccgcgaacgtcgggttcgtcctgctcgccgtcgccttgatttcatccacctaaaaaagaagcaggccatcgctgcgtgtggatgtcacgttcttcctcgcaagattggtatcgaagaagtccatggtggggtccggcctttgctgtacgattcctatctgtgcggccattgagcgatgcgcttagcaccgttgtggactgcatgtgggttgaatccatggattccaaatggattgaatccactaagactattatggtttgggttggtttggcctgaaactgcttgtggactggtttggattgggtcccagaggtgaagaagtggggtggattggttgagtgagctgctttgaagaggtgttgggttggtgcggatttggattggatttagacccattgaagagatgagaggacgagcaaggagaaggggttgatttggtctaaaaatattagaaaatatagtgaagggttaagtacggggtatatatatattttaaataagtataaaattgtaatgacattagagcaaattattaaatagcaatgatattattcctagcagataaatttataatggtacggatccaattaacctttatttatatccatagagatacaaggaaacacaaatataatgaccatatttgatcatgcacatatacatccagggaggacaataacatgcaagtaggtgaaagaaacaaacaagtagcagatatgaaatatgtttaacgtagcaatacatttagtgatatactcgagtactagctcccgatctttatgtagcatcttttcttcaaagatacgacaataaaagcaaacttacccttctccttctcaaggtgcttggcaacacggtgagcatattcttcaaacaacgcattgagtatgtcttctccaaaataagatgcaattaagggctgcagtgcggctctaatgcactttgctacattcatgccactcaaggcactgtcatgcacaatatcaccttgtgagtcatcataaggatcccaattacactcaaacagattgatgtgatccatttcgaacaaattgacgttcttcactatttcatctacctcaccgacggatggcccatacagtggtagattgaaggactcaaggttttccttctccaccaagccctgttatatacatgccgagagtttattttaattacatgtattcacctgaaaatttcctttttatatatgatatactccctccttccctaaatgtttcacgccgttgacttttttaaacatgtttgaccatttgtcttattcaaaaacttttgtgaaaaatgtaaaactatatgtatacataaaagtatatttaataatgaatcaaatgatagaaaagaaattaataattacttaaattttttcaataagacgaacggtcaaacatatttaaaaaagtcaacggcgtcaaacatttagggatagagggtgtatcttgtatcgcatcttgagagagtgacaccaaattcgcatagataattgtatatgtacctcagcgacaagagattgtagtgattgtgcaagcaaaccaaagagattgtttagttctgatccactgcgtgcgtcctcattctttctcccacaaaatgtcagtaccatctggcccccaagcacgagttcctcatggcgtaacgtgaggaagagggagaagtccttgtagaactgctcttggaatagtttcaccacggactgtggtgtagtctttgtgatgtatatgttttcttcatttaggtacacttttttcctgccattcagctcctcaggcacctaagtaaatgatagcactgctaattaactcaaagtatcatgctgatgatttgacttgcattggcagagaccacatgtgtatgaacatcttgtagtactatatatagatgttacacttgattaattttattgcgtacctgagagagccagtgaagagatatcgaggagtgaaagagatgaatagtttgttgaggaaaaagccttgtgtaataggaacctggcactccacaaatatagtatgcaggtactatttctccttcatgatttgtttcatttgccttcttaaacgtttccaatgtccgaaagaggtgattgaagtcattaccaggtaggtcatttaagaagaactgaagatccattaaatcaagttgtcctagcttattttggcacttagttatgatatttatcacctccgagacaaaacgcaatgtgttcggtcctgaagagcagccaaggtcggcaataaccatgttacgtggtaaaagaccagtgtatacttcttgggttaccttatcgaggattgacttagtctccatcatagccttgttctaacagcgtacatgcatgtgaaaagattgttaattattgctactaatatatgatgtatcattagctggaattaaattcgagtataacataatcaaataattaaatattgtgcattgatcaatctgataaaaaaagaaagaaaacatcgattcattcgtgtcaaaaaatgaaacatgttactttctatatcaaggaacctattgctttcttcgttttctctacaaatcaaaggaagccaaaaagctgtactcatcagaatttctttttaatgattcctgagtaaagctcccttgatcgccatggatagaggaaaaaaccctctatttttctttttcgccgggcaaataccctctattctaactggtgtataaggaatacactttaatccactttaatcttcggatgaaaagtacgtaaaacattgtacttctaggttcatatcaggtacgatactaggagccaacaaaaagaatttccaatcttgtctttgtatgctgtacaagcattttttttcctggtaactaatgaagtcagtgaattttatatggtttcaaattcataaatatgctccatgcaatcatgcatcatgggtacaacctagtttacctttgcactatcacaacttatagtttacttgtttgctgatactatcataaattaaagctattgttctaacagacctcataacttgcatgcagatgattggcaaaataccttgtatcacaatagcaagtaactctgctatatcaatatatatgaggcaaacctcttaccctcttttttttaaggaaaaaagcagtgaaacgcgcgcatatgtgttagtgagtaagagagacagatatatgcagattgacagccagacagatagatagagtagttacttgaaccctagaattcctggcatagctaatttctccttcccctccgaccatgtggaaatcacgttccgtgttgatcatggttgtattttctgatgggaacaacacaccaattctaggcaacacactgatcaccctgcggcatgctatttatatagaggccaggtatactgtcatgctatttatatagtgtacttattgaaagaattaattagctcattcaaaaaaggccattcagaaaagcccatctcgcaaattaactcgccttttgctaggaccattgagttgtggaatggtatatgccaattaattgatgcatatggaatggtatgccattagttaagacacatttcaggagcagatataatattgcacgatataaatggctccaacagtttagcagatatatataacagtgaagagactacctctactatcacttgcatgggtattctactatcactttaaaaatgcatacctcctaaaggtagaaaaagcattaacattttttgcattttttctgagaatagtaatgttagaaaaagcataacagtgaaccaaaatttcgattctaatgtaactcctacacataagaattatatattcttcaatcatctgacacaaaaaggatattgcaataaactcaaatatcacaagatttgatcaaacttttaaaattgactatcaataactttccaaatgtttagtttagaaaaaaaatgctatgtgcaaatttgccttagcaagcactatcataatataacacctattagaatttaggcaaaatttgctacaagacactcaaaaaatgttgtttttgttgggagacaccacaagaatgtaaatttgctcgaggacacttcaaaaacgtggtaatttactggtagacaccatacacgttattgtatgaattcttgctattttggagagataatttttgcaaaatgatagctttgctcttaggatcaaacttctttcctaatccaacaagctagcaggtggcggtgccaacagagggtgttggtagggttttaaatttcgaaatcagcatttctgccgcagctgagcgatagaattgaaatttcagaaatttcggaaaaaattcgtatgaaattttttgaatttttgacagatttttaataaatttgaataaaatgtaaccaaattcacaaaaaaatacaaaaaaaccgaaattttcgggcgagatgttagcatttcggtggggggcgaaattcaaaatttccgaaattttgaaaatttcgaaccgaaatttcaaacactgggtgctggtggcggagaaggccagcaagctggtgggcgacgaggaaaggctggcgtcgttcaaaggtcaccgcctcccccgccggtggcagtggcggcttggcgcaactataaacaaataaggaagaggcccgtgatggcgaggataccccttcaccggtaccgtgcgccggcagttcctggcagcgaagccgacgatgtggtggtgaggtaacggggcaccgtgcacgtgatggacgaggtgaggacaggttggggaggagctcgaggccgtcggcgtcgtgaagtccagatccaggtgctgacagtgtcgcatgtaggaaaataaatgtggcaatgatagataaagctaacttgtgcggctgcaactcgtttatagttttgacataattaaggaccatccaatttaattttccgtgttgtaatcgacttgccgatagatgcaatgctggtataagtacatgcatgagaaaattaatttaattagaatacccatgctatccctattattattatgaagaacatcacataactaaacaattaacattagagtgaaatacacgggtagtccttacagatgtgttatttagatctctaaactattaaaatatatttttgaatccctaaacttatcatgaatgccatataggttcaaatagacttcaacctgattcttgagatgacgtggcataccaatatatttttgaatccctaaacttatcatgaatgccatataggttcaaatagacttcaacctgattcttgagatgacgtggcataccacggtaacgcttacgtgtcagtgggatccacatgtcagttacatagaaaacaattaaatttaaaaagaaagaataaaatgttgtttttaattttgaaaaaataaatgaaaaatgagaggagaaaaatatttttttttctatatgttactgatatatgggttctacttatttttttctattttttaatatattaatgtttatatttttttatgttcgtgaaaaaaaatcaaatggtctccaccaccctagctacctgtcatcagacatgactacaaaataaacgtggcaacaatagataaagctaggacgtgtctacaacgagaccgttctctgtatggtcataaccagctacctctcaacctcatatctagttactactattatattcaaaagtgcatgtattttttttcttcttatagaattttctcttagattacccatccgatttacgatctgattacaccattgtgttcatagcaattaaatctttataacaagatctcacatgactatatttttatgaaaaaatagaaattacttttataatatatctaaattacttttagatttcattaaattacttcttagtcataaaattaatttaataaagccagaaagtaatttacctatattataaaagtaacttaaaacaaaagtgaagtaacttgttacggcattaaaagaaatctatacattcatgttgtgagttgtttattttataatcatttttagtcaatgatgtaatttgtgctgattaaatttaatttctatatagactcatgtttttacctccataacggatttacttttaatgtcgtgataaagttatttttttttctaagttacttctataatatatgtaaattacttttaggcttttttaaatttacttttatgggtctaagaagtaatttagtgaaatctaaaagtaatttagatatattataaaagtaatttctaatttttcatcaaaacataatcatatgagatcttgttataaagattcaattcttacgaacacaacggtgtaatcggatcgtagatcggatgatttgtttaagagaaaattatttttgaagccggcgtagcgtagagcgtcacatggcttccaatttggattcctctggatgatggcacgtccgtgaatcaccaggctatgtacagacgcaccagagcttgttggatcggacggccgatgagtatgtggcgcaacaagacaaaacagagagcgcgcgcgaattagattttgcataaagctaatttgcacggctgccactcttttattgttctgacatacttccaatttaaggatcatccaatttaattttccgtgttgtaatcaacttgccaattgacccaatgctggaataagcactgcccctcgcttgtcttatcaggccattcacactgcgtctggtcccgtgcgtgatacatgtgcaggctgagcagtggaaaaagcggccgaaaatttgacaaaatgattctcttagaaaatttgtttgaagatttaaccatgataaaaactaattacaaaactaagtcttttacttagcaccatcatgcttgccgctgatctatagcgtcctagtgccactaatattagcgctgagatttcatgcgaggtgacaaggacttgccaaatcatccgagctcagcgccatactacatggcactgagagcttcataggataaaaccataaccatgcactttgatttacaaaaggtttgcttggattaggccttgtctagtttccaaaacaaaaactttttacccatcacatcaaatgtttggacacatgtatggagtactaaatatggacaaaataaaaaactaattacacagtttacatgtaaattgcgagatgaatcttttaagtctaattgtgccatgatttgacaatgtgttacaaacatttactaatgatggattaattagtcttaataaattcgtcttgcagtttcctgacggaatctataatttgttttcttattaggctacgtttaatactttaaatgtgtgtctgtatatctgacgtgataatcaaacctaaaattttctcgactaaacaaggccttaatggtggagatatcatagctacgagacaagaggtgctaggttcgagccccaattgtccccctatatagcttctttttttctctccttatcctctatttcttttttttttcgttctctccttaccctctattttctttttcgttctctgtatcccctatatagcttctttttttcgttttctctccttatcctctatttctttttttttgttttaaatgtatcccatattcttctctatttttttctcttctcctatctagcttattagttttcgttttcactccttatcctctatttcttttttctttcgttttctctgtatcctctattctattcttgggcaaaatttgccataggacacgcaaaaaatgtgtaattggccgtaggacaccggtcgtattattttattatttccaggataaaagaggtgagatatttttctaaatatccggattgccccttctcttagcttctttttctcttatccttcattcttttccccttcccgtgacatcgtcgggaatggcatgttacctcagaggagcaatggggcgaggtcaggcgacgtggtgcgacgacactggtggccatctcatcctcgcgctgagcatctagcccgtcgctcttgacgcggaacaggccgagctcctcgatggtgccgtacccgagtgacgagcacccaagcccaccgttgagccaaagtagtaggggccccttgatcaacgtggcgtagccgccgttggccttggcgaggtaaggaacagcgcgcgccctgtcacctgtccaccatcacacatacccaacgtattgtgcgaagcccaggctgttcgcctcccctaccagcatccccatgcggtccccctcatggctcccaagcgcctctggctctgtggttggccccgcatgccacctatcggagagttatggcgcgctcgaatcttcggctgacacgacggccagcgacaccctcgacgatggcgagccacgcagtctgtccaggtagtctccctggcgcgtgcgtggctccgccgctccgggtgcgccagcgagcagcacgaggcattgcgctgctgccaccagcaagaacagtgcgatgcagcagccatcgctgcacgtccgcctccgcgccatctgccgctcctggcgcgcggtcgccgccgccagctaccttgccggcagctacaaaacttttgttatttcggattggagaagatggcgtcaggggcaatctcgctattttaaaaattttctcacctcttttgacctagaaataataaaataatacgaccggtgtcctataaccaattacacatttttcgtagtgtccattagccgtgttatgtgtttacggtgtctcccagccaattacacgttttttgcgtgtcctgtggcaaattttgcccttttctttttttccttctcctatctagcttattttttgttttctttctttatctgtaaagataaaaatatataaaaagaattaagaaagttacgttctttctaattttcataggagagtaaaagaaacaaataagagagaataataaaaaaatgttactcttcccaatttaaacataaaaaaatataaaaatatttcaagtgagttacgttctttcgattttccgtgttgtaatcaacttgccaattgacacgatgctggaataagtactgccctcgcttgtcttatcaggccattcacactgcgtctggtcccgtgcgtgatacatgtgcaggctgagcagtggaaaaagcggccgaaaatttgacaaaatgtttctttcagaaatcttatttgaagattgaaccatgataaaaactaaataaaaaataaatcttttacttattgtcatcatgcttggcgctaagctataacatcttaacgccactaatattagcactgagattccgtccaagatggcaaggacttgctaaatcatccgagctcagcgcaatactacttggtgctgagagcttcataggataaaaccataaatatgcactttgatttacaaaaggtttgcttggcttaggtcttgtctagttcttaaaataaaaacttttcacctatcacatcgaatgtttggaaacatgtatggagtattaaatgtgtacaaaataaaaaaactaattatacagtttacgtgtaaattgcgagacgaatctttaagcctaattgcgccatgatttaacgatgtggtacaaacatttgctaataatggattaattaggcttaataaattcgtatcgcagtttcctgacgtaatctataatttgttttgtcattagactacgtttaatatccgatgtgacaatcaaacccaaatttttttccaactaaacaagtccttaatgatggagatatcatagctacttcctccgtttcataatgtaagactttctaacattgtctacattcgtatgtatgttaataaatctagacatatgtgtgtgtctagattcattagcatccatataaatatgggtaatgttagaaagtcttacgttataaaaatggagagagtatgagacaagaggtgctaggttcgagccccaattgtgcccctatataacttcttttttttctctccttatcttctatttcttttttttttggttttgtctcctaatcctctattttctttttcgttctctctgtatcccttatatagcttttttttttcggtttctctccttatcctctatttcttttttttttcattttaaatgcaacccatattcttttctctggtttttctcttctcctatctagctgactagttttcattttcacactccttggtctctatttctttttttctttcggtttctctataccccctattcttttgttcggcaaaatttgctacaggacacgtaaaaaacatgtaattagctagaaaacactaaaaaacgtaacacagcttatggacactaaaaatgcgtataattggccgtagaacaccggtcgcattattttattatttccagggataaaagaggtgagatagttttctaaatacccggattgccccttctctttccttctttttctccttctcctttcttcttttcccccttcccgttgacatcgtcgggaacggcatgacggcctcagagagcagtggggcgaggtcagcacgacgtggtgcgataacactggtggccacctcatcctcgcgctgagcgtctcgccgtcgctcttgacgtggaacgggccgagctcctccatggcgccgtaccggattgacgagcagacaaggccaccgttgagccagaggaggaggggcgccttggacgacgtagtggagccgccgtcggcctcgcctttagtagaacagcgcgcgctccgccgtctcgttcaccgtgacgtacctacaaagagatgtcgcactctcgcagcggtggcgaacggtttacggcgcaaaccgagaaagatagacaaactaagagaaaactaaaagcaatatgaaaaacgattcaattgattgactgtagattggttagttacaatagaaccggccatgtctcttatataggggttgatcttgccctctacaggccctcctccacgtccaactcgggatagaaaccaaaggaaacccgaaacatgctttcccgagcaaggaaacctcgagacccgacgaaacacagtcggacttggacctgccggtcagaccggccacacaccggcggtctgaccagccctcaaccggtggtctgaccgcccaacacacggcggtcagatcggcccactcggagaaaaccggtagacttctaaattttggtcatctttcctattttaatcctaggtgccaaatttgggtgtaaacatgtctcttcttcctcgctctcaagcagcggagggagacggccagcctgtgcacggcagccggcggcgagcgccgctgtcgcctttccccgaccgtcacagccgccgcataggcccggggagcggcccccatcccggcgtctaagatggctccgctgcccgctcccccggcgagatccccggccaccgcccctgcgccgaccggcgaccccgctggctccttcgtgtacaccaccaccgccagcttcgttgccgtcgccgttgcagtggctgctgccatcgtgttctagaaggatggatgcattgattgattgattgacacgttgatgtggagaacgacgaatttgtccttgggtgtgctcctcgcgatggatggtcgcacccatcaccgctgccggagcagccgcggcggagctggacctgtagcacctcgatcctgtcctcgacggaagcctgcgcggcgctggaggacgactctgtgacggccacgtaggtctcggcctcgacggtggtggcggcgcgccgtgcctcggtggtgcccagagccgcctcggcagcctcctccgcacccaccgctatctgctgcccagcgctaccgtgtccggccgttagacctcctcctatcccgcctcgccttgccccaccgaccggcccgccctgtgaacaacgaaacaaagaggggagacaacggccgcaggaggaggacatggcagcacgacggatgaggatggggaggaaaagcatcatcgggctcgggttgtggcacgaccgcacgagtacacgccgctcaactccacgctgtctagggaggggttcacgccgtcaacaatcgaggagaccacgggtatctctgtcgtcaagcaaaaccacgtcgccgttgctcgctcgtctccgaggatttccccgacgagctcctccctccgactcctacagcgggttggagctgctatacaagctccgattcctcgcacacccaccgccccacgcgcccacgccgccgccccccgcggaacactgggtgtcgacgccggctccttccctattcctctagatccgctcgacgccattgacgagcgtgacaggcggcagatcaggcgccaagggtctgtttcagtctcaccagcgacgcacgcgactgatctgccgaagatgatctaggacgccccttcctagaccagggcctctgttagcggcggcgataaggttggggaaacgatgagtcttcatcttcgctgcctccaccgagatctccggcatctccgcgtgcgagcatggtgagggctgagaccggtggcagccagcctcctgctcccgacagcggcagaggcacctcttgcacgcaccatgcctgacgagtgggcccagacatttgccacatcagcgaaaatatgtgaacatatgtggagagaagagggggagagagagggtgctgacgtggcatcctgacatatggggcctacactgactcagccgccacgtaggacaaaactagggtcaaaaccatcaaagtacctaaagtgaacggtttttataagttgagggatgacatatatctagttttacggttggaggacgattttgtaactcgatgacaagttgagggacctttggtgtacttttttcttctctttttcccttcccctaagcaggccgcccaacccagcccgcaactattcaccatctccttccttgagatagccacttgcacgcacacagggtgtttgacgaaatgctgacccagacgccgcaccgttccacatcatgtccgtgctgttcccaccctcccgtgcgccccgcatcgtgcttttcggaaaaagctgggtcgttaactccacagcacgctcacggtgctcagtggcagaattgaggggggctggcaggggccatggcccctcccaataaaaagaaattttttattacccctatatatggtctccaggtctagcaggccaccgtatggcccaattcagtcttgctggcccatagcagcgatttcaatacagtgaagactcgtgccgtatagtttaaatgaacatgtaagtatattgtccgcttctgcaaactattcgcttttatgtattgccaatacacgaaaaaaaggagaaattgccaattttttgagctgtcaaaagccggctggcccccctttgattttccgtccagctccgccactgacggtgctcttcccatccactcgcccaggattagactcaaaaaacgagtgactaaagttagacacagggattcaaggatttcaaataattgcatgttgtataaaatctttgcttatccacttccattgcttttgtcaccatgtcaattatttgtcgtagaacctgttcaattctgattatttcggaagtaatctgattaattatggagttatatcccctcaaaagtcgtttgtttcggccacgttcgcaatcagatacagccttgtggatatttggttacactccctaacagagtactatcggatacaccgtacgtaactacgtataccacaactgacacggacaaaataattattagagcttgcattcttccattacaccgtttaattcctgatactaccgcgacactgcctttctaccaccttaattagtatcagtatctaaaatgtatctaagatgagacgtatatatttgtacctagaagttcaattttgggaagggtatatagttaaatttcaaatacataaagtaccgcaaaaaactctaaatctgaaaggacatggcctaaagctagtaaactatacacatcaatccactgtaaatcaaatttcttatttgtaccagaaataactcaaattaaagaataaacagataaccaaatttcttaatttctgtaggcatatgcttgtcaaaccactaaacattgtgatatttcagcaagaacttcttatgtagaattttcatcaaaattaaaataaatcaaaatttgaattttataatagtcaacgcttctcgcccgaaactttcattcgaacaagacacccgtctattttcattctggattcatcattgctggcacaatactagcggcactgatgacttcaatcgttggtgccggttgcaaatcgacaccctatatggtattataggtacgggttctataaccaactaccacatggttagccaactgcctatctaatggcccaaatccatcttttgtcgaaaagaaattacgaaaattttcttatattggaatggaccgaaaacagacgcagtttttggtctgtagtcgtagactgtagtcgtagagcatcactaacagcttccttattctattccctatcctcaaatttaggaaagtttggtcaaaaatcgcatctaacagattccctaacctatcttccaataatccagattctcaattccggaaatctcgttacccactgttagagagcgattttttcttcccaatcgctgtcttcgctctctcgcgcgcgctgggagaaaatgttcccgtgctccttttctcgccctactcgcgagcagccatcatcgtctccctcacaagcgtcggcggcattggaggggatggaggagctggcagaggggaatcgagggagatcagcaaccaacagacggctcgaatagattgatcggtgtcagtgaagaaaaatcgcgagagagatgaggagatcggcatctcgcgttgtgcgcgcgcagggcaggatagaaaaacccattttttctgttgatagttaaagggagggctcacatttaattataggaaatcaattttaagctatctattaaaaataatagttttctcacttcctatatattcagtttaggagataaaaatatagttttgagaataaaatattagaatactctttggtgatgcttactgggctgatgcagctggcgtacttgattattactagctacttccgtccttatcttgatcgattcagcaacgaggaaacacaaacaatagaacagaacgatatacatagcaaaggaagcggctacgagtatatcgatggctactgttcctggaggtggttgatcagttacggccaaaggtgagtacatgtgtacgcggccggaaatctcagaattaatcgacggggaaatggctttcaacaagatgagaggactactccaacaagtcgatccaactacgatatccggtacgtttttccatccaagcgtactccctccgtctcaagaagacttaattccaaagtttctgtatctaacgtttgactatccattttatatgaattttttttataattaatattttcattgttgttagatgataaaacatgaataatactttatgcgtggcttatctttttaaatttttttataattttttaaaataaaacggacggtcaaacgttggacacggaaaccaagaattaagttattttgggacggatggagtacatagcaggacgaccgggtttaattgcatcctcggacgtacgagagaggttcaattattaattaagctcgtgtggcaatggcacgatctttctagatccaagaaacggcgacgaatttgacgagatgattaatagcaagattcctttcctttgtatagcacgatatataattaaaacatttgcttatggacaaaacccattgcttttgtcgcatgtcaattatttgtcatcagacgtgtttagttctgattctttcggaagcaattatgaagttatcccctcaaaagtcgtttgtttcgaccacgtttgcaatcagatacagccatgtagtagacatctggttacgagcaattttacgattttaaggggatactattttttttattataaatttagaatgtctcgatagttagatactataaggtactaaattacgtagaattgctctttggctatactgcctaaccgaacacaccgacggcagttgcagtaactgtgcaggcgaggtgtggagaccgaaggataaacaaagcgaactcgagattgagaccaccaagaccagcttttatcgaaaagaaagtatgaccctgtggccctgctagaccaattttcttccgttgaaatgacccaaaacagccgtaatttaataaaacgaaccggaaaaggataaaagaaatttaccacccctagaaaaataatataataatttacgataatgctcttcgtcggtcgaccgacgggggagaaaaaaatcgagcgctgtcccgcggctccgcccccgctactgttgggccccaccacattacctgcccccacctgcaacaaatcaaccacatattttgtaaaccctctattaagggaatttggtttactttttgttgcactaaaaatgtttcacctaatgtactcgcaatgtttcactatgtatagatctaatgttgcagtgaacgaaacatttcattgcaataaaataacccacatattttgaaaccccctattaagggaatttggtttattttttgttccaccaaaaaaatgtttcatctagtgtattcacaatgtttcactatgtatatatctaatgttgcagtgaactgaaacattatttcgctatttgctgaaacattgttttttatataaggtgaaacaacacctgatttaaacgagtgaaacattttcgatctactcagtgaaacaattccgatatacctggtggaacatcgtgaaacatttaaaaataattcaataataagttaaaaaaattcgtcggaatatatctatgtgtggtcttgttttaaagatttaatcgcaacgaatttaatggtccaatcggatcatgatttggataagtaatttaagacaaaaatcagtttaaagtagttttgcacgtaaatcg

SEQ ID NO: 13541 - DNA, 46254 bp, Oryza sativa
gggcctagattatcacccgtcacggatgactctcatctctaacgggcctagattatagcccgtcacagatgagtataatccacgaaaaaataaattttgttttttggttagccttgtgtgccttcccggtcggtcacccatttgaacctcacttgtgtgccttcccgataggtcacccatcggccaagttatttggagattggcttccgagaaagaaattgtaatttgttggtatgagtattctattaataatattaaaccctgggcctggatgtcacaccctagcatcccctattcatatacattcattcacataacatctattttgatcacatatttcaccagcaaatccaagttaattggatcaaatatatatttagcaagtattatcatgagaaggaggcaaatcagacttctaggaaaaaataaatttcgaattcaattttatgatactaaatgaaactcatatgaaaaaactatcaaaaacaaagttgtagaactcattgagatctaccatttttattttggtcatttctccatccgggtttgattgaactatataaaatttgtattttaaaatataagaaattcaaatatttttttgatagtaaatgatttcaaatggaaaaatcatcaacaacaaagttgtataacatctataacttttactttggcattttttctatataacattttttgaacagcttgaatttgaatttagaaatatgacaacttcaaataatattttcaactactaaatgatttcaactgaaaaagtcatcaacaacaaaattgtataactcatcagtgtctataacttttattttatttatttttctatacaacattttttttaacagtttgaatttgaatttaaaaatatgacaacttcaaacaatattttcaaatactaaatgatttcaattgaaaaagtcatcaacaacaaaattgtataactcatcaagatctataacttttattttggtcattttttcatccgacaaagtgatagtaaaattgttaacaaaattcacatatctctcatctagtttataaactataaaacatgtatgtaaattttgtgaacaatgttactagcactttatcggatgaagaaatgacaaacattaaagttatagatcttgttgagttatacaactttgttgttgatggcttttttagttgaaatcatttagtatatgaaaatattgtttgaagttgtcatattttcaaattcaaattcaaactgttcaagaaaacgttatatagaaaaatgacaaaaataaaacttatagatcttgatgagttatgcaactttgttgttgatgacttttttagttgaaatcatttagtatatgaaaatattgtttgaagttgtcatattttcaaattcaaattcaaactgttaaaaaaaacgttatatagaaaaatgaccaaaataaaagttatagatctcgatgagttatacaactttgttggtgatgacttttttagtttaaatcatttagtatttgaaaatgttgttttgaagttgtcatattttttaaattcaaattcaaactgttcaaaaaaaaattttatatagaaaaataaccaaaataaaaatagaagttgtaaatattggtatgttatgtaactttgttggtgataatttttttcatttgaaatcatttagtatttaaaaatattgtttgaagttgtcatattttcaaattcaaactcaagctgttcagaaaaaaagttatataaaaaaatgacctaagtaaaagttatctctaacgggcattaacaaaagcccgataccgatatgaatcatcggtgacgggctttaaagtcatctcaatcgggccatatttggagcccgtcaccgatgaccctcatatctgatgggctcggtgtctaggccctattgagatatgcgaggtcatctcaatcgggcctaaatctttgcccgtcaaagatgagtgttatcagtgacgggctatatgtacttgggcttagagtgagtacagatataattgagcccgtcacagatataattgagatgacttcgttctgacggcccaagtagtacagatataattgagcccgtcacagatgataggatctgtactagtgattacacagggctttccgtaagattttaataagataggggttgtgatgatggtttctgtcttttatagcgtgtgttaggagatacattcatgagatgtgaatgtcatgttgcgtgtatattggtatgtgcatgtgtctcctgtatatagaaagaaaaaaagaaaaaagaagttatggctgttagttagcatgaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacatggtatcagagcgttgatcaattccctaagagatcaatactcatggccttgtcgtccagtacggctgccacaaatccgttccaaggccacccaatctcagagaagcttgggagggcaaatcatgcgctctggaaggtgcaagtaagcgccgcagtcagaggagcgcggcttcaggggcatctcaccggcgcaaccaagcggccgccggcagagatcgctgtcacaaaagatggcgccaccaagaaggagccgaacccagcccatgaagactgggaagccaccgaccagcaagttctggggtaccttctctcgtcgctgacaagagaggtgctgatgcaagtcgctacatgcgacaccgcggctgaagtgtggagcgccattgagcagatgtactccacccacacacgagcaagagcgattaacactcggtttgctctcaccaatacaaagaaaggtaacatgtcaactcctgagtattttgcaaaaatgaaatccttaggagatgagatggctactgccggaggtcgcccaatcgatgaagaggagctgattcagtatatcatcaccggccttggcgagggctacagcgaggtggtgtcggctgtctacgctcgggttgaaccaatctctgtgagtgatctgtactctcaagtgttgaactttgaagctcgccaagccatctaccgcggcgcacaggaggtcaccgtcaatgttgtcaaccgtggaggcttcagccacggggggcgtggcaacagcaatggtggccaaggaggttcgcgcggcggcggcgacggcggcggccatggtcgcggcaacggaggaggtggccgtggtcgaggccgcacaccaggaggcgttgataaaagaccaatttgccaagtgtgtttcaaacgggggcacacggcagcagattgttggtataggtacgacgaggattacgttcctgacgccaagcatgttgcagctgcagcggttaactcctatggaattgacacaaattggtacatcgacactggtgctacagatcatgtcacgggagagctagacaagctcactatgaaggaaaaatacaacggtggtgaacaaatccacacagcaagtggtgcaggtatggatattagtcatattggtcatgctattgttcataatcccaatagtcgtaatatccaccttagaaatgttttatatgtgcctcaagctaagaaaaatcttgtttcagtacatcgcttagttaatgataactctgcctttcttgaattacatcgtgattatttctttcttaaggatcaaatcaccaggaaaactctccttaagggaagatcatggcgcaggctatatcctctaccacactcctccttgaagcaagcctacagtgccatcaaactatctttggaccggtggcatcatcgtcttggtcatccttccattaccacggttaaacaagtagtcaataagtttagcctcccctgttcagatttgtctagtgagtcagtttgtaatgcttgtcaacaagcaaagagtcatcaattaccttttcctatttcttccagtgtttccaaacaccccttagaacttgtcttttctgatgtttggggacctgctccagagtctgttgggagaaaaaaatattatgttagttttattgatgattttagtaaatttacttggatttatctcatacaacataagtctcaagtgtttgacaagtttcaggagtttcaagtcatggtagaacgtcaatttgatagaaaaattctagccatgcaaactgactggggaggcgaatatcaatcccttaactcttttttttctaagattggcattgttcatcatgtttcctgtcctcatactcaccaacagaatgggtcggctgagagaaaacatcgtcatatagttgagatcggtttatctctcctatctcatgcattcatgccattaaagttttgggatgaagcctttcaggcggcaacttatcttattaaccgtgtgcctagcagagttatccataatattagtccccttgaaaaactgttcaaacaaaaacccgattactcctccttgagaatttttggttgtgcctgttggcctaatcttcgcccctacaataaccacaaattacaatttcgctctaagcattgtgtttttcttgggtttagcactatgcataaagggttcaagtgtcttgaggtctctacaggacgcatctatatttctcgcgatgttgtctttgatgagaatatttttcccttcactgaacttcatgccaatgctggtgcccgtcttcgttctgagattgatattctcactcctgaactgctaggacccatacggtctgttgggaatgaacaatgcatgcatccagtgactaatccattatctgctgatgtttctgctgctttatctaatcgtgctaatgagccacatagagatggtgcagtacatcccgctgatgcagaagatccgccggcgacgcctcctctggatgccagttctggtccagaaccagaccgtgtcgtccaccactcccctgcggccacgtcatcaggccgtcatccgggtcccacacctggttctgtgccacggggggcagcatcatcgctagcagaggagacagcagaagactcagtgtcgcaggcggtgcaggagcaggagtcgcaggtggtgcaggagcaggagcagtcctcaccagcgcaggaacatgcacaggctgtcacagatgagactaatacattacagcatgcagatgtgactgacacaggttcagaggcaccggcaggaccgcgcaccaggttgcaaagtggagttcgcaaggaaaaggtatatactgatggtactattaaatataagcattcttggtttactgcttcaggtgaacctacaaatgatttagaagccttaaaggataaaaattggaaactagcaatggattcagagtatgatgctttagttaagaataaaacttggcatcttgttcctcctcagagagggagaaatattattggctgtaagtgggtgtataaaattaaaaggaaagctgatggtaccctagataggtataaggcaaggttagtagcaaaaggatttaaacagaggtatggtattgattatgaagatacctttagccctgttgttaaagctgccactatcagaataatattgtctttagcagtgtctaaaggttggagtcttagacagctagatgttcaaaatgcctttctgcatgggtacctagaagaagaagtttatatgctacagccaccaggttttgaggatcctactaagccacatcatgtgtgtaaacttgataaagctctgtatgggttaaaacaggcacctagagcctggttctctagactaagtaaaaagttgatggaccttggttttaaaggatcaaaagctgatacgtctctgttctttctgaataaaggtgatataactatgtttgttctggtatatgttgatgatatcattgtagccagctcttcagagagggccactgcagctttacttcaggatctaaaaggggaatttgcactcaaagatcttggtgagctgcattattttctcggaatagaggtaagcaaggttcagaatggcattgtactgaatcaagacaagtatgccaatgatttattgaagaaagtgggcatgatagattgtaaacctgctaatacacctctttcagtaagtgagaaactctctcttcatgaaggctcattgttagggcctgaagatgcaagtcactatcgcagtgttgttggtgctttgcaatatttgactcttactagacctgacatagctttctctgttaataaagtttgccaatacttgcatgctcccacaactgtacattggattgctgtgaaaaggattcttaggtacttaaagcaatgcactcggttaggacttgaaattcataagtcaggatctactttagttagtggcttctctgatgcagactgggcaggctgtttagatgacagaagatcaacaggaggatttgcaatatttctgggttcaaatctggtctcctggaatgctagaaaacaagccactgtgtctagatctagcacagagtcagaatacaaagctattgccaatgccactgcagaaataatgtgggtgcagactttacttgcagagttagagattaaaagtccaaaagctgctaaaatatggtgtgataatcttggagctaagtatttgtcagctaatccagtgtttcatgccagaacgaaacacatagaagttgactatcactttgtcagagaacgggtaagtcagaaacttctagaaattgattttgtttccactaatgatcaagttgcagatggattcactaaacctctgtcagtaagactcctggagaatttcaaaagcaatctgaacctggttaggtccggattgagagagggtgttagttagcaagaaaggttcggatcatgtgatcacgacctgacagcttgcatgcatgtagttgttgaggttagtttggattaggttagtctatccatgcggatcaggttagcctttcctccacatgcgataacagatgtttgttagagtttgttttctgttttctgttactgcatgcagtcgtttcatcaatctcggcttcggttgttctcagctgcgccgaactctgtatcgccacgatgggggctgttcccatcacatatatattaacacgaaggcgacgcacaggattagtgcgatcgtttccacccaaactaattcacaatggccaaaggtgatcgatcattggtgctgtgttagcgacccgtggaggcggccggccagaatctcagaaataatcgacagcggcacggcattcaacaagatgagaactacccccaacaagtctatccaacgatgtccagtttcgattcaagcgtacgtatagcaggacgatcagtctgcatcctcggacgtacgagagcgatatgatgacgcgtcatcgagaggttctcgtgtggcaatggcacgatctagctagatccaagaaattggcggcgaatttggctggaggattcagctgtgtttggtgtcgctagctacctaccgtgggacccaagggaagacggtagtggcatccaagttccggcgcgacgagattttagtgctcggcgccgccggatgtgggtcaggatgtaacattatcccctaacgtctgtaccgccctctagcattctatactgtactgctaatcccattaattagaattatttcagaaccaaataacatgcagaaaagtatcgatcatcgatcatatcactcataaaagaatacattatttaacggaattttatggtaaatcatgtgcgaagaggtaatttatatttaatcgtattctcatcatatgtaagaggaaacataggggctgctaattcgtgcagccgcacgtcgaacttaactcgcgtatgcagtaccccggaggggatagaacttgagatccactgtttttatttataatctcttctttactattaaaaaaattgaggatgttttcgtaaaaaaattggtacgtcatcagtgttagtgttggttttttaattagttttagtcacctgtatccaattcatcttatatgcaggttatctttagggtaacgtattagctccggttctagccttagatacaaaagtgtgatgaggacaccgagctaaaactagatatcacattgttaagtcgatggtcttgcagtttttggccaattatggttggaggtttacaaataggattcaataattaaagggtctttatgttttgtgggcttttattagcttgtcgttgctttaggttttttcggtgtgctttttaagacttgtttatgtgctcttttctagcgcgagcttatgtaataattggttgtagctcgttgatcaaatgtcggcactctattgcattataaaaaaaaaagacaccccttcccagcccaacccctccccctccatctctcagcccaacccaactgacccatatcatcccaccacaccgtcccgcatgcctccactcggcgccgtgcacccctacctcgacaacgtcttctttctctcctttttttttctatttctccttttccttttttccaattatcatgtcctctccctctcctacaaatatcctctctttcctcctccttttatctttttcctctttttttctctcccaaaattttctcccacgaatattttccttttgaaattattattaagttgtgtatgcagaaagtttgttgctttgcaaatgctttccatctacatgtaaaaagaatttcactaatttgaataatcaaaatctcaatctttagtcgataacgtactgcaaaatacacatgtatcaacttatggaatagcgacccgatcgattttttaggctatggaaatgtgtagataagggatttcttttgtgtgatgatgcatgaagcaagtgcaaccgggttcaatactatatatggtttctggctttgctttacctttattttgtttatcttgtttcgggtttgtcgtttaaactggtagagtttttatcaatcatgaaaattatgttcacttgttgcaacgcacaagcatttttgctaatctgaattaaaatttcaactaagtgtaaaaaacctttcgatctgaaatatgaaacttccaactaaaatctcaaaacattcatctaaaaaatggcaaaatttttaattaaaaatataaaacctttaaacttgtgggctataactaccgattcattctttctaaaaaaacttatcaattgaaaaattcaaaagtttctacccaaaatcctaaactttcaaatcaaaattatttcaatttgaaatgtttcaactgaaaactttatactcaaatcagtggaagtttctagggatactcctatctggatcagataaagaggaggaaaaaaaagaggcacttacatgtcactcggaaggatgagcctacggttgtaagcatctcttcgtgtcgtggtagaggaagagggggtagggtgaatcagcatgctaggtaggaggtcatcgaaacacaaaagtctaggcttacatgtatgccgtggtggaggaggcggggtagggtgaagcaaagtgttgctgaagagatgaaaaagatatgtgctgcatgccaccaggatgctattagctcgccatcgtctagttcaagagaaggtagaggggtaagtaggtggtgcccaagctagttgcgtcaccggccgggaggtgacaaagcgagaaccgtagaaggaagaaaagaatcacaggaggaaccatggatgaaagggatcgagcgatggggggaaaggataagtggataaggcttgcactaattccgttgctaggtaacgtgcacaaagtaggattcctgaagaaacatagctggtaatcgaggcagcgatactttggcgtgatcaacaagttcacacttacatatattctttcttatggtgaaacaaataaggttccatccttaaatgttaaaaaaaagaatgttttggtttaaattcttaccattcttaccaatatgaaataatgtatgctttggtttaaattcataccaatgtgaaattagacaatataatgtatataagcacaattatgcatctagattaatcaaaaaaataaaaaacaaagaaaatcaataattgaaattcacttgtataaaagatgttggttttgctatagggaaatgatgtatgtcccacatccgacacgggaacaaaaataagacgtgaccctccactacatttccgcacttcccgtggtgcctcaattcatacaagtgagacaatatacgttgtgtgtgggcagatctcatccaccatggcgacaaatcaagcaagtcctctcgtatcgtgacgatttgatttctctcattatggaggtctactttgctgccaatgatctccgtctggccacacgtgaggtgatgccagaggaagaaggcggatccattcaccatagtggaggaagaaggcggatataaccactgtataggaagaagacggatccaatcattgaaatagaggaagacgacgcatgatgggctttgttgtaggccataatttattcattttgcactttgctgtatttgaacatttcaccatcctctgcgggaacggtagccgacactatctcgcccgccgccgacgcagatgatgcttgatatgttgtgggaatggccgttgacatcgcccctgccgccgctgacgttgccccgcacaccagcaatgccaccccgcatgccaccgatgccggatccaccatggacaccatcccgcttaccaccaacactacctcacacaccacagacgccagatccaacgtagacatcatcccatatgcgaccgatgttggatccaccgcagatgttgccccgcttgccagcgacgctggatccgtgctaggagccgccgtcgctgcttcccgaccgccactgatgccgcctcgcatgccacagatgtctgatccgtcaccgattctatcttacacgccaccgatgctggatccactgctgacgccgccccgcttgccaacaacgccagatccatgcttggagccaccgcttacgccgcccaaccgttgttgacgccatagaggggaggaggagggtaggggagagagagagagagagctgtggataggggaggtggagggaccgcggagacgggagatggaggggaggagaggctgagggggtgagggggagagagagagatgggcgagtgtggggcttatccacttgcccccctctctcagccgctttgcgctaaaaaagttcagactaggctcccggctcggctgccagttttagctattccaacacctatagtgccgatctatacgtgtctttttcttagtagtgtacaactatgtaccgcaggtctacgtaccatcaatatgagtgccacctcagataattttcgtttatgtgcactatttttgccttggttcgcacggaccagagataagttgctacaccaaaactaaatattattttatctatttgaccttaccaaatattttgcaccgtgagagtaatttatgcatttatacattttggtccatcaattttttataatatccatatctgcaaacgaacaaaaagatggagacatggaatactttggcattattattgtcttacttacgcgcttgatttgaattcaacttacgtggacatccacccatttaattatatcaactaaacagctatgaacaaaattatatgaaatatgtcactttcacaaacatagaaatttgaattgaacttctacaagatgttacaaaaatgacagattaaattctaattagtatacacatatttacagttaaatttattatttttgttacaacttgtagaatttgaatttgatctagcatatttgtgaagtgatatacttcatattaatctatcttgtcaatttcttcgaaactttttaataaccattgggactatctaaaatgtcaccacaagtattttgaagtggaaaactttcaaatgtactacagtatagtatagttgtaatataattatatcataactatactataactttaatataacctatatataaatgttacaaaaaatatatgcaactttgttcctaagttataagttatatagagattccaatgcaactttatattgtattacactacaagtagttgcatttgatttggaagtattttgaaaaaaaaatactacagatttttcactactacagaatcatatcatctatctatcttctgattctttagataccatcttattaactcgacattgatagggtttgagaacatgtgcttcatgcgatctttcattggcaggtaccacatcaccatggccaaaatctttctctttgtatccaccaacaaaactgggtcgacaacatcactatcagaggccccgttacccttttgtaccgactcgtcccacaagttgggcacatgtccaagtcagtgtattccttgtagtatagtatagtgattaacacatgcatggatttttttgaacacctagagataatggaaaatcagtttcttcgcttgatacgtgttgaatggcaacaagttaggcttaggaaccataactctcaatagacccatcaaatcgttgaaactagtattagaccatccgtgtctagctttcaatctgagaagctctagcacataacatagcaccatataatccttatcacatgtcttggattcgtcgtaaagaagatccttcgctcatttataaaacacctcccaattgtctaaccattgcattgtaccagttagaacctctggttcagcatggcataacatatcctctaaatcaaaatcagcatctaaatcatcaatatccgagccaccaaattcatcaaccatatcacgggacatgtcctctattgtaaaattttctgccccatcgaaggaaatatatatcaagagtctctttaggaatggcaacttcctcgtgatatgtccatatcttgtaatcatccttaatccacacttcactatgtgcttcaaaattatcttcggatctttcaacattttctgattcttgcaatcaaagcacggacagaaaaatatccctcttattctccctcggggcatatgccttgcctgatcagtaaattttgatgcttccttcatgaacgccggatgagttatccacgtctcgtacatccatgcccaatcaatttataaataattacagtacgaataaaattttagtgcatgtgtttctcacacatcatggaaaaacaaatatctcctaaaaatttaaactacaatacattgaagcatcaagaactagtgattagaataaaaattttggtcatctaaacaatatatttgcactaaatatagcaaaatagtttttaaaattccattaaaaaaactataaaaattgtcacatttcaccaataaactgagaaataaaaggcggcaaatgaaagaggaaatgaagcatgtaactttttatatggattgcaagcaaatatttcgagttgaaaaacctccccctatttatatcttcgttttagagagagaaacatcgctttcaaatggcggcaacttaggctaggagaagatatatggtccataatcacctacaagtatcttaattaagggagcgcatgcgaagatcgattattgcatgcggtcgcttaagaaggtcgcatgagatttggccgcgttatcgcgtgcgggcctcttaagcgaccgctgatgataatcggtcttcgcttgcgaaatccctaatacaaggatatctgcgcgccgcctctcccgtgcggcgcagctatgtggcgtgcatgcagagggcggcggtggaacggcgcgggggaggggcgcaagtggtagcctggttcaggtgttttcatttttttaggttttttctgttttgtcgtttttctttcggtatttttggttttttttctttttttgttttttaatatttatgtatataaagtttgtatacatacatatgtatacgaactatatatggtgtatttttttcatttatacaaagttagtatacatatgtatgcaaactttgtatacatgtgtatataaaatttttatatgcatatatacaatttagtatacatttttatacgtcaatgtgtgtgtgtatatatatatatagtgtatgtatatatatatgtatatactttgtatacatatgtataacattcgtattatctacatacgtagatacgtaagaggctaaagggaggaggtgcgccgcgcgggtgcaaccgctcgcggctgaccgcacttcagccaccccccttgacgtgtggtaggtcaacccgttcctggggattggttttttgcaggtgcagccacttatggcccaccggcgatctaatggatgctcatgcaagaaaatcatttatataatagtgtttagcaatttcataactatttaattagtacttaataaacaattatcaggtggacgtcaaacagctaattacaattccactcccactacaacggcacatgcactgaatgcaccgtgccctcgtcgtttgtccctgcaaggctgaacacgtagccacggccgcgctcgtccctgaccctgagcttaattaactccgaggtgtacgtggttcttctcgccaccgttgatggagctgccgatatctttggtgccacgctttgccctcggtcgccggacttccaagactaccctcgacgacgtagatcgccatgatgacgctccgacgccgcagcggcgccggcggcacacctccgacgacacgctcgtcgtccacgccggggagcggcggcgcgcgcgcgatcggcggcgtcgcggcggaggtgacggactactcgatcgcgacgccgatcgtgaccggcacggcgcgctggttccgcgactcggccgacctcgtcgccttcagggaaggcggcgggcggcggcggcggcggcggcacagcttcgagtacgcccgttacggcaaccccaccgtggaggtcctggaggacaagatcagcgccatggagaaggccgaggcgacgatcgtcacctcctccggcatgaacgcgatcgttgcgacgctgctggccgtcgtcccgccgggcggccacgtcgtcgccaccaccgactgctacagcgaggcgcgtgccttcatacgtgacaggctctccaaaatgggcattagggtaagctatattaatagagatttgctccgatccaacaaaaagtattttgagatatggtaccaaattgtttctgatcgttggatctaacaatacccatcctacccagctagatccaacattgagaaacgatttaataccgtacggtaccggtacctcgagatattttttgttggaccagagtaaatctcatattaatatacacgcaccattgcaatatatagctcctactatgacattaatttgcagattgaatgatgtcgattgtttcattaatttgcagacgacgttcgtcgatctggacgacatggaggcgttgcaatccgttcttgatcagggcaatgtacgtgacacacgaacccccgatattccgatgcacagacacacacacatggataaaatattctaacgatcgagaatgtacatgtgtgcaggtaacgatgttctacgcggactcgctgacgaaccctcacctcaagtgcgtggacgtgcggcgcgtcgcggagctgtgccaccagcggggcgctctggtgtgcatcgacagcacgctggcgtcgcccatcaaccagaagccgctcaccctcggcgccgacgtcgtcctccactcccatcaccaagtacatcgcaggccaccacgacgtgatcgccggctgcgtcagcggctcggaggagctcatctcgcgcatacgcgtgtggcaccacgaccttggcggcgccatcagtccagtaaccctttggctagctttcttgttttaagaggattgggaaccttcccccttggtacatataacggagcggttgattattacatcgttaattaagaattaactaaaacttaaaaagtgtattcactactatgcaaaaggtgattggtgccggttgggaaaccccatgggtgacggattttacaaccggtatgggtgttggatttcttaactggcacccggtagacatcacgtatgtttgagtcctcctcaaaggtgtcggtttaggaactggcaccttaaggttccataatgcaaaaaaaaaatacatctcgattcaagctaatgcatcgagcagttccacatcactcgcaaagcagcccacattcaataacatcacccacacaaatcacaaaaattctaatgattcatcaatattgatccatcaaccaacaacattgaccgcaaaaatcacaaaaattaattaacaaaacactgggaagtcgctgacaccatcgtcaccaccaggtctgcccgcggaaggctatggacaccgctgtcgccgccagatcttgagggtgaggagtacgccgcagccgctcacgatgggggagggtgctgctgccgccgctcacagtggggcagtgcggccgtcgacgctggagagagaggagcttggcccagtttttagaggtgtcggtacctataatatattatagctattggtttttttaaataattggcacatataataaattagaggtggaacaaaaccggtacctatatattattgatgtcggtttttctctaaaactgacatctatttcttcataaaggtgccggtttattttgctgtgggcgctcatgtggacaagaaaaatagtaatatttttaatccaagacaaatatattatgaaaatttattcaattaaatttaatgaaactatactggtgatgtaaatattactactattttctaccgaattagtcaaacttagagtagtttaactttaaataaagtcaaaacgccttacaacttgaaacggggggagcaatacctaaccgttttgttacagttcacttatatactgttacaacaacaaacatattttttttttcagaatgcagcgtacatgatcattcgcggtctaaagacgatggcgctgcgggtggaggcgcagaaccggacggcgctgcgggtggcacggctgctggagaggcaccccaaggtggagcgtgtcaactacccgtggctggagagcagcccgtggcacggcgtcgcgaggaagcagatgaccggcgccggcggcgtgatcagcttcgaggtggcgtcggacatgcgcggggcgatgaggttcgtcgacgcgctggagttgcccttcatcgcgacttcgctcggcgggtgcgagagcctagtgcagcagccggccatcatgtcctactggtatgcacccttgtttgtgttttattaagttgacaacagtaaatattactccctttccaaatttatcatcatataatagaaaacaatattttttaaattgatcatcatataaccacatggacatagattttatcataatacaagtaatgcagcatgagagaatgtgtgcatgctaaggtataattggtatgatgttttaatcgacacatgcattgtgggagaatatgtgcatggtgtcttgattgaggtgatttttttagtcttggtgtataaacatatatgatgatcgatcattttggaaaggatggagtaattaactgctcgctcaatttcatacatttaacggatttaatctggtgcacgcacgtaacatgtgttaattaatgttggcataattagttcgtgcttaattttactaggggcaagagtgaagcggagaagaccgagaatgggatcaaggataaccttgtgaggtttagttttgggatcgaaaagtttgaggacctcaaggacgacatactacaagccctagagaagatttaattattagggctaactataggcgttgcatcttgttttcgtcttttcgatcactatatttatctatgtttggacaataaaaagtagacgctccagtatacaatcgtatacaagatgagtatggacagaaacaatgaatgatatggaaactcagattttatttattccaaggattttacaagctcctctttttttacacaaaatgttggtgtggcactaagacacttcataaatatgaatccaaccagttgacaattaactgcgataagttcttcatcatcatatttacaggttttcccatataaaaaatatatgataattaagttgatagtagctcgcctgaaagttcgagtcatccaaccaaagtttccgacaccaccggagtagtgccaatcgctcccactgccatcaatccgaacaccacatctagtcctcacagtattgattgcaacccatctaatggtacagatcgccacctgaagacccaccaattaaacttcgttgatcatcaccttgttccaccttgtgccagtcctatctcagacacatatgtaacctggtgtggtgtggggcacctccctcgtacctctacctgggatctcccgcaagctctaatacagcttgttataagacgcagcctagatatatatcttgaaaaccgacactatagaaaattcaaatttaatgaacacacagaagcacgatatttgttaacgatgtccagctgaaacctacatcactgggacattgattatggacgctcctccccaatccaacataattacaacgtatcaaagttacgttacaacaaccctcagtcggacaaccacatcagtcgttccctcttgcaacagttgtggtcggtcggcgtagacgatgcgacgatgtctaggggtggtgaggacggttggggccggcgagggcacggattggtggtggatggggagagcacgcttggcggcgatggaaggggaacagtgaaggatataggaagttaggtttggttgattagggttcagcttttacatggttctatcaatttcaccaccaaaatagatcagccgggtctttaaatggattgtcttcatagtggtttctcatagctccgggggcctgctgggagacctgcgggtccattctctcccccgtcctcgctcacccgcaggtaggaattcccacctgccccctctcccgttggggacgaggaccaaccctaatgaggaaatagccacccatagggctaggccatatcattattcttcgatgcatcgtggcgttcatcattcctttgtacagttctttttaattaatgaaaattaccgtggggcttccctcactgtttcctggtaaaaaaatgaagataaagttatggaactgtatatatatgataaatttatgaatgatttttatcgtatatgcttcatttgcgatgttttttctacctgcaattccaaatgatgatgtgataattcacctgcgaagatgtagctagagaggagatcatatattagggatctatatacagttgtattatatattgtcgtcatatgtttttcttagtttgttcaacttattattaatgctattgactagtctatgatccccgggaccattttgcctggatccgctagttaacgttgcatgttaccaaattttcagtgggaaaaccactcttgaacaaatggtagctgattagttttgcaatggcaattatgcatagcggctcattcacgatttcatgtataactggtaaaaatgacataatggtcttacacggtataattatttggatatatatgttgaagttcattttgcaaattaacctatagatacttgccgaggcaaatcaatatagccaagtaaccaaacaccatatatagctaaccaatggagaaacaatccatttagctagagttttacagaatatgagcattatgcaatattgcaaatggttgaaaggagggaaacaaaaccacacaagtgttcttattacgatatatgtcaccatattgtgtttgatctctttaaaagcatctcgtaattaagagagaggacattcatggaccacacgtgctactatattttcttcaaggacatgacgatgacggcatactttgtcttctccctctcaaggtgttgggccacaaggggtctaaactcttgaaacaacacgtcaagtatgctttctccaaaatgacttgctatcaaagactccagcacagatctaatgcccgtagtgatatttggctactgctggcaatgtcatgaacaacgtcatctactgaatcgtcataaggatcccagtttgcctcaaagagtttcatgtgaaccaagtcaaacatatggctttccataactatttccattacttcgtcatctgatggcccatagataggtaggttgaaggattccaacttttccttgttcacaaggccctatatgatcaatcaatggttaattctgactagcacatctcttcttagaatgttaattagcgatatctctactcttaccttgcaaacaagtgattctagtgactttgcgacacatcccaaaatatggctgagacttccattgtatacatcctcatccttccgtccaaaaaatattagcaccatgtgtccatcgtttactagttcttcatggcggagcttgaggaaaagggaaaagtcctttcgaaactgttctttgaataatttcactactaatggtgttgtggtggagctgatgtatatgttgtccttatttgagagagattttccaccagcctctagtccctctggcacctatatgtacacatcacttaatttagaaaatttcacagctcaagttagctacaaattaaaagcaatatcacatgtatgcaagattggtacacatcatgtatatacgtcagatatatgcaataatgcataaacaactttgggaaacatatcctatgcacacaagtttcccatacacaccaactagcaaatgtcgaaaaaatagacatgtactcctaataggatgacacatatatgcaaagtgacaaagtctcatattcaaattcattatattttagctgtaacaaaaaagtgaaaaatctaacaattttcagagtacaaagctgttagaattttctctatttttttacagctaaaatataataaatttgaagataagatttcacatataggtgcaatactattgaaagtatgtgccgaatttttcatataattttctgtgatatttgttagttgctgtgtatggagtgtattacgggaaacttgtgtgtataggatatgttcccaacaacatttttatatcaataatcgtacctgggagcgccaatgaagacaatacgaggagtggaagagatgaacactctgacgagggaaaagtctagagtaatatgattttggcaaaccggatatgtagtatgatggaagcgaatctcccttgtgatacatcgtagttgaggtcttgatcttttcgagtgatcgaaagagttggttgaaatcattacctggtaagtcatttaggaagaactgaagttcgataggatcatgttcatccaacttagtacagtggtctgctatgatgttgatgacattggacatgaagaacatcgtatttggtcctgcagagcaacctaagtctgcaatgaccatagttttggggagaatagccttgtacacttctattatagctttctcgatgactggcttagtttcatctataacaattgtctagcaatgagcagaaaagaaaattttgagctcttaatcatgatatagacacgttatatggtgttatacaatgtcgacctatgtctaatgcatgtatatcttgtatagtatgtagatgctaggttaatattatcaataactgacagatatatccattcttctaaacaaatttctccagtactacgaatagttatggctaattgttaattgcagcacatatatattttctgtgaggataattaattaagagacgacagagattcgtgcttttcagcagaaaagaagatgcagagaaaataattattatacgaggaaaagctaattgttatatatatttgataaatcacaataaacataatttaccaaggtaaaccaaacacgtcatgatgttgttatttgtacacatatatgtaacctggcagccaaaaaataaaataaaacgaagagcaatataatcacctgacgcctggagtacttggcatagctaccttctccttccccactggtcatgtgtaaatcgccttcgatattgaccatggcttgtcttggattattagatatgtgggtctttgagtagcaacaataagcacaatattaatgcaactcaagtgtgggtactctctccattgcgaggtgccatcatatatagaccatcaccaagacatgtaccagcagtactatacatatgccagctagctagaagccagaatatctaaaattgtgcaagagaaatctgtgccaacccacaagctaacactggtacagtcgtacagaaagcaggtgtaactactggagtagtacgtactaaattagtttcgctggcggtgaaaacgaattttcatagacaagtaaacagaccacacggaaccaaaggcctaagaaacatcgatcttcacagacgggaaacacgcagcacaaatcaagatgtggattggggtcttcagctgcttcgaagctagtccgaaggagagagcgaggtaatccctccgtttcaaaatataagaatttttagcacagtgacgtatcaaacattttcaactttgactattaaaaagaacaaaaataaaaaagatcacgtggagattatgggtaccccatacccacagggcatagttatccgactagttatagaggataacttatatctatggaatatgtacggatcatgacttgggtattacatttccttgtatattacggaacagtctaaagtcctggtttgataatattgtaaagtaggtttagaaaatcgataccgtattggttaaggtttctatctcgtaataatcctgcccctcatcctatataaggcggataggaggtcctctagggtagaggattcacaattagatcgtcggatcaatattacacccggcggattcaaatccccgaatagtagtagggtattaactctcgttaagagggcctaaacctgtctaaatccttgtttctgcatccatccacttgtaggtctcatgcgctaccccgtttatattgccgaaatctagtttcgacagatcaatcatgtaaaattaatgttactagatttatcattaaacaaactatcataatgtgtaactatttttatttaaaacatcttacttttatatattattggtaaaagtagcatcttggaaaccgtatcagagtccaaaaaatgcttatattttagaatggagggagtagacaatagccaacatgaaggcgaggatgaggcagagtcagtttttggacggatggaatgcgaggacccaccatgccagtagaggccactagcttcccaacatgctggcaatgatctgcctctcagctcgccggcggcgaatccgtcactcccaagccttgtggcggccgatccacctctagtgatcagcttatcagcgttggatctagaattagcgcaagactaggcttcatcaaagcaccaagccatcactatcgcagtcccagggtgtgttcggaacttctagttcccaacccctctccctcattttccacgcacacgcttttcaaactgctaaatggtgtattttttgcaaaaagtttatatacgaaagttgttttaaaaaatcaaattaatccatttattaaaaaattagctaatacttaatcaatcatgtgctaatggacagctctatttttcgtgctaccggacacagcccccgtcaccatctctgtcacaaatagtactgcaacaagatagagaagctggagggatgtaggtgaggaaagggagggtctaggctggattcagagaagagttggtaaccctcctcctcttcggcacgtataacgaataactcattaccatataattaattaagtattaatttaaaataaattaatataatttttaaagcaactttcctatataaattttttttaaaagacacacagtttagtagtttgggaagtgcgcgcacgaaaaacgagagagatgagttgggaaagtatgggaaatgctatgttcttttgttagagttgggaactctccgttcaaacatgcaaaaaagaacagtccattaacatgtgattaattaaatattagctatgttttttaaaaaataaatcaatatgattttctaaaacaattttttatatatttttttagaaaacataccatttagtagtttcacaagccggcacgtgaaaaacaaggaatgtgagttgagaaagctaacaaaaaggacttggggcggctatgtagacttggccatgaccactcgtttgttcgccatcaattaatatcaaccggcataataagtaccgccgtgcctgtcatgtcaccctctttgccttcccctctctctactcgtcttatcatatcatactgagcacgctgagcacatgaaatatttgacttaggtgcaatatcaattaagtattagctacgtatttttttgaaaatggatcaatatgattttttaaaacattttttatagaatttttttataaaaatataccgtttagtagtttcagaaacgtgaaaaacaagaaatgtgagttgagaaagctaattacaaaaaggacttgggcggctatgtggacatggccatggccactcgtttgttccatgttgcaatcagcttgccatgccatcaattaatgtcaactggcataataagtaccgctatacctgtcatgtcgccctctctgccttcccctctctccacttgtcttatcatatcaaactgaacacgctaagcacacgaaatatttaacttaggtgcaatatccatgtgcttcaaacaaatgtaagtttctgaaaaaatataaattcaagttaaaaatatttaaaagaaatatgtaaaaaaattaactttgaaaccgtttctctactacttcgaaaatacgaactttttctgtcggtggtccatcttggtcatttctatagcacaataggtttggctttgcgacattctggtccaactaggatttgacctgtatgacccataagagctatctgcatatgtttaaattcaccttgccaggcccgtcccggccccatcttcgaggggccacaaaggcccaataccccaagtacatgcgtgtgggcagctcaataaaaaattaaatcgactgctcatccgtctgtcgtttcgtcttccaatttttttgttgcctcttcgtctccttgatcgctcgtccgtctttctgccttaccggtggagtcgacgtgttacgtcgctgcttctggcctcctggtggcatatgttatttgatgataatgtttctcaattttggtgcataggttatttggtttatctactatgtggactaaattattttttttcttttcatgttgtatctatacgtgtataagtttatctagtattttaattttcaagccacatcgtctacaaatcagattacaaaatataacttcggtcgtgaaaagcgtaagaagaaaaaaaacaatagaagaaaggagctatgcaaatatattaaaaagaagatccatcaattattattattattattattattattattattattattattattattattattattattattattattattattattattattattatcaatttagtgattttgcacaggacccctgaattttacggcacggcctacagcttgctagtttagcaaggtttggaacaaacttataatgtttcttcccttcaaccatatgactccgggtttacccttctacacgaagcgagaagcaatttataaggtctcttgaagcaacttataaggcctcttccttacaaccatgttccaacttacaaggactcctccctccaaccatatcaccccaggtttaacccttttacacaaagtgaggaccaacttataaggcctctttcctccaaccatgtcactctcgggttaacccttttacacgaagcgaggacaaaagtataagcggagtggtatgtgtaagtgggcccgcccatcggatgggttggctacacagttctggaggaagggctgttataggcttcacctaaacgcaatatcatactacaaaacaatacaataggactttgaaaccgtatatatcttacgttgtttcgaaaaaaaactttatatattttacctactccctccatcctataatattgcatcctaggatccaatgtagtgtaacaaattgggagatacgaatgggacactacatattagaatgaacctaacatgaacatgcctcatgttcagattcgtcgtactatatagtgtcacatctgattttggattgacgtagggagtacttattaaaagatgagcaacatcacatcaatccgcttccgccaatttctccaagccaccacgcccgcgcaggcgcgcagtcaattcaccactgtgtgccatctccgaccttctaggcatatgcctctagcatgtcaagggaatgctaagagctaagggcttccccttaacctcccctctccatccctctttgcctccatggacgctgccatggaattcctctgctcgtcgctagctacatctcgttgtcaccggtcggtctctcccagtccttctccgcctaacaaacaaggaaaaagacaaagttgctgctattatttcccttgttcaaaattattggcggagtgatgaagccacgtgattaattcatctctccgcgctaatttactactatctctatcctaaattattataaggcagccacaattttcttaaaaaatcaacatttaccaactttaaagttaatagcttaactagtaatattttgtcatgcatgttgcatttttagatttatgtttggaattactttcatatggctagcaaatatgcatgtgtgttgaaacggaattgcattgaagaacacatcataggttcctagcccaattccacagagtaaagtaatgaaaaacaaaagagattagaatgcaacgcaccggtattttgttagtctatttctctactatctatctattctactgttttaaaagtgcaaaatgtttccatcgtccgaaaagaaagagagagagaaaaaccattccgatttaaaaaacaccggcgagaaaaaaaaaatccatctaaaaaggcattttttaaaaaagcgcccaaaaaagtaaaaatacaaaacgccgaaaaaaccgtctcaaatatggaatcagaaaacaattcggaaaaggaaggaaaaaacagaaaaaaaaaaaggcccgaacgccgtcagcaagaaaagcggcggaaaaaaaaagcgaaaaaaaagccaaagagaaaaaaacgccggccaaaatcttaatcttaactaattaaaatattcgtaattttcatttcgtcaccatccgtttagtcagtccacgtgatttttcgtccgtacgagtgcttaataaggcaaataaagccaaaaaaaaatacaaaatctaatcggacaatcaagcgattgagaaaaagaacaggaagaaaactaaaacatcactgggaagccgccaatgctgttgtcaccattggatccgaccacggggcgccactggagggagaatagagcccgcggagagagccgccgctgctggatcgccaccaccgatggatctacctgcggacgcaactgacgccgtcgtcgccgctgacaccgccgttgggagggcactgccggatcttgagggtggagagggcaccgttgtcgagatggagggacggccgtcgaggccgacgtggagaggtagagggggaggaacggccgtcgccgccatctctgccgcaccccactgtcgccgcgctgtgccggcgagacaggagggagagggggagactgagcagcgccgccggagggtagagggaggggagagggagcggcgccgctggaggggagaggggagaggcgacatcgggcggggggcgctgatacgcgactggtcgcgagcggagcaccgcgcgatcagctgccccccctctagtctatactactatacatactgctatatgtagtatagtatatactatatatacatacgtataaactttgtatacgtatgtatatatagtatatacatgcgcgtgtgtgtatataatttttttttgtatgtatacacttgtaatgtataaaaaatatacacatgtatataaagtttgtgtacgaacgtataaaaaatttaaaaaatacgtgtatacaaactttgtatacgtgcatataaactttgtatacatgtatacaaaattagtatacgtacgcataaaaacccaaaaatacatgtatacaaagtttgtatacgcatgtaaaaataagtttgtatatgcgtatataaagtttgtatctgtgtgtatacatagtttgtatatgtatatgttaaataccagaagtgcaaaaaaacataaaaaaacagaaagaaaaaaccggaacagaaaaccacaaaaaaggggaaagaaaaaaccagaaaaaggaaaaaatcacacacgtgtcagcgcctggtctctccgcgcgcgcaccgcgcggggtggcgggcgcgtgactattcgccgattagctttctcggcgtcgggcggggaggcggccgatggtgggaggggggatgggggatgggagagccggtcgggggaggggggagggttagtgttatggttttaattgatttggaaccgatccgagccgtccatcaaaacgaacagctcagatcgatcgatcgtgttgggctggcctgcatcaccggaccgcaccacatttctggttacggctcacatggcaagtgaaaggaggaatatgaggatattaattagactttggtcgcttgctggctgaggaagaaaatgggctgaaaatggtccacagagaagaaggatatttatttagatttttatttaaataaatactaaaataatatttgcattatcaaaattagcaattaatctctataaatttgaagaaaatttcaaaaagtgtaattaatatggagaatttaataaaaattaaatcctaccatatcattttattcctcacacttactttacttgtaaattaatttaattatatacctacctgcttaaaaaatacctaaatattctagaaagtttgtatttcatttaattagaatttaatatgttttaattcatcttttttgttttttctttctgttgcaacgtacgggcatttttgccagtacattttaaaaactcatcacctcgtttacacatcttttttcgacttttcgtccgtcaagccgcttctaatacggattttttttttttttgacttggacgtctacccgtccgtatagaagtcggcaacatatgttaggtcgcttgggcctcggtctggtgctgctgcttgaaagccatgccgtgggctactgggctgtctctcccaaggtgggcccttggggtgcacgggcagaaactatttatttgaaaaaaagaagtccatgtaaaaaatacaaaatgaataatgttagctgataggcaaaaggactggaaccatattaaaacaagactaagtccttagagtttctaggttaaaattagaaaagtttttacggttctttgtattgttttattcttattacctatttgtgggtctatcaaaaataattcttttgtcatggcaaattgtgttgcatgtaatcaccgatatcatatagtgtcaaaatatattccactagaaataaactggtagcattgcaaagtaagcgtagttcaactagttagcttccttgtggttgaatcagtcaacccgtgtttaaatactaaatttgacatgggtgctcaaatttacggctaattattctttcatttataagtgacttatccgttgacaccaagacatctgtggtgacttcaaaaattaccgatcatcgacaccggttatcagttttttttttggctaattagtatttataggagaaaaaaatatatgtgtgacctttgtctggaggggatccaaaaggtagacatgatttgaatagtgtttgttttaattgcatgtgactaattgatgtattgaactcgaaaaaaataataaaaggattaatgtgtttgtttattacatgcataatcgatttatgatactataaatgtagatttttttccctcttctcttgttttaacaaaattagatcacgaagtactatatgctgataccgtgaaatagagcgtagggtcgacccgtataagcttaggttcccatgcaacacaaaaaaacatggaaacagctgcatgattcctactttgttatttttaggcaccatcttattcaatgtattaaaattatcttcacccgttgcaatgtacggatattttgccacttcaaatagaaagcctcgaaattaataactctgagcctagacttggtttggcagcagcaactcagcaggtaaggaactgagcagaggacagcaagcggcacaagcgcacagcagcgctatcgatctctcattttccatctttttttatttttttttctgttagttaaaaagataaagtctaatgaaaatcgaactactaatcaatcgcctagacttggtttagactcagttccttacccgctgagttgctgctgccaatgatgcttgatgcatgcttgctgctgctaccgtaaatccttgctgcagctgctgcaacagccagaggctttcgtctgggaaacagatcgagacgagaactgaaggatttcgggtattttctgcagagatttagcgggtttgcctcaacctcaaatatgcagtttgtccttaatttgcaatgggtagctcctttttttaagatcgaatcacaaaaactaagccaaccagagggggtgtaaatggttgatatacccaaaaacccaaacttttagcgggaataaaagttactctcaaattcaatgtagatcggtctgaccgaggttgatccgccggtctgaccgagctcgtgccaccggtctgaccggtgttgatccgccggtccaaccgcctaaagattgcctgccgcgtgtgaagtcaccaccggtctgaaccgctctcctccgtcggtctgaccgccgcctgccgccggtctgaccgccgatatgtcgccggttagaccgccgaacccgatgaaacacaaatcgaagaactcttaaagtagatgataactttattgcttctctctgtgtttacaaagtgcaccaatagcactccttacaaaaatctcgactaaactcgaaaccctaactaaactagtaactcaattgctctcaaaaacgataccgggaagcctcactctccccctatatttatacatgaggtaggcagcctaaagccacgaaccaaactcatactaagagtcctaaacaccttaggaaaccctctagtacaagacacaaactttacataaccaatcataccaaatttggactacttccaaattcgactccgcatcccatacgcacacaatacctctatcgtatgccatttggaattttcaccaaccacgtgcatcaactctagtcttagtatcccgcatgatatctgaccatcacggacatcgtcttaccaccaatccgactcccggtccatcaccacaaatactctcccgaggcatcgagtcacctacacatgaaacaaacaaagaaactatatttcgagaccaaactatcccccacttgactcattattagcaaacaacagtattacatacgtatagtatccatctaaaagccataaccttgaaacaatcacggatatccaaagaaacaacccgaaaccgaaaccgacacagcgttgcccggtcagaccacgggcctggccagtctgaccactacacatgagctggtctgaccggcaacctccgcccggtctgaccggtcccaacaaaacagtaaaccatgttcatcacctgaaaattgattatctccaaaaccacttcgacgataatctgcaaatatcaaaaccaataatcacagatgccaactgtttaacacagaataagaatcaaaacacagattgatcttacacttttcatccctgttcgtataaaaaatgaatagaaattgattcgatagtcaaacgttcagattttaatttatcaaccagtatgctgaaaaaatgttttgaaattgggttatgtagtctaaacagaaattttaggcactgtcctcgtcgttgtaatgtggcttgtttcattcaaattcgattaacggattaagagaaacgctaaaatcaatgttacttactaggtcggatatcggtacgacatttcgtttccttaaatgtgggcttgatagaggcgtaatctgattttttaccaacgtagaagtcacagaaaaacttctatatgtctgatatgataatacacatgacgtttttgctagcattcctattcagatttctcctgtaaaagtctgacaaaaagattatatgcagactaattaaatagccatggaaagtaattaagtttactacgtacaaactaacggaaattcaaaaaaaaagaaagaaaaaaatattagatgaatatgattgagataaaaacaatagcagttcatgttaggtacaaccggataatcattaattttagagaaatgatatttccttgtacaatataatacaagcaaattccaacacagatacagctcaatacctattaattctaaatttaagaattattaaactacaaaatactatggtgcattccagaacacacaaaaggcttgaacaagcacaaactacacaatgaccaggccattaccaccattacaaatcaaaataagaggaaattaacggctaaattctcatgctccatccgctcttgtgattaattctttcttttgctgagcgacagcacaatgacgctgtgctttcccttccttttctcaaggtgctgggtgacattacgtgcgaacctagagaagagcacgtctagtatagattctccaaaatggctagcgatcaacggctcaagcacagctctaatgcacttggcgacgttcaagccactcttgataggattaatattagttgcttgtccttgatctgatgagtcgtcataaggatcccagttcgactcaaagacgtaaattttgttgatggtgaaaagcttgctgcttatcaccactgttttgacttcatggatagatggctcgtaatttggaatgttgaaggagtcaagcttttccttctccacgagtccctgccatgttgaaagcagaaagcaagttctttcattttagagactctgtttataatatactgatcaggcgaggaaaataatatgtattgttcattttataacactcttcttgctatcaaccaatcatcctgtacataagactggaaatgtgaagtatcagcgtagaaaacaaggtgtaataatgtttggatatagagaccggattttaatccatttttttaaaaaaatagtagtaagtgctaagtggctcattttagattgaaacaaatctgcattgtcctgagtaaattgtcatttcaattaatcaaattggtttgaaaatcttctttttacagaatatgtcctgaggaaagcccaaagtttttttttttgaattggaaaatgtgtgtatgttcatatatacacggacctctaaatttcatggcttccatatccaccaatatagaaattagttaagctataggaaaatgggagtgtataatgctagttcgtaattagtagggttagtggtttagtgtacctccataactagagattgcaatgcttgtgagattaatccgtaaagaacacttaggtttccatcatataggtcatctttcttccttgcaagaaaactaagcaccatctgaccaccagacacaagttcctggtagcgcaactcaagaaactttgagaaatcatcgtaaaatagctcttggtatagctttatcaccgatttaggggtagtcttggcgatgtaaatgttcccttcatttaggaattccccattgttgctctcctgaaacatctgtgcacaaaagcagtggaagatataaacacatattaattattggtgctatgaactcctaatgctggtacagaaaatgcggtctctctttttggatatctcatgcattgcagcaaaaaatgcattcactttactactttcataatatcactgttttgtatgttgtatgaattgagtgaatagagaaattattttctcaaaaaaagcgacaaattatgggagtatataatcgatgggaacttacaaaatgtacatatagaaataactactttatttgttgtagaatactagaattcagtagaaatctttagcaactaataaccagtttatttgtactctttcgatcagtaaaaaaaaatgcatggcctatttaatgagttaccactcaactgggataggttttcagagacagacttacttgagatctccaatgtagggaataagatgaatggaagaggtgaacactcttgtcagggaaaactcttgtatagtaggatcttggcaagcctacaacatagtacttaggcagtattgctgcttctctgttttgatctttggcgaccaagttatctagttgttctaaagatttaaataggtagttaaagtcattgccaggtagatcattcataaaacaacagggcggtgacctatcctttgacaatattcgctggtcgcttttatcacctcgaagataaagtttagtgtatttggtcccgaagaacagcccatgtcagcgacaagcatcgtcctaggaagaactgcagagtatagttcttgaatggccttctgaatcataggcttagtagcaaccaaagtcttctcctaaaattcatgtgcacattatattaaatcaagttaaattgtttggaattaacagttgcatactagtaaacaaactactccatctgtttcatattataagttgtttgattttttttcttagtcaaacttctttatgtttgatcaagtttgtagcaaaatatagtaacattttcaatacgaaacaaaaattgcatcaaaatatattcaatattaaatttaataaaactattttggtgtcgtagatgttactatttttttctataaatttagttacaccttttcctttttcttatatattttctagaaaaaataccatcggtactaacgaaaacctactacgtgccatcaaaattttctaaatttgaaaacataccactaccgtacgtcactgccgtcacaatttctgtccccttcccccaatcccatggccatggagaagctctgttcgtgccgctggtggctgcttcttggtccgcaagaagggcgagagcaggcgcgggcagctggtggccagcggcgtactgcgcgcgggaacgtggtgtggatgcggcaagctagctccccctgccggcgcttccctagcttctcgtatgtaatggtcgatcgaacgcccctctcgatcgcacgcaagaactgcttcaatttctaccacttatttgttgaatttgtggatggtttcttggtcaattttgattagtcgacgttcgatcggcatggcgagtgtgctggcgtgcggcagcaccaacttctcgggtctacaaggagcgcgtcatgctggtgctagctgttcgtgccgttgggtagagtacatgtcgtcgtgccttctagtctagtgatggctagctacagcttcactccggcgcgcgagccacgtcgtacgtagtgtgctgggcctgggcgcaggtggcgagcttcgcgaagaagaacggctcgggcggcggcggcgggtcgccaccccatgcgtgcggcaaccattggtggcgtggcaggtgtctccctgcagctccgcgacgaggcgagctgtgcctgtgagaagccgatggcgacgatctactggagacttgcggccgtgcggaaggaggagatagttcggaaagtatttttagcacctaggtgctgcggcacctaggctagaaaccacacgatggtttaaagattcgtgcgtcaaatagtatacggagatgttaggaatttaggatcgtattttctttattttgagtgcacgctcgaaatacagcgctggcccacctgaagattcgtatgtgggttgttgtgggggggggaccaatacgtgtgtatgacacctcctattctcgtccagattctcaagagttatcgggaccgaatcgccacccgccgccgccggggccgctcgccgctagccggccgcatccccgttgcatcttcctttggcggaagcggcactccatccagtctcgccgagtctccggccgaggacttccatcaggtatgctcgaggaatcccatcttccccaacccccttctgccttcatcccccgtcccctcctccacatcacactccttgagtcattgtcctggactccgacgagcttccatcgccgcacatggaggccctgttgcctgcggcggctgcgcgaagcctcctgtggcaagagttgcctccgtgcatagacgccggcgagctatcacgggccagcaatcaagttataccgccccatttgtcattcttgagcttcttgatgtgcagttcttcatccgtgctgtgagcggatgccggcaagacgacacgagctgagccgaggcaacaatacgttaaggtcagcaaaacaatcaatttcttcccctgccgcacaagcacgcattcttttgtcgccgccgccacggaagaactctagggctttcaattcttcagcaaacggcgaacgattttatccatggttgtttttccctacattttgctggaggaaagaaagaaaccacaccagatctgttttttttttgcacattttttttagatcaaaggcttcacgcccggctttactgagataaaggcttcacttttttttggcacattctgatctactgaaatgaattttcaatttcttttgcatgttttattctcattacatgctttggggggagattagcaggtctttgagaagagtggtttatccaacgtttgaccattcgtcttatttaaaaattttatgtaattatcatttattttattgtgacttgattcatcatcaaatattctttgaagcatgatataaatattttcgtatttgcataaaaaatttaaataaaacgaatggtcaaacattggtcaaaaagttaacggtgtcaacattaaaatacagagggagtagcacatactaatagatttcactcgactagtagtaacatttctttcaaaatagtaaagttgcaatgacatccatccaattaaccctttttatatggtcatactactggcctgattcggctttttccccatatctggtatctcatttcttcccatggccttgccaccacctgagcagtgcagctgtgaggaaagcggcgacggggttttccagaggagacctcggtgcggcggaggggagtgtcgggtctgcgggttccagcccccaaatctagcgacgtgggaggcggaggggccatgggcagtggtggtcaaggccgcgcgtgccagcggaggttgttgggagggatggaggcgcaagcgttggacagcagcagtggctgaacccgagattggcatgcggcagcggaggggtcgggaggcggtgtcacagcgggtcggccgcgacgtctctgcggcggcgggtgtagcggaggacagcgggtgcagcggaggacagcagggggcctaagcttcgatgctcagtcctcagcaaggagaaggccgttccgatgaaggtgatgtcgtaggcagctgcgaccctagaggccgcgacggcctgcgagtccgagcagcgatctccttagttacggcagctgcggtcttaggggcggcggcggcataaggactggtgcaaggtggtacaggcgaaggtggatctcgtcggtgatggcagccctaggggtggtggaggcctgggtgtccggacgaaagatgatatgctcgatcaccacggcagaggacgccggtagaggtggcggcaggctgagagtccgagaggtagtagaggattccaacgttggcaacggccctatcggctgcaaaggcttaggaatccggcaaagcataagcatatcctttcatctcgcatttggtcggctagttctgactggacgacgatggatgaaggtgggctacccggtggcgtgtggcaccggttcacttaaagtggatgaagatggcaccagtggagattagcagcgagaacgcattaggggcggtgatgagaagacaacttccactcgtcaattttgttcactagaggatgtcgggatacagggatatgcagaggttgtaggtttttcattttttgggtttgtgttctcctctctattgaggtgtgagtttaaatactcttgtatcctttttggatatgtatacccctcgtgggcatagtggccggattaatgaaaatcccttatctaaacaaaacctagcttatgcatgttttctatttttagttttttttttcacccagaaccatgatgtttgattttacattggacttgcatgcatataaaagtgattttaccatccttaagggatgtaccatattttgtagtatcaggtagtaggtgtatcgagataccaaaatttttagtataaaatttgagcaattttaccatccaatatttggtaccagaggaaactaccttgagactttcggaaggactgaaaaattttactataatatagacagaagtcctcacgaaacaacttgatccaagaaaatacaaatatgtgtagcccaatttagacaaatcaaatcaacataatataccgaattaaaagtaaatttccctataaatatatataatatatatctactgaaatgaatctgcaatttctcaaagaaacagagttagtgtgtagtgtgtactaacttgaagcttcgagttcttcgcatagctattttctccgtccccttcaaccatgccaaagtcaatttccatatagctaagactaagagtgtggataatgtgatacaggaggagacctaataacttctttttaggagtgtatacaactgggaggttcaacacacaagtagcatatatagatatagaaatcatggtgccattatatttatagatgcaaatggtgattgtacacgtttatcacgcctacaacaattaatgatatatatacaaatatatatttacaaagtgggatggtaattaattgttgtttccccacgtatatattgctgctgtgtttgtccgcattcaggacaatcaatctctaccaccgaaaagtgcgaaaattaagggctatcacatatggtccatatatatatgacattaatttgcaacactcccaagattataatcctgaaaaaaatctcatccacatataaactttgtggcgtgtgatccacatgcttcaggcagctagacagcaacgaggtacattccatagtggcggagactgcagggtggaacgatcagtagcttgggccctccgatccagcattttttttctcacatataatcatcaaactgattaggccatacagtgtttaggcttcctccatgacttttaattagtatcctcacatccatttgaaggttatatattctcttatccattggcttcgtacataggctatcctatagaagtttggttgcctggttcgcaggatatggtagttgtggtatgtcaatatttggagaagatggttaagaagtttttcacccaggaatatggatggcgatctagtcttagaattggtggcccttaaaactctgtgcttttagaggaaatggccaatgagttgttcatgagtggcaatttagtctttgttttttacccaggaatatggatggcgatctagtctaagttcaataaaaagttccattatctaaaaaaaaatctctaattcatgtttccgccatcagtcgccgttaaatagcagcgcgcttaatttatacattttacgtaagtcgctgatttttttataatgggttaggtcgccagaaaaaaaaaactacctcaatctatttactttttttacaattgaccggcccctaaactatttttgacatattttactcccccaaaaataaaagaaaggaaaagctacaaatcactccagattatgagcatatttctctttttagccgatatctccttgtacacattatctaaaaaaaatctccttgtacacaggtcatattttagggtgaaattccatagtatccttcgatggcagcataaactacgttacaaaatatttcaaaagtttacatgacagttgtgcgcttagttttctgtttgtatggttaaactttaataaatcagtcctgcagggtgcttcaaactgatcatggaagcagggttttctgaaaaaccttaatcttaggccatttctcccattttccccgatttctccggtgtgagcaagggagctaggcgacggtggcgatgattcgcaacggcgtgcctgtgtgtggcgggcttaggccgtgcacggatacgaaggtcaagccgatagtgcgccgtgagtcgacatcaccaagtctacccgagcagggtgcccatatgcacaaaggacagcgatgtcaaggtgatgacgacggcggcgatggcgcacggtggcctgaggtcaatggtccgctccccaaccatggttctcctccttggtgtggttgaggctgtagaagaggcgagcctcattgtcacacggccaagtcaggcatgcgcgggattgtccaggcggcgaaatatggccggtacacggcgcagctgaagtagcacatcacccgcatgataacggaggaggatatcggagatgcgcatgatgacatagctcatgcctcgtgtagttatcttggacgatccgtaagtcctaattcggttagcaaaggccctaattgtttcaagatttgatcaatttggggtttttttgggttcgggattgtctaatttaggaggttagagttcttgatattgggggaaatgaaattaggatttcggatttgaggaaaactaaagttttgggttttgaatttggggaatattggaaatttgcttgatttcaatcccattcgtgatcccctacttctaagtgctactcaagccatgaatttgaaaggcaagatgcaacttacatagatattgagccttaattacgctagatcagaacttgaaaataaaaggggggaaattaagtacatgaaacttaagtataacataattaccagggaaattatacctcaattgacaagaaataaacatgaattaaaaaacaatcttaaattgaacgtggaccaaacaataaaccctaaaaccaaacaagccgacggttgcaaaaacttgatgctatcatgaacaaatgttattactaaaaaaaactgattaccgtatttatttgggtttgatggtgggcatggctttgcagatttgcagattaggaaacggatgtgattaccaaaaatattgattattgtaaaaataaaccgattactgaaggtgattccgcttgcgatggacgccggacaaaaacttttattaggaaccttaccttaccttatttttttattaggtatatagatttcttgatttatttttctaagatcaaaatattgccaccactgacaggtggttccacatgatatttatctctcagaggaaaaaaaccagggaggccgacaaaagtggggtcatgccaacttctcccattccatctgtttcttctccatctcgccctctctcgcacatgttgtgcatgacgagcggcacaggcacggcatggcgccgtctgcacgcgcaatggcatgtcgacgaggcgaccacgacaaaccggacaggacagtgatggcatatggccctcgcaaggcactgtagcgacggcgacacgacatgcgcagagctgactcggatcataggttttaacgggttgtttggttgatgactaagtttgccacacctcactctgtcacaagtgtgttatgccatacaaagtgagactagcaatttgttagccacaagtataattaagtttggcaagaatttgagtatatggcgtgcaggcccaataatttataaagtgaggcatgatttaggtgtggcaactaaccaaatactatactaacaaattatggtatgcttaacgtttgatatagcaacctttgagagccaaccaaacagcctaatttcaacctagcgcacgagcatattgcgcctgtgagagttggtttgattttgcaaagggtaaattggaaccatgccattgtaattatacaaagtttaagatatgccatcggtatctcaatgatatgtagcatccacatgagtcaatgatatgtgggtcagcatgtcatatcttaaatttacaaattttacaaaattataatggcatggttccaatttttccttttccaaatgggttggcgcgacggcaaactcctagtttcgccggtgcatggcggccatgcgtgggaggaaagaagggtcttcacggcgatatggtatgatcggaaataattgatcaggaatctagccgtcatatatgtacattgaactggtagtgctttgggcacgcacacaaggtgctcgacgtatgtttcagaggtgtggtggtgggctggtggcagcttgtagtcgctagtagaaatgtgcatatctatgataaaactttaatgtcatggtcgatgacgaattcgtcataagaaaatttctgtgacgtattcgtacgtgttcgtaaaaaacggagcgtgacattcgtttagtcacgacgaatcagcaaattttgtcatggaacttgtatcatccatgaataaaccaaattcatcgtagaacctatactttttatgatcaaatttgatgtcacataaatttgtgcatgtgagccttgcaataatcactaaaaaggaaaaaaaaatggaatatgtatggatcaaaatagccagaatcagcggcggaaacaggaccactaaaaatattcgattgaacgaagccaatactttagtttttttcagattttgttcaaactccagtaaatacaatgcaaattttgaaactgtggggtctccacctctgcccagattggcacaaacgacaaaccagccaaaaatcgtcattctggccactaacatagttacttcatccgttttatattataagtcatttaactttttttctagttaaacttcttttaactttaatcaagtttagagaaaaatatagtagtattttcaacacaaaacaaacatattatcaaaatatattcaatgttagatataatgaaactaatttaatatattagatgttgctaattttttctacaaacttagtcaaacttaaccaaacttgattagaaaagaacttataatatgaaacataggaagtaagatgtaccagccagatcatcatcatctatagcactccatctccatatgttcttgccaatgacagtgcaatgacattgtgctttcccttccttttgtcaaggtatttgcttacattactggcaatccttaagaagagaacatcttgaaccgattccccaaaataggtagtgaacaaccgcctcaacactggcctcaaagacctcgcgacattcaacccgctttgcgccgggtagagcacaacctctccttctaagtcatcgtcgtaaggatcccagtttgattcagagagttggatctggttgatgatgaacagcttgctccgcatgatgattgttttcacttcatgcgttgacggcatgtagaccggcatgttgaagttgttaagctttttcttctccatcagaccctaatgtgttgaaagtggaaattaagcacattaattcattgaagaatctagctagatatatatatgacaatgtatagtaattaatatatcatgagtaatatggattgtgtagacctccataacaagagattgtattgctcgtgaaattaatacatgaagagtacattgatctccatcagatacatcttcgttcttccttccaaggaaagtgagtagcatctgaccactagatataagttcgtttgagcgcaactcgaggaaatttgagaaatccttctcaaataactcctgatataacttgactgttgatatgggtgtagtcttggagatgtaaatattgccttcgttcaggggctcctttatatttttcatttcgaacatctggatatgaagaacaaaatcttgatattttgctatagtgctaacagcaattttgatccctcaataataacagttatctatatctcatgcctgcatatacaagatatacgcatttactacatcagtttttgtttatgatttggaccaccctttaaactatgttatccctttgtatcaggtatttttacctttgaggcactttcaaccacccttaactcttttatctatctacaaccaatttatcatatgccaaagaaatggtattgcgtataactgtgagagtttattgacgagtaggagccgatgtacttgagatcattcatatatatgctcgaaaaagagtcaggttagtccaaagtaatacaaaggtaaaattactcagtccaaagtgaaagcattaattgaagggtgatccaaattaagtgaaacatcggtcacaaatgtaggccaaagtgaaatttactctttttatatcataggtgaaagaaaaagtatgataacaagtcccaacttattctatcttactataaagttatcccccactaactacttaagcttaacatgcaaagatgccacatcatcatccactaacaagatgccacatcatcattcactaatctactaattaacaagatgccacatcatcatccactaacaatcatcacatttaaacatcatgcaaacatgctatgtctttatagtttttataatttaagagcttttcaaatacaaacatgttaaattatcatccaacataattcacataatgtttcaatatacatctttattatgttttatgatatcctatatacttatatagttcatcatcacttagttagtgcttaaatgattaatctatggtccagattatctttctcctttttccctctaattaagtcatatcccatcaattgtttttagcctttagatgattaatctatggtccacacacctaaactatctccctatttttcttcttctataaaatcataccaccttactttttacgtttgaatcaccattctacatactatttaaatttaaattatcataaaccacattaatttacttaatctggtgttatctagctatcatagctatcttacacgttattttttttattgttataatactaaattcccgcagcaatgcgcggggtttcacctagttatctcaataattgaatgctagtactatgatcaaaatttatggtaaaaccaaataaaaataacatttagaatatatcccaaaaaaatgctcctttgacaagatctggcgatagcaggtaaattattcatcaatactcttgcatgatctatatcgatggccaaggtgtatatattcatatataaattcaaaacaaatactacaattttagtaaagcatatatctcaaaaggctaaatacaaatgagattgatgtctaaatgcactactctaaaagtatgcttcacctggacatctgcaattaactgtgataagcttgtctgattaccttagatcgccagtgcagagcatacgaggagtggaacagatgaacactatttttggggaagagccttctatagtatgagcttgccaatccagcaacatagtattgaggcagtgtagttgcttgtctgttttgatctttagcaacaaaattatcaatctgttctaaagatttaaacaggtgattaaaatcattgctaggtagatcattcaggaaaaactgaacatccacggggcactgaccgatcctgttataatattcagcgatctctctaatcatggtagagagagacaaacattagggtatttggccccgaggagcatcctaggtcagctacaagtatcatcattggttgaagagcagtgtgtacttttttaatggccttttcaatcatcggttttgtctgaagcagagcctttccctaacattcaaagcaaacataaatacatggcattgtgactaactgtgggaaaccagtactgcaagctagaaaaatatatgcatggtacatgtaattaatttaatctgaagataatttcactttgagttaaactagtgatgagaacatatgactg

SEQ ID NO: 13542 - DNA, 8046 bp, Oryza sativa
taaccaatgatttaattataattagaaactatggagaagaccaaaaagagaggctagaaggatgatgtcaggcgttgaagtcaagatggagggccaactcatatcaagtttgagtctaccttaggctctaggagtagtctgcgctaaaaacatcacgcagccgcattcagactcacatatggaaagctaacgagaccacctttccaatgggtctggtctcacgtcaaaaattcttctgaaagaagtggcgtccagaatctatctgagtgctgcatcaccatcttttgggccgctgggccatgtatcgtattgaagtccaataatgatgcttctagaggtccttgatcgacctagctagaacctatatttgttgattgaaaaccagattgtgtgtaccaagtttctgccaaatcgataatctctacttgatggaagatcgggcaccccattaccgtcaacaaaatttgtaccgttgacattaacatatattacaacaacatagcctatataactagtaaaattgcattttttccctatctttatagcatgtctctcattcatattcatatagattgccactttttcatgtttatagcatgtctctcactcataatgtgactgcttggtactaggcctatgctgatagcttatacaacatggttgcatgtgcacacatagtaaaataatttatttagtcccaccttgctagttctaagagatcactagtttatataactggtaggtggtctaataaaatcgtgttgggcatagaattatatcataatgtaaagttgttacacatatttattttacttctctcatccccaagtagggtcgcccatcatcctcatagagttatacctatccctttcattaagcaatattattacaaattaaaggaaaaccaacatacaagaaaccaactagcataaagacaaccaactaattaaatgcaaaccaaatacaagaaaccaactagaataaagaacacaatccttttgctccattggaactcacttgaataataatcattagaacgatttaaggtagcatttttgcaactacatacatatactttcgacaaacctagtgcccaaaggtacaccatcgggggcttaacatcgacaacccatcgtggtcaacgggaagcttgagcaatcaaatagagggatcaagtgggatgagagcaaagctctatgagctataaagaggagagctgatcaattaggtacaaatagagacaagggagtaaaaaaccgggcttggatcagatgaacaaggagtattcaagaagcccatgcatgtgactggttgggctaataggagatggatatatatatatgaagcaacagatcagaagaaaatcttctgctaaggcaaagggtacaagtggagaaagtatgacaattcaggagaacacaaatcaacaagaatagtagaggctcgattgaatagaatgaaataatctgtagactgtacacagtaactttttatctttatttatttaactaggaacgtagcccgcgcattcgcgcgggcatgtattatattttgtgtttcaaacactataatgacagaatataaactggagaacatttccggaatataaatcggaaaggaatttcgtacagatgtacgagcatcttatttgttattaaaaaaggaataatacatcactatatatatatatattgtaagtgaatttagattatcctaaaatacatgggagattttaatatactactaatatgataagaatgcctcttagatttaaataaaaatcccgatatctgtgtatgaatcactcatctattcttttgaattatacatatccgcgcgattaattttttgtttcgatgtgcaaaagcaaaccatttcttgaaagcattcctataatgaattactttggaagatttataataaatggaatataatgagttgtgatcaatcaaatattgctaagtcctggtatttactaccgctcggaattaaaccataaaggaagttctatctacaccaggactataaataacagagtggggaggaagatcttaaaattgtagattaaaggccgttgacaacaaatatgtgctcacaccgatgatttttcctgattagtatttctttccaattgttctatgtacgtgtgcatgttttcttttttattttttagctttattttttttgatcgtatatggcgtaggtatttaagttttgttttcttggtagggagacgatcgtacgatgtaagcacactatgtttttttccgggatagagattagcagcgtgggaattttaagagctctaatccaatgtttaaaataatgtgtcactaatttaagtgacaattgaagattggatgcttttctctttttttttactctaaatttctaggattaatctaaattaaagcgccacgtgacgatgtaggagcgtttgcaggaagtttaatagacttataatatataatagatttctaggatttcgctaatatatttgagagccacatagcggtgtaaaagcgtttgtagaagtttaatgtacttttaatatataatagatagattcagaagatggtttaaagaatattgattggatatttattatagatctttgtttaactaaatatatttatatttgtgaagtaatatattttatcaaaaattatatttcaaagaccgctgatttttatggatgtatgttttttctgtctttttctgtacatgtgtatgttttttttcagcaagattaggaaagatcatgtacgtttgtacgtatggaaagaacagcagtagcatttgtatcgtacaaactcatacgtacggacagtagtaccgcctgtacgttataaacatgagaaaattattattttttaagtaataaatctaatctaatagtgtaaactaatgggtccattaatttaaataaaatcaacggtgagattagatattgccatgtggcgacttaggaggatctataggagtgccacatggcggcttaagaacgtttgtaggaagtttaatggacttttagtacctaatagatagattaataattaattacaaataaattaaaaattggatgttgtttggttgcaatctgttcaaataatgtattttagttttttatagtaaaatatgggtgatatggatattaaattattaattgttttttcattaaaaaattaatttaaagaagagtagggagagggaggaaaacatacgtacatacggttggagtagtgtgatattttttaatttattaaaatgccacatgacgatgacgacttaagagcgtttgtaggatgtccatatagcggcttgagaatgtttgtatgaagttttattgacttttatatagtataattaataacaaataaaattactgttcaaataaattaaaaatactaaaagtccattaaacttcctacaaacgctctcaaaccgtcacgtgggattcctataaacggtcataagccgccacgtggcactctaataaattctaagaaaaaagaaagatatctaaccgtttatttttatttaaaacgatgaacccgataatactaaccattagattaaatccaccgatccgatcacccttttctcttggacccacaggtacgtataatacgcacgtaccaccacatctgctcccctccccctcaggattctctgtcttttttaatttttattaaggcgatgcaccatcatttattactataaaaattattggatctatgaactttaatttatatatgaatgatcttggggacataaataaataattacttttttagccgatctacacattcaatttaagacacgcttaagcgaagccatccatgataaatcatttgtgatggtctcatactcacgaacggataaaaataaaatgcacttcttatctaattcctgtggaacaggagggagggagtacgtacgtttgtacatatatatgtgtatttatatgacggtgatttagttatttttttgaaaactattattataaattatgatttacatttgactaatatatcataaaaataggaactaatatagtatggaaatagaagagatcatgtagcatggaaataggagataattaaaggggaaacatgggagggcgtacgtacatatcccgtacgcacagaccaagctggacgtgggatgtggatttttttttccaaaaatagatttaatttcatataatattgggttcaccagattattagattaacacgtgacggcttgggagcgtttgtaagagtctcgtgtggcggcatgagagcgtttgtaggaagtttaatggacttttagtatataataaatagatagatgtttttcatccatggtaacgctgatctgatgtttaaataggttctgacatttaaagagatggctaatttgcatgaacacatgatttcaccctaaagatgaaaaggaaagtacaaacaggtcggtgatgtagttctatttctataatgaaagaaaacaaccttatttagcatgaaatacgtagatgtatctactaaaatagcactatggtaatgttacatagagaacaagttgggtagtatacaaaattgtagctttgagttcttcatatagctagcttctccatatcctttggtaatgcagaagtcaggctccatagcaagatgtggaggccggccctaatttatcaaaaggaattgcctaatagcccttatttataatgtttgttttagcatgcactagtagagtgcatgcaatgggagcttcaaaacacaagctacgaggaaacctagtaccactaaatttgaagcgtatgtcgttttctcatgtgtctcaatttgaagcaagtcatttctgaagaaataaatatttaatgtattttctagttttgtaggtatgcagcctagaacttgctcaaggcgtaaacttgggttcaaaattccagaacaaaatttcagttttggaaattttcattttatcggtccccgggataggaaactattttgcccgaaatttttagatctttttttttcaaattttcatgaatttagaaaaaactcaaatttgacccattttgttcaaatttttttggaccaaaatatcctaaatttcagtcgtataggttcccccaatagaaattgcccaatcgatatattaaaccatggctaaacctagcgtgaagttagctatatgagcttacacctattctgacctcactttactgaaatgtgtgttggaaatttggtcataattcggcatattttaatccaaaataacaagataataatcatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggataaaaaaagaaacaccagctttggaaaatggatgaaagtgtgtctttttcttctcgcgggagattaaatccattcccattttataaaagcaatggaacatgaagagtaagagtcatggaataggaagaggaatggagcaactaatggtcatcaactaaccatgaaccatcttccattacacagcgatcaaccagcaatcaattaagagtaatgatgtaagttaccaatggaatagaaaaaggaatagagcaactaatggtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaatttcaaggctcatgagaatgctctctattccatagcagcttttatataccagtgtttcggtgaagactgttaagttgaactttcacctagaaaaggagctacacctgaccacaactgaacaatggactatgccttgaattgtcagtcttgtgcagttaggtttcactcaattccataactgatactaggcaaccattagtattccctcgggttggagcttataagtcatactccaggcctttcatgagtatctagagatcacccaaatctcatagactgtgactagcagtcgaactcatataggtgtgttccttctaagatgttctgcaggtcaacatctctgcttggaaaagccactcggatcacattaagacataagccatcctaccatgcaggaaagaagagaagcacatcatgaaaatgagctcttttcaagggtctcttcagtcacacaatagtttgtttcaccatccaaattcacgggatctccgatcataatggacaggtttccactattatgcaaccttaggtgggtatcaagcccatttccctcgatgcactgtctatcacattacgtggtagccccttggtaaactgatctgctagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctataagttctgcttccattgttgacctcgttaagatggtctgcttgcaagacttccaggaaacagcgccacctcaagtgtgaacacatatccacttgtggcttttatctcatcagcatcagatatccagtttgagtcactatacccttctagtacttttggatacccggtatagtgaattccatagctcatagtaccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttccttaatagcacgctgggatcataaggagtaggagctggcttgcagtcactatatccaaagcgactcaaaaccttgtccacatagtgggatgcacaagtgtaatcccaccctcatctcctctttgtagtttgatgttaagaataacatcagcctctcccaaatctttcatttcaaaactcttggacagatagtctttgacctcctcaatcacattaaggctggtcccaaagatcagtatgtcatcgacatataagcacaagatcccccttctcccccaccatagcgatagtatacacatttgtcagcttcgttcacaacaaagcctacagatgaaagcgtggtgtcaaacttctcatgccattgcttaggtgcttgcttgaggccatacaaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtggtcaagcgagcaactggtgagtatgtgtcgaagaagtcctcgccttccttttgggt

SEQ ID NO: 13543 - DNA, 5904 bp, Oryza sativa
  unsure (1)..(5904): unsure at all n locations
atgtcgggtactctagagtttactattaagaatctataacccacactgtggatagcataaccaagaaacacacaatcaacagtttttggtccaagtttccgctttttggctataggtacatttaccttggccaaacagccccatgttcgtaggtatgagagatttaatttcttcctttcccattcctcgaatggtgttacttccttatgcttcattggaattttattcaggacatgacacgcagtcaaaactgcctcaccccaccattccttggaaagccccgcactgtctaacatggcattcaccatctcagttagagtacggttctttctttcggccaccccatttgattggggtgaatagggaggcgtcatctcatgaataattccaaactcttcgcaaaaggatgcaaactcattggaaaaatactccccacctctatcagacctcaaccgtttgattttcctttcaagttggttttctacctcagctttatagattttaaagaaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaaccttttaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtcccatatttagatacgacacatttattggactcaaacacaagtctaaaaccttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaatagagaaatgtcagcacatacatgaatattagcaccagtgtccacccaccaatcaggtgaatgaaaaacagagagaactgtgggtagtattttaccgtaccccgatgttcctccgccctcgctaatgatcatgttggcagacttcctgtctttgcgctcaggacagtccttggcccaatgcccagacttgccacacacaaagcagtctccctttgcctttcccttgcttttcttcttaaaattggttgcagccttgggtttgacatcaggcttaactttcttgttgttgtgggatgcatgagggttcttcttctgtaccatattggcactagaacctccctcaacctttttcccccggacgtcctttgccctcgccttctcctcaacacccaaagagccaatgagatcaggaacactgaactcttgtctcttgtgctttagagaagtggcaaagtccgaccaagaaggtggtagtttggcaataatgccacctgccacaaacttgtccggcaactcacagttgttgttctcaagttccttagccagcatctgaatctcatgagcttgttcaactacagaacggtcatcgaccatcttgtagtcatagaactgctccataacatacagctcactgccggcatcagaaactccgaacttggcctcaagtgcatcccacatgttcttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagttggaaccatcaaaagcatgtggtttcagtgcagcagcaaagccaactaccggaaatgacctatcaggtttttgggatgttggaaatttggtcataattcggcatattttaatccaaaataacaagataataatcatgatatttacaataggatttgatccagtgatagtggtgaatgtaatcaacatgagcatgcttaacgttgaataagcatcaacaatcatgaattcctagcataatgagccttggaatttatttgatttaattgatttaaatggattaattacccaattaaatctaacaatgtgtacctagaagttacatatttaggttaacaagttcaatgcagtacttcacaactttcagaataaagttgtagtaatcctttttatgcttgtactgagatcacgagcagaatatatctgagctatgttagtatatatagtaattcaattagagataattaaggcacaaaccgcaactcctttgataggatcaccatcaatatatatattgcacagtttggtttgatcctgtccactcaatactcagccctaaccttatctgaatttacttggagcagcaaaactgttggtttgatgcaatcatggaaccaagctatcgctgcttgctgcccactgttgtccactctcatgtccatatagatatatatccctaattgtggaccatctgtttatctggtatatattgatctgcatttaattatatagcctctctatgatgtgcaaacctataagaagcaacaaaataacaagacaaaaaatcctaaaaggttaatatactcgcactgcgcaacttactatgcctatatatatatgtgtctaattcaaatgtttaggctattgaatgagaaggggtacctatcgatgaataaatgtgctcgtaaatgataatcaaaaagagaggaatttctccatggtaaatacccttagcctaataatagatgcttaattccgtggtttatggttgtgtgttgatgaaattacgctaccatatgaaagttggatatttttggattagcatacaaatctacgtctctaaaccacggccctttcaacttattaacttttttatataaattgaggatatataaaagtacaaattaagtgtgatgctagttgcagatggatctctgcttctcaatcgaaatgtgtattttggaagctagctaggacattgcactgcagccaaagaaaagtcgtgtcgaactatgaagataagtctgacgatcgacataaaacccatgactgaactagcctggaccctacaaatcacttgcaatcagcgctagctaaatccaggaacctgtagctatatctttatcttgatcgttaccggctgaaaacatccattctatatgtcattctccatcgtacaacgttgctgatatagttctagccagaaagctacatagattatttttcacaaaattgttaccaaaacttatacacatccacatttttttctcccgagaaggcttgatttcagccatctaactttggtaaagagtaaggagtacagttctactctccctctccccccccccaccccaaaaaaaaaaaaaaaaaaaaaccaatcttgagtttcaatctggacatagtcaaatctagggttgggtttttttttttttacggagggagtaccttcttagctactctaggttcacaaatcgataagttcctaccatttcaataataatatgttgttattaatgagatgtactttggtttttatcaccaagagcagccgtagtgtgtgttttataggatactaagataatcttttttttttgtctttcaaccggtactgtatacatatacattgcgcactatgcgatctaggaaaacgttgaaagagcacttccggccttgagaccggaagcttcaaattagataatactacttttgagtgtttacaagtggagagaagcaaccagtgattagaagagacaaggtatacctaacgggcaatctggtgctctgataccaattgatgagaactaggtcctaatctttcgatagtattgataactctcgatttggcggaaacttgatacacacacgatatggcttccgatcaacacgatccgaaccctgcaattgaagcaccacatttcctctgggtatcaactgtgcacaacctggctggcctcaccaagaacgttaatccctgcatgcgaatcgaagagcataagcaagaacaaggtagattgtaactcaattgcatatgaatgatgaatcactcgaatttggagttttacaaaccgaactttgcagcgaaactgcaattggtagaataatctaatcaaaacctcgtctaaactatgatggcaactaaataaatatcattaggccatgctagggttgccctagggcgccaacctcttgagcttagcccacgacacaattacaaggcttaaattagtcttagactggatcaggtatgtgacttgtttcgcagattaccgatagctcggtatgaattttgacgtaagattaaaaccatctgaaagtagactccataattttccaacaagtacttataggctccgagattgcttctagattagtggctaggtccttctcaagttgatgttgtcaggaggacgggatccgaattcagaaggtgtaaaacttcatctcttgccttctatggaccgaaagtaaagtggtgatttaggaatagacttggagaaggtcttggttatgtccctagtcaaattctttgatctttaaagtacttcatgagcccgtacttctttccttcatccacgcaagtatttctgcaaataagaatatacaaaaacttatggtacagtaacgtttgttcaaacatatattaattaagtaaatctaatagagcacatatgtaccattaacttgttgatgtgtaaaataagcatggttatatccgagccaatgatgtcctcatcaggttatctaactccaaaactgtaccgtgatgagaaactaggtcccaatcatccgataggtattgataacactcgattcagcggaagcttggcacacatggtccgacttccgatcaacacgatccaaaccctacaattgcaacaccatgtctcctatggttatcaactgtgcactgcccaattgatctcgccgagaaggctaatctccacatgcaaatcaaagaacacaagcaagaataattgcaacactattgcatttgttggagttccacaaaccaaagtaacggcgaaactgtaataacagaaataatctaagcaaaaccaactcgaaactatgacaacaactgaatatatatgactagggttatcatagggttagcctaggatttccatcccttgagcttagccacgatacaattataagaccgaaggcccaaatcagactcggattggatgagttatgtggcttgttttgcagattcctgacaacttattcagaattttgatgtgggatcaaaatcatctgaatgtagactccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13544 - DNA, 473 bp, Oryza sativa
gcgttctccaaaacatggagcatagatcatagcaggataggacacttatgttccctacagttccactttcactattttacaaaagctggaaatcatgtgaacaatacatgcattgtgctccacactactatgcagcatcatcatatgatagctaatttatgtgttgccgtattggcaaacaatagcccaacgcaagcatgagaagtcctattaaacagctaaatgtgacaaataaaagaattttagctttaagccaaatgaagattgctcgcaacatcccaaccaagttgtattctaggtcactcaaaatgtgttcccaatttcccatcttagctaaaatgaaatgtatcagccgcaagctaaaaattgttaagaagcactccaatcacaagcttttggataacagaaggttggaatatggatgtaagttaggttgcatcaccttcagttctttaatcttatcttcaagactc

SEQ ID NO: 13545 - DNA, 581 bp, Oryza sativa
taagtcatatttaaagaatatttgataataaattaagtcacaataaaaataaatggtaattacatgtttttttgaacaaaacaaatagttaaaacatatttttaaaaaatcaacgtcgtcatatattaaaaaaaacagagtgagcattttattttcggttaacctaagttttatttggagggagagacgttttactcctagtttgttgttcgatagtagagatgataatcatgagtcaagtgagaattgaattgtacgcaatgatatacggctttagatttatctagtcgtacctagaagagaattatgtcccaattatatacccctgctcaggcattaaaaaggtgggagttcgctcttaaacttttaacgcccaccaaccgtcctcatttttaaactcatattctctactaacaatttccccccaacttaataagccattagtctctagcgtttcattttgttcgaatcggtccttgagcttttgagctttgctcttttgttccatacgatccataacgcccacctaatgaatcgggtgatcaaggcaactcaatgaagatcaatcttgttgatgaatg

SEQ ID NO: 13546 - DNA, 15816 bp, Oryza sativa
gatgatgaatttcaggctgagttaagtgaaaaaacggcagattctccaaatccaaagactgaagtaaataagtcagatggagatgagcacttgccattggtcaaaagggcaagggttcgaatgggaaggcctcagttggaagactcaccagttgatgggattgatgttactaataacagaccagagcttgctatgcttgcagacctatgtaatatgcataacacagttgcactacctggtgatgattgttcagtcgatcagtcagcagtggtaaatagtgtttccttgacaggaagagttgcaaatactgtttcaaatcaatcatccaagttatacatgcctggcccctcaggtgaaggtcagtctgcttggaagaacaaagaatatcaaccaaaggttttaacattggatgttgaagctgctttgcctccatcaaaacgtcttcatcgtgccttagaagctatgtccgctaatgttgctgaaactaataatctgcctgaagtgacagggtcaaagcaattgattccaaatggttttgtggcttcagaaaacagccactctaataaatctgcagatgcagtagtcacagccactaacggatctgcaatagcagaaagccctaggccatctttgtgcacagaatccatgcatagcccaaagtgcaaaacacactcctcagaatcaattctgcaaaataacagtgttcctgcttctgcttcagttccttcagaagcaaaagatgacagtcatgttacagaaggcaatatttgtgaagaaactcacgttgatagcaaaactactgattgcttgttggtctctagtgaagttggcaatgacgactgcgggaaaggcttggctctttcaatgaagctgaatgagtctgctcttggtggtacacagactgtagctgtacctgatcgtttatcttcatctttggggacagctagtgttagcgaggttgccaaaccaatcaacttcaatgaaggcccaaaaccagttgaccgtcctgcatatgatactgacagaagtgttcaaagatgtgatgagccaatttaccgaccaaagttgctttcttctaacaataatgcgatcagtgattctgtactgcataatgaaactgttgtagctgaaacagtagtcaatgtggctgatacagcaagcacctcttcgctggccactaaatcttccagtatacaatctgatgcagacacccggacatttgaagtgtaagctttcatgccaaattgtatcttccattatgtctgcatgagatatttgtttatcattatatgctccatatcttcttgttcataacctttttgtgacaaatttaggacatgcatgcttcttttccaaatttatgctggcattttctgattgaaacttcagaaagttgtgaagaagaagcatccatgcaatttgatttttcttttcctacgaaattcttttccttgtaatgtcaacctgatgttttcatccatcaaaatgcatttctttggagactcaataatgggtcaatgtatgtcttaaacataggtaacacttcataatctagttgactgaacaaaaaaggtgggcaaattgattcactctggaatctggataaatggcatgaatggttatcttgttttactcatcaacaaggatcttattattctaatgctcctgtcttgtgtagatttgttgctttatgagctggatacttgggttttcaaatattctgattataacgtctttagttatatcatatagattctaaatctttccatgttatgggcttgtggatcctaatatatgttttgtgggatatttcagttccttcacaatcctttattaaggagaattaatcgggactgttttctacctccatacgtccctaatttatttgtctgctctattttggctttaactatagagcctatttttggagcctgacattactagccagtggagactggagagcaatatttaggtcccaatggaaacatcattcttatggttcatgtctgaaatctatacattgagctctacaccttttgaaccttcttagcaggaatgcttattttgcaacgtacagtctgatgaacttatgacctattcatgtagaatgcctggaatagcaacttttttggtttatattgtacctttgaattactcctataacaactctggattagtactttataaatttgatacttgattagttgatttaagatggtcttctgaaaaggcatgacaatacttattgttgtattgcaggcacaccttctcagctttggcattaaaagaactgaaccatagaaacctaaaggataagagcacttctccagattcaatgcctatgaaagaacttattgctgttgcacaagctagaaggttctctcgatcaacttcttttccagataactttctgaatgccaagtatattcctgaaactgtagttgatacacctgctttcaaggaaggatcacagaagcaattgtcacctttgaaccggataatcagatccacatctacaaatgataatattcattctaggagtccttttgatagtcagcaacagaagaacttgagcaaattaacaggacatgatgaggctaatgcagcacgaaaggcttttggatcttttcttggtacactgacaagaacaaaagaaaatatagcgcgtgcaacacgtcttgcaattgagtgtgccaaacatggcgttgctggagaggttagaccatgcgtccatgcatgtcactcctagttttctatttggcacgtgatcctcatttatcatgcatttactgtgtctttcttaagtagtatcatcatttacttgcttatagatgtagcaaacattgttgctttctttgttttgttggtggacggggaagttagattcttgatttgcctaggctaattagtaattacagtgctatgttctctgtgccaagtgccaactaccatcttttttgtgatggatcatcaggcatctggaacttattggtgcttctcaaggatcaatcttatttaccattgaagtgtaccatctcttataatacgtagttgctacatgcttttgatgtgatatgacaacatatctcagcaacttatggacttcgaaataacctgtgataattctggtagatgttgctttgtttaccacttctatgttcttttagattatgaaatctcatctacagacacatgcatggtgcttttagattaccaataaaaagagggtacatacctttctatgcaaccaattgccaaatatcaattttcctgatttttttttcttatttaggcgattgatattatcgttgaacgcttggagaaggagtcgaatttatataagagagtggaccttttctttcttgtggattcaataactcaatactctcgtaaccagaaaggtaacatatagctttcatgatctttttctgtctatttcgcttgcactctatttttttaaattctgtaagaaatttgcaggtggagctggagatgtttacccgtctcttatccaggcagttctacctcgattactttatgctgctgcacctcctggaaattcggcatgggagaatcgaaggcaatgtctaaaggcaggcaccttcagcagtttgatagaactggtgtcatgtgcaattctccttttctcctcttaaaaactttgtgattttatcttcaggttttgaagctttggtttgagaggaaaacactcccagagtacatcattcgccaccatattagagaacttgaggttatcaatgaggcatcttttggaagttctcgccgtccttcaaggacagaaagagctttaaatgacccgttgcgtgacaacgaaggaatgcttgttgatgagtatggcaggtatgcttgtcaaactgatgtatgaaaagtagtgtggcatgcatataatattgtaatgttcataaacgatagctagatgaattgtgcagacaaaatgggatcacgtgtcgaagtgtagagaagcaggcaaagccacggtagatttgatggaacactgcaattttgagtaattttcttagagcatgggtattcttcaggtagtcttgttggtcagttaagcagtgttctatgatatatgaatgatgctaacatccaattagctaatattggataaaactcaccatgaataaataactagaaaaaggagtcattcctgaaatattgggggtgaattttagtgggcgtcctttttcatattatctgtgagacaaagctattttaaataaaacaagatatgcattaatgcatgcagtgcatgaatatgtcctcattacttcatagctccatgttctacatattcaattatatagatgtatctcatccagttctttccctatgtttgtatgttccattgttttccgcagcaatgctggttttcaactaccaaacttaatttccacaaaagtacttgaagatgaggacggaagctcctctgaagatagaagttttgaagctgttacacctgaacatgatgctccttgcactgatgagaaggaagaatcacaaatgcccgcagaaaagcatcatcgcatccttgaagaagttgatggcgagcttgagatggaggatgtagctccaccatctgaagttgaagctagcaccagatgtcggccagaacaaattgataccaaatgcagaacatctgatcgacatactttaggtcctcccctccctgatgataggcctccatcgcccccgccattgccatcatctcctccacctgttccgccaccaccacctgctccaattactcagactggacagttgcagcgaacattaccaatggcatctgatccagttggtccgcatcctacaagagctaccaatgtatgctcatatttgctttctgtgcaagaaggaatttatgcatttttattttagaaactaatgattcattttctttgcagaatattcagacgcaacagccaaattctgttgtggaacgcccaggcagtatgaatccttctgtagcgcaattgcagcctccaccattctgtaattcaggatatggggggcatccaaatcagatgccaccgccgcccccaattgcaccacttaatccgcctggaccccatggcaattttcctgcacctcctgcaccatatcatgggaataactatcatcaacccccaatggcatcggtacctaacgaaggatatcatatgcaaccaccaccccctccacctcctataaaccaatgcccctatcgaccaccagaacctcagcaaagaccacggccttggagtaataatagttcatcctatcctgagagatatcggtatgatggacatgatcgagatcatcacaggcatgatagaagacatcatgggcatgatagacgacatcactttgatgatagaggataccactatgatgatagaggatatcactatgatgatagaggacattattttgatgatagaggacaccattttgatgacagaggacgttcctttgatgagagagctattaggggaccaatgcaccacgaagttgctgacaggggcagatttccttttcctccaggtacttttttcgtgaatcattgtcgcttttttcctggcacagttttcatcctgtaaggtcaccctagaaacaccagccatgaattgttattgtacaactagatgggtactccacgcgttgctgcgggagaattgtgtgataatatagtagatatgagttctaaaattttcattcttactccctccgtcccaaaaaaagacaaaccctgggtttctgtatccaacgtttgaccgtctgtcttatttgaaaaaaatatgaaaaaaattaaaaagacaagtcacgcataaagtattaatcatgttttatcatctaacaacaacgaaaagactaattataaaaaaaattcatataagacggacagtcaaacgttggacacggaaaccctaggtttgtctttttttggacagagggagtacctactatacgattttttttatatgtttatgtattttttacctttatcaattatccataggttataaatgattgggttgtatagtgtgccttttggggggaagagatgcaatttaaacccttgatgaatcatccaaaagctaaaaacaattgaggtgatgtggcttcatgagagaagagagaattagcattaattacacttagtggggatgaactttatagatatatgattacccaattaagttaatctatcccatgctgtaggaccctcaaaaacagcagactaaatgttctttgttcttgattattgtccagggcctcctggtccagaccattttgaagcatcgtcagcagcaccagtgcactacggacgaccatcagatcctccaccaggtccttgctctgggtggtctatgcctcctcggtcatcgaattattctccctccagacattctatggagcctccagttccacatgtaggaggtatgttacatgctctttcgtcctgcttcataatgtaacttgcattgatttgcctcttaccactagatattggtttgtccaaagaatccagtttcataagcatttgtcctgtaaggagcatttatatggtagaaacttttcaaccttaactgtagaactagagtgtaaactgtaaagtcatgaggggaagcttgaaagagaggaataacattgttaatgttgtgaccaaagtcttgggaccattttgtttcctttctaatattacctacactagtcctaatcaatatttcgtccaagttcatgacatattttggttgtactgtacgaaatgcttggcataatacgtgtaagaataacacaagctgttccaaagaaagtaacttcaggtcgcatcagattacaggatactaattcatcatcttttatcgcagcacatggtagctggagaccaagataacatttttgctatccgtgaatggtacgccatttgttccgttcctcttgttaccaccatatgccacaattatcttcttctctgattcatctgacatgctgcttttcagggtcgatgcttttgtcagctgggcacttcgagatgctttcgttgatgctttctgattcatcggtttggttccttcacatgaagacccaccaaaaaggagggagataagtacctgccttcctccttgtaaatatgtatcttagcatagtaggattgcagaagcggaaggcagatcaatgtattgtaggaatagaggctgtcaatgcatcaatctttagccataggttgtattgttagcctaacaatgttgtatttctcttcggagaatctcattgttcatgtccattcatgaaaccctcctacccctctgacaacaactaccccaaatgatttactgaaactgtttggtctcatcgtacataaacaaataaatacaaatcattttgccgcagttcttttgttgtgtaaatatcacctggcatagctgcagaacaaggcatgcttgtgttcctggagcacatcattagcttttttcagcgcctgcgtttgtgtaaatatttagaagctaatggtttgcgagataaattttaccatatttgcactagaaattgtgctgtaatgtactttgtcaaaaaggttaggctattcacatattgtctcacatcagccatggattatttgttgcgaatttagtttgaaatgagtcgccagccccattggttacactaaaaagctaaagcaaagccaaattttaaaatttaaaacctaattttgaagttgatttttaagatatttttaacatagcattttacattgatttctaagttgttaagaacacatatagaagttttagataaattattttctaattgctaataaaacagttacggtttataaccagttttggacattatgaatgcaaaagcttggctgatgaatttacagtgtttccaacatagatgtgcactgaatgactgaattggcctgtttggtttagtgtcaaccttagccaaacttgtggcaaaaaagtttgatcaactaagactagtcctcttgtcattgaatgattttttttaccacaattgtggctaacacattcataaccatacaatatgtggcatgccacactttatcaattatattgtggcaaaatatactcccttgatactatcgtgccaccgtgttaagtagttgcacatgagctcggtatttaggtgattatgatgctgttgctgattactacctccgccctggtttcataattcttggtgttttggatattattgttgtcaaacttttataacttcaactatcaataactttaaaaatatttagtttaaagccattagaataacaaatatagatttattttacaaagttctctattctagttttcatagggggcggatccataattggagccggccttgatcatcattcatcaagggcggacccaaaattgggccacgacctgggccagcccattatagcttgagctatgaatatcaatggaaaaagtccactttgactcccttaaatgtacaacgaatctaattcgtacccctcaaccagaaaaccggttagaacgactcccccaattactaaaaccggtacaaattcactccctcaatggttttgaagggcggttttgctgacgtggcgctgatgtggcagtgttaacttggtcttcgtcccacgtgacgctgatgtaagattataattaaaaatatatatgtgggacccatttattattcacaaaaattataataggatccactaatatgtggagtccacatgtcattctcttcccaacctttcttcctccccctctctctcccttatctctctctttctcttcccgtcggcgagcagcgcggagagcttgccgaggcaacggatggcggagcggagagtggcaagggagtgtgcgaagccgtgggcggcggtgggtggagaaggccggcatgaaggtagggcggagcagcgctgcggcggcatcgagagctgccagtcgccgcggtcgctgctgtcgcgtatcctgtagcgaggagacggcggcggtgggaagttcgggtgtcgggtgcggctgccgcggcggtaaagctccacctccgccgccggcgttggagttgccggagaaaaggagatgatgtcaaacgcgttcaggctcgaccgccgccgcgagctcccgcccagcccgaatctcccttccagcaacgacggcgccgccatcgccccggtgcactccgccgccgacatcgccgtcgccgacaccctctggaaggccaccaccacggtcgggactccccttgcgcgagttgctcacgctcgtcaccagcgacgacgacgctgacatggacacgtgctgctgccacgccgccatggcggcatggcgccatccactcaccgaagtagtaattagctagctagctagctagctaggcaacatgacgacgacactagcttaattagcttgtgtttagttggttaatttagtgttcttggttgctcggtgacgtcattagctaagctagcgatgtagtagtagcagctagtgggagtattaattatcactcaaggcgaggaaatcgacgcccagaagaggggccgcggccatgctgcccagatccatcgccactccacccggccgccgctgccgccgatgcgtcccaagggggaagagggggaagagaaaaggggagagaaaagagagagaaggagggagcgaggaggaagaagggaaggagaaaggatgatatgtggccccatatgtcggtgggtcccatgatatattttatgtgtgaatgatagatgggttccacggatatattttaattctagtgccatgtaggcgccacgcggaatgaagaccgggttagtatcgccacgtcagcgccacgtagaatgaagaccgggttggtatcgccacgtcagcgccacgtccgcaaaaccgcccttcaaaaccactgaaggagtcaaattgcactggttccaataattcgaggagtcatcctatctggtttcccagttaagggtcacgaattaaattcggtgaccaattaagggagtctaaatggactttttccaatatcaattacatggtggaaaacggaataagttcactttgaccctttaaaagtgacccgaatctaatccataaccctaaaccgcaaaaccggataactcgaccccgaactattgaaaccggtgcaatttaactctctaggcggttttggagggcggttttgctgatgtggcacttacgtggcggtattgaccgggtcttctttacacgtggcgttgacgtgatgcttaagtggcattagaattaaaaaatatgcataggattcattagtcactcaaaaagagaaatgtgggcccaccgacatgtggtgcccacatggcagtcctccctgtgtccttcatttttcctcctctctctctcccttctttctctttctctcccaatgggaggaggcagcggcgcgagggcggaggcggagcacacggccgacctgcggatccggatcgcctacagtactgcagggaagcactgtccatgtgaggggaacagcgatctaaggacataaacagtggctatttactatagctacaggatatccttccattctcgattggacggtctacagtacccctaatgtgcggtactgttcatcctctgcattagtacctctaatgcaaaggatccgaattgccggcctgcacgccatggcgacggcggtggcagcggccgttgatccatctgtagaaggcggcggccgccggcggacgttgtcggggagatccccgacctcgccctttccatggcggccaccgccggatgccgccgtcttcactccccgccatgcccgcatctcccccgctcgccgccgtctccgcttgccgccgctgcccttctgcggtctcccgcaacgacggcaaggtcagcctactaggatcttcatccattggcaagatcggcaagcatgcagctcgttggcaaggacgagtcggtcaataggcttaaggccgtcgtccagaaactgaaggacatccgcgcgagctccgggcggctgatgcaggcggcggggctgaccaagccagggtccggcgagtcgagcagcaccctcctaacctcggatggtccggtgatcaccggctcgattctggaggatgctgaggtgtttgggcgtgacaaggggcatgagcaataattggtgtcttggctagtcggtagcacgaccgaaggcgaggatcggagcgccgcttctgacaccatccccgtcgcggctatcatttttttgagaatgtctcgtcgcgccggttcttgctgattcttgagaatgtctggaataaagatgagaatgagaattcgtacagggatatgtggactgatgtgttagctcccctcagatttggtcgagctgggagtaagatcgtggttaccaccaggaagaggattgtggcagacttgctgaatgagggaagggagagagagagggaggagagaggatgacatgtgagccccacatgtcagtgggttccgcatgccatcctttgtgtgaatgataaatgaattatttttttaattctaatgccacttaagcgccatgtcaatgtcacgtgtaaaaaagacccggtcaataccgccacgtaggcgccacgtcagcaaaaccgttaagggagtcaaattgtaccagtttcaaaaagttcgggggtcgagatatccggttttgcggtttagggtcatggattagattagggtcactttttagatagtcaaagttaacttattccatgtagatagtcaaagttgacttattccgtggaaaaacaaacttcatagtgggattgcatcataggcctcaggccatggcccgagctgcccgaggcctagttccgcccctattgatcatcatataagatttttaaggtcttcctaaatgaccatcctctaacaaagtgtcttttcgtttatttgtgcaaatagtaaatgagcattattgaatgtgctacatgcaatcaaccaatattaatttatactagttggcatcccacatctttgccgcgggttttgtagtttatcatcaaacaaaatcatagttttaaatagttaaggtacaactctatatacatacaaactatatgataatgtggatttatatatgccttatgttattacaatataattcatgctttatttttccatgcgtcattgtgcattgttataatatatgaatttcatgcgtaatatatgggtatcgttgtagttagacaatttgcatctctctacttcactcaagttttttttttctaaaaatagattcaggtaacgatacctaataattatatgctatcttgtcatgcataataaaacaaaacacacatattaaacaataatttgaattgtattaggaaaacatggtgttatgcataaaatatgtaacagtgctatgtgtgactatgaagtagagcaaaatgaggtgaatggataaataataaatgattgaattggaagaataagtagcttcttgatccaacggttgttatctttatactaatatgatgtgatggcttaaaattgttgatgatgtggcttcttgcatgtcttactttataggagtaaatgccctttaatgggtaccaactatatagaagataggattggtgaaactccattcaatatataaaacgtgatgcaatctatgagacacgaaacaacatagcaccttgactgatgatgattaatttcataatagtgaagtttttgttgtccttggtctctgtgtgtttgcttaggtgatattcaaattgggatagagggagtgctataataaaagtaaatatatatttatttattgtatatattataatagaaaaaatacagtcaaatatatattctggagactgttattgtccaaaatatcaagaattataaaatcggaaagagtaagcaatcttaacaatacaaatgatagtcaaaatcacttccgtcttaaaatataagcaaatttatcaacacaaatgcatagtaaaaatttcttatattttgaggaggtagtataaactgtctttttgaggaggtagtataaactgtctatttgccatgataacattgccatgataacagcatcaatatacttatatacatgcatcttatagaaagcaatatacatgtagacaaagacctttttttttaataaagtgcacgagcggtctctaaatttgtgcagatgtgtcacctagatccctgaactctcaaaatgcatttttgggccccttaacttgtttagggtgtcatataggtctaaatgggctccaactcacaccgtgtgctgatgtggcatgccatggtggcacatgtgtcagtagaacctatatgtcaatcatatatagaaaaaattaagaacaattttttcctctcttttttcatttattttttcaaaattaaaaacatccttttctcatctctctctcctttctttttaaattttatttttttatgcgaatgacatgtggatcccattaacacgtgtcaccgtggcatgccacgtcatctcacggagcgggttggagtccgtttagacctacatgacactcataacaagttcggggactcaaaaatgtattttgagtgtctagatacctagatgacacatctgtgcaagtttaaacaccgtccatgcacttcactcaatttttttctttgcacataaccattaaccaaaatgtcactaacccttcaccaagagtgcatctgtgcatgtcaacaggatggccatgggcatggctgaacaaagccttgtatcccattgcatgccactggtatgaagcacctaattttaaccatgcttctcttctcaaccccccccccccccccctctatcttggttaagttacgttacccaactacttgaaaacaattaagtctttatatatatataagtagtggcacttagccagagagtgaggccacggctatctatacactatagcttagctagctagcccgccatggcggcgtcggcgctttcaagcggcggcgatcgccgccgtcctcttcctcctcccttccctcttcgcggcgtcgcggcgcagtccaaggccaaggcttctgcatcagccagttcgccatcgccagccaggcgtgctccatcctcccgcctagtccccccgacgagcacgacgacgacgacgacgacgacgacgacgacgatgatgacgacgacgacgacgacgacgatgatgaccacgacgatgacgacgaccacggtggtggtggtgacgacgacgaccacggcggcggggatcaccaccgtgtgcgccaccgccaccgccaccaccgcgaccgcgggcgccgtggccacgccgccgtggtcgacctctcggcgctcgtggcgggcaacggcagtggcagcacgcagatcgcacccgccgtagccgggaacgacaccgcgggccaccgcggcaaccgcaccggccgtggcggccgcggcggaggccgcggacggcgccgcggccatggcaggcgcggccgtcttcgcggtgacgacgacgacgaaggcggcggcggcgacgacgatgaccaccatgacgacgacgacgaccacgagcacgaccacgacgagcaccacgacgaggagctgagggcgtaccgcgactgctgccggtggctgcaggaggtgtccaaggactgcgtgtgcgacgcgctgatgcggctgccgccattcctggtgaagccgcagcacacgtacgtggtgagggtcggaaggacgtgcaagatcacctaccgctgcggcggtgtctagccggcggcgacgtcgccgccggcgaggcgaatgcaagctactcgatcgtggttgattaccgagctgagtttgggttggcgtcacgtcgttgctcgcgtcgtcgtcgtcgtcgtccctctgttttaactgtctgtttttccattatggttattcatgtttgggcatttatttgttctcctaattagattattattatcaggtagatatatatgaaatatgatgaggtccttgactatcagctagattttaaaaatctgaacttcgggatttatgtttcaattttgggtttcatgattaaaaaatcaatttaattctaagaattttaatgattcaggcattaaaacctcagattcttatcataggattcataaattaaatttgaaatttaaattcacttgacgaacttcaatttaaacttgttcttttttctaaacttgaaaaaaaaagatgtactagtaattgtggcttgcgattagatcaaactacgagctctaacggactgcgaaccgagagtaggagacgagatacagaggaagatattctcatatcagtttgcagtggtctaatagccccaattaacttgatggaaatagcagcaacaataaaatagaggaagggtaagagaaacaaatcctctaacttactattatctgattttgagttactgatatgtgaacccactactggtggccaacatatcagtaactcatgtgagaggataatgcgtcaaaaggagtttcttcctagctatttgtagatggttttctgctgtatcgatcgcccgatccatacagcagaaactaaccgagccaaatcaagcagcagcagatcgagcaggcgccaccactcttgcatgattcaacaagccggcccgagcgcgcaccggccggcagctagcagttgcatgatccatcgggtcggcgcgcggcgcgggcgtgcggagagcgcgcgcgcgcgcacgcgcgctgaggcggcttcatcttggcaacttacccggccgcgcgcgtacgtgcgtgcgagctcgtcgtctcgtctccgtggaagcgcagcggcgcgtaccac

SEQ ID NO: 13547 - DNA, 16939 bp, Oryza sativa
atctcctcgccggtgagcgccgccgcgcccctgcaggggtggtacacgccgctgcgtgcccacgagacgtactgcggtgtaccaacgcgcgtacacggagcgcgcggacgacgaagccccatatatatagcggtgcacggagtctcggtgatatatcaaagtcacaccaaaataaataccaattaaatatttttaaaaacaaaacgaattatcgatatctaaaaagtcaataataccatatattaaaatataaagatagtagtactgggtagaaactggtcctctcacgtaaaatcagaaggacgtgggttagtgacgcataaagttcgcttgatattcgcattttcgtatgaatgtaataattaaaattttagaagcacaaaaactgctgcctcgtaacaatctaattaatattgggttattctattctgtttgtcaatacgagccatacccaaatattaataacattatgctttttacatttatctaatatatattgtggcaaaataaccgtgcttactctgctagtaccagaaaagtgctcaatagtcgccaaggttgcgtaggctactattacttgggttacttcatttgtttccaaacatttctccacattgactttgatgttttaacttcgaaaagaaataacttttaaatggttagattatgagacggaagtttcttggttgtatttgtgtatgatgaaacaaactgtacactcattgtccggtgggtacgtagtttatccgtcatgatcaaaatttaaattttcaaaaattaatcttagaattgattttgggattctattattgtagtctattttccaagtccagcttttaaatcgctataataatataaatataaaaatttacctacaaattatttttaattactttatttatttttctatggcttatcagcctcatccagccgaacagttaagcatttataaatttattgctaaaagaacatgccaaattttaaatttgaacaatatctggtcataatattctaagattaatggagataataattaacgaagaagcagccatatatacgtaagccatatataccaagaaggcttgaccacaagcattaccaaatcttggtagcgaaacgaaatggtcggcaaattctgttggcaatgccaaattaaatttcagtaacacttattttggtaataaccctattttagaacctttttgcttggatgtggacacctcgtaggatcacgcaagacctgttctattcagtgattcgtatacctcataaatggttaggggtgggcgttcgttttcgactttctaccggccgagccatatggaaatggtaatcgaccgaaacaaaaatgaaaatggtaaaaaatatggaaatgaaaacagaaatggttttgctgttataccgatcgtttccgtatttaccgtattcttgtggaaattaccgtttcttataatatggtaattaccatattctaaatatgtcgatatttatagagcatgtctatacttgacccgcagcttacatattgactgactcttcaatcaaatctctaacttttgtacatggctaaaatgaagttaatttataatttatatagtataagcttgaatttatgtatacatataacatacttatgtaaagttaaatatatgtttttatagtttaatgtatccgtatttgttacctgtttccgatctgtaccgacatgtttccgtccgtattgttccgttttcggttttccgatatttccgatatcgttttcgtttccgaatttaccatttccgatttcatttccgagaaaaatatggttacggaaatggttgaggctgttttccgatcgtttccgaccgttttcatccctataaatggtaacctgagtactcgaccttttctccttaaatttggatgcgtggtagttaagatgttgtgcactcgtgttctgctaactaatatcggacacaagatgactagatgagtcgtgcagtacactacggcttcttgagatagccaaaactcgaaggatgaagggtacgtgtgcaagaatccacagattaacaaggaaaaaagacgctccctgacctcgattgatccttgtgacgtcttcttttaaaaatatagataacaggtacgtatcatatgagttatctccagtgaagtccatagagtatgtactccttttcttttactttatttagaggtgatttgtaggcggagctatatggagagttatgccttgtgctgtggattgatttgcctaggatgtcaaataatcaaggcctaatttctaatttctaaagcgtcgaaatattacaaatctgtctggtagaagtggatgtggttaggatgcatactccgaggaccggcgagggtcaacacacacgggtgctcgacaggagggattggttgtcatgacagtttctagatccgatggagggatgggttgttggtgtggggatgagatggccaagcagtgagataggggccagaggcagtgactaaaggaggcgcgctcagtaggaggcggcgatgttggagctggatcggagcacatgactaacataggttgcagtggcacttgattaagaggggagagatggatggtgggctaagtaggatgatagagaaccttcgacttctttacgagacggtactaggaatcaagacgagatgatataggtctaaagaacccaaaacccaaaaccactactggacatatgagattggtcacaggtctggttggaagctccagagttgggagactcttgcacctcgcataggtaaagggaatccatggctgaacgctagatggaaattagactaaggctgaattggcactcacctttttcaacttatacttcctcttttttcctgtgtgcacgctttctaaatttctaaacaatattttttaaaagaaatctaatccattttcaaattatttttttgctaatgtttaattaattatatacgaatggatcgctctattctatgtgcggggtggtggagttcgtaaccttcgcctcaaaacacagcctaatggcgccgtaaggagcaagtgacattgggtgacgaggctgaagcaatagttgatgctagaggtggatgacggggctggagtggcagctgtcatgaagtgtggccagccaatggatccaggaataaatagcaagggatctgaatgaactagacagagctacaactttcccttcttatttatgtatgacaaaataaattagtgggagctttgtgggggtttctatagttcttgctttagtagaaggcttgaacccttgctgtccccctggtagatatacccccttggccggtggggttggccatggaaggagggggctctcatgcaatagtttcatgagctatcttttatagtttaacggtggagcaaatttgatgcagtcatagcaatgccacttcaatcaactacaagaaaattaaatggatggagcggttcgagcctatggatgcttatgctagattacctgtcgtcttagtattacggatttatacaatggacggggtaatattatttcgtattatctaattaccacaagtactgtagcgtagctatacaaattaaagtcggtcccttgaccccctatcttaacacttgtacagttaagatagcaaatcgaattgaagaaaccgagcgaaaaaatagcaaatggagtagtacataattacgctttttccatcaccttggctgctacgtaagcaccgagtaggaaagcggcgaaggatctgtaaaacataacctcctcctctaacttgcgtatccttgctgcattattctgcgacgccgccattaccgtttctgttacttgccgctgccgcgatgccgtcgtcgccatcgcccttgccgcctgtttgttggctgaaccactggcactaccagcagcagctgcgtgcgacgccgagacgttgttgtaaccgcgaactgctcccgcgaggccactgccgctgccgctcctggcatgctgggtgaccacgcgtgctgccgcttgacgcgccaaccgctgcatcatcatcacggatccactcatcttgatcgatcgatctctcgctcgctatagtgccgatcgatattgatcaattgactctacgtgcgtacgggggtaaaccaaaatatatagtagtactggtatacgtatgtaggcgatcgattcagctacaggttgtccgattcgaggctggtccggagaagccaatccgagtctgactctggtccggagaatccgattcagggagtgtctgatcccggttgctagctgctgcccagcagcacagcttgtcggcgaatcagacggcggcggcggttagctgcagccgtcaacaactcgccgctcgtcgtcgatcaactctcccgctaagtttgcttcctctcttggagtctaaagatctacttcattgtttagactcgttgttctaggtggagtcgcatcactacgtagatcgactcttttttatgaagggagtagacaaaagattttacttgttaattacatatattctccttttcatattatattatatatacgatgttttgattttttttatgaaactatttaaagagtgaattgcatcttgggctagtgtttattacatattgacggagctcgtggctcctcaccgggagaccgcgcaggcccccctttgccggttcggccgggggcttagggtgcgatctcaagctctctctgtatgtggaaagatgctcgccggcaagacacacgagacacggccgatgtatacaggttcgggccgctgccaagcgtaataccctactcctgtgtttttgtggatttgtgtatgaatgagctacaaagtgagagcccacttctcccccgctctaggctctaaatctggcaagaatcaaccaaccctttctctatgggcaaggtcctccttttatacttcaaggggataccacatgcacccttccctttccaaactggactgttcttcttctctttaatgggcggagattggtatggttgtcgtccaaatgacacttcgatgggacagctcacacctacctccactcccggcggagacgggcgcaacgtgagatcgtggctgcccgttgctgatgcgaccagtgtcagaccggtcattcttgtccaccacgcgtcagtttaacaacgtgcatgtttgcccttcttcgtgtaacaccttgcctgtaatgattaggatgaagcctggtataaatctaaccagggctaacgtgccatctctaagagataacacgctagctccggcttgagacgagttgccttgaggctttcgtcttgacgggatggggcgaggcgtgcgtcagaccgccagtcgccacctaacccttgatctgaccggtctgtgactggtcacagaccggataaaagagcgtgctgtactgcgttgcacgcagcgtgacacgcttgaccagactgcaataaatgctgttaggtgagcacagctgtgctcacttatcccatatatgtggcgcagacttctttaaggggtcgggggtgccccggccctcggggccggagcaagcgcaacccgacccccccctcaggggaaatcacgaggagggcggacacctcaccctcgggcccaacgtccccgaaggtgccaggccacgtgggcgattgcgtctgcctcaagcctctggtcatgatactcccggtcccatatcaccgacagtagcccccggcgttatgccagagcaatttcctttcccaagggaagcggtcaagtgtgacgccacccctaaagcctggtgacaggtgggaccggtctccgtagttgggcaaaatgcccaacggtctcaatccatgcacattggtattgataactttggttgtccataatgggcggtctattcaagactgccacaccacttgagcagcgcgcgaatctgggtgagcagatttgtctcgcctggagatacggtaacgccgcttcggacggcgagcgtaattaacgcgcgcacgatacaatccatttcgattgccacaaccgcatatccacttcatgcgccgtaagcgggcgaatgggattagtggaagcgtgggcacgggaaacgagggagcgagatagcgagatacgagggagcgaagtagtgggcgcgagaaacgaggagccaggcccagcgattgcaagggtataaaagcatcgagaaaaggatttgctcccttcctttcgccattgttcctcttgccttcgccgcctgagctctaactctttctctgctacgccctactttcgccacacacgctcgttcccaatcatctcttcctccaccgccatggcacggggctctgctctgctcgacggcagtgtactgccgccttcccgcatcgtgaacgagaggcacgccggactgccgcgccgcttcatgccggagtccgccaccggtcgggagatagtgatgctgggcgaggggcgcccggcaccagactacccggggcggtccatcttcttcctccccttcgcaatggctgggctggtcccgccattttctcatttcttcatggatgtcctggagttctacgatctccagatggcgcacctcacccccaatgcggtgatgacattggccatcttcgcacacctgtgcgagatgttcattggggtgcgcccctctcttcagctgttccggtggttcttcaccgtgcagtcggtgtcaccgccgtcggtggttggcggctgctacttccagccgcgggggccggtgttgaaccgctacatcccctgcgtcctccgcaagaagtgggacgactggaagagcgactggttctacacccccctcgccgacgaagcgcgcctccgacttccaagccagcccccggcgcaggtctccagctggcgggcgccggtagatctgggggaggagtacgacgccgtcctcgaccgcctggtgggcctgcgatcccaggggctcacaggggccatggtgttcggcgattacctccgtcgtcggattgcgccgctccaacggcgcgcccggagcgcctgggagtacactgggcctgaagactacatgcggacccaccagggagccagatgggattgggctcctgaggacttcaagatcgtagtccaaagggtgctgaatcttagctccgcggaggcgtctcgccttcctcaggagatcctccccctctgcatagatcccgaccgcgtctccattctaaccattatgttgggggtcggggcctcagaggagagagcccctaagggccacgacggcgcgggcgagcgacgccggagggaacaacctgccccaggagggggtcgtgcttctgggccccgcgtcgggggctcggggagcagccgccctgccgacgcccaggggaagaggaagctgggaggtacacctcccccatctcctccccgagggggcagggcggcgcgtgccagcagtcggcgcccggagggggccgcgccgacgtcgcagcccgagggggtgcgcaagaagaagcggctccgcaagacgggggagacggaaccgtgccggggaaacctgatttcccctccaaggtggtcattcaaccgaccccctcgcaggttcgtctcactctcattgcaaccatctttctccaaaaagaagtttttttcttgctcactttgttcgtcttctggctttttttttctgcttcagcgatgtcccgtcgcattcctcccgccaccccaagtccggccagtccgaggccgaagatccagcggccgcagaggagcggaggcgagagtctgaccggcgtgaagccgcagcccgccttcgggaagctgaagaggccgcccgggaggccgcccgggttcgccaagcggaggaagctgctcgggaggaggccgcccgggctcgccaagccgaagaagctgcccgggaggaggccgcccgggctcgccaggctgaggcgtcagccgctgctggcgcgtcacttgggcccactccctcgggcggccctcaggcgacatcctccgaggcggctcgcgacgaggccgcgggcgcatcgcctgggcctacctcaccgggcgacgcccaggatcaaacgggcccgggggacatccccgagcccagcgcatcctccggggggccaagccgcgtcgccttttctccaaggcggctcttctcctcatcttctgtcgccccgctgagcgccgagccccttctgcaggccctggccgccgcaaacaccgcagtgctggatgggttcaacacccaagtggaggccctgcgcgcagaacgagcggagctcgaggccgcatgggcgcgtgttgaggaggggcggcgctcggtggacgccatggtggaggtgggccgtaaggcccaccgccgccacatctcggagcttgaagcccgcaaggcggcgctggcggagatcgcccgagaggtggaggaggagcgagaggccgcccttgtcgccaccaccgcgatgattgaggcgcaggactccctccgccttcaacacgggagctgggaggcggagctgaagaacaagctcgacgccgcccaaggggttcttgactccgctgctgcccgagagcggcgggcaacggaagccgaagcggcgtcccggcggcgcgaggaggcccttgaggcccgtgccatggcgctggaagaacacgccggcaccgtggagaagggcttcacggaccgcgaggccgccactgctctccgggagacgacgctggcggcgcacgaggccgcctgcgccgaggaggagtccgcgctccgccttcgcgaggatgtactcgctgagcgggagcgagctctcgaggaggccgaggccacgacgcaacggctggcgaacagcctctccctccgcgaggcggcgcaagaggagcaggcgcgccgcaaccttgaatgcgtccgtgccgagagagccgcgctggagcagcgggctgccaacctcgaggcacgggagaaagagctggccgcgagggcgcgcatcggtggggcggctgcgggcgaaagcgacttagccgctcgcctcgcggctgccgaacacaccgtcgctgacatgcagcgcgcgctggattcttccatcggggaggccgaggccctccgcttggcgggcgagatggggcccgacatgctttgggactcggtctcccgcatggatcgcgccggtcggcaagcgggcctctggaaaggccagacgaggacgcgcccttgcaacctggaaggcctcgctccgcacctcaacaggatggcctgggtcctcgaacgactccccgaggagctcgagaagaccatcaagtcatcctcgagggacctcgcccggggggcggtcgaactcgtgctagcgagttaccaggcccgggaccccgatttctctccctggatggcgctggaggagttccctcccgggaccgaggacgacgcgcgcgcgcgggtcggggatgctgccgaccacatcgtcaacggcttcgaggggtcggcccctcggctcgcgttcgtctccagctccgacgaggagggcgacgccagcggtgaggatgacggtggcgacgaggccggctacccgggcgcatcggaatgagcccccgagcccccgccaatctttactttttttctttttctttcttctaaggccttcatgcctcttttttgtataaattaactcaatctgcaatcagaaacgaaatgatgaaaaaatttttgtgttagttttattttgctatacatatgcgatgaggatgatctgtgccatggtccttttgcgccttagcttgaaataagggctcgtgcccaagtcccagtcctcgaatggctcgggtcggggccagtgcctggggagatccacatgtcgagactggccaggccgggaacgtggtgaccgaggggtatgggtgacccgattgtgggtttttgccgattcccccccggagttcaccacgccccggggcacggctcggttctgggccccgtttggcgattttagctgaccgaaccgagcccccgagggtggggttgagcacgaatgacattatttcaagtcaagattcctcaaaaggaaaaaacggctcagacacaacctttagaaaattgaaactgcttctattgaaatgctgaaataaaggaaaaaggaatatatgtgcatgtgtggtagcccccggctaacccggcacacccgaggggggtgtggggttagcccgagccaaaacctgacacccgaccccccccttcaggggtagaagcgacgaaggtgttcaatgttccacgggtttggcagctccgtgccgtcgcccgtggccagccgtaccgagcccggccgggggacaccgatcactcgatacggaccctcccacattggtgagagtttgctcaatccagcacgcgtttggacgcggcgtaggacgaggtcgtcgacgcagagtgatcgggcccggacgtggcgctgatggtagcgccgcaagctctgctggtagcgcgcagctcggagggccgcgcgccgccttcgctcttccaagtagtcgaggtcatctctacgaagctgatcttgatcagcctcgcagtacatggtggcccgaggagacctcagggtgagctcagatgggagaaccgcttctgcgccgtagacgaggaagaaaggcgtttccccggtcgctcggcttggtgtggttcggttcgcccagagcaccgctggcaactcctcgatccatgaatcgccgtgcttcttgagaatgttgaaggtcttggttttgaggcctttaaggatttctgcattggcgcgctccacttggccattgcttctggggtgggcaggtgaggcgaagcagagcttgatgcccatgttttcgcagtagtcgccgaagagttcactagtgaattgggtgccattatccgtaataatacggttaggcactccaaaacgggccgtgatgcccttaataaatttaagagcagagtgcttatcgatcttgacaaccggataagcctcgggccacttagtgaacttgtcgatcgcaacatacatatactcaaacccgcccggggcccgtttgaacggtcccaggatatcaagcccccagacagcaaatggccatgacagtggtatgatctgcagggcctgggccggctgatgaatttgcttggcgtggaactgacacgctctgcatcgccggaccagatcgactgcgtcattgagagctgtcggccaataaaatccttgacgaaaggccttgccaaccagggtacgcgaggcggaatgggctccgcactcgccctcatggatgtctgcaagaagctcaacgccttgttcctgaggaatgcacttcaggaggattccgttagccgcgcgccgatagagggtcccttctaccagcacatagcgtttggaaatgcgttgtacgcgttcactcccttcgcggtcctcaggtagagtcttatctgtgaggtatgtttggatctcagagatccaagcaatcaatctaagggagcttggagcgctcccttcgggtcccgaggcctggactccgacgggcctcgggggccggtcaggcgcatccgtctcccctaaggggtcgggtcgcgccgacggctgggtaagcctttcttcaaaggcgcccggtggggtctgggctcgcgaggacgcgagccgtgagagttcgtcggcaatcacattatcccgtctgggcacatgccgaagctctatcccgtcaaaatggcgctccatacgccgtacttggcgcacgtaggcgtccatctgcgggtcggagcaccggtactccttacagacttggttaacaaccagctgagagtcgcctaacaccaggaggcggcggatccccagcccggctgccaccctgagcccggcaaggagtccctcgtactctgccatattattagtcgctcgaaagtcgagacggaccaagtatctgaggacgtctccgtttggagaggtcaacgtgacccctgcaccggcgccctgaagagacagagaaccgtcgaattgcatcacccagtgggcggcatgaggcagctgtgaggggttcgcactggcctcgggcattgagacggtctctggagccggggtccactctgccacaaaatcggcgagggcctggctcttgatagcgtggcgtggttcaaagtgcagatcgaactcagaaagctcgattgcccattttaccactcgccctgtaccctctcgattatgcaagatttgaccgagggggtaagacgtaaccacagtgacccgatgcgcctggaaataatggcgcagtttcctcgaggccatcagaatagcataaagcatcttctgggcctgtgggtatcgggtcttggcgtcccggagggcctcactaacaaagtagacaggccgctgcacccttcggtggggccgatcctctttgctaggggccgtacccccggggcgttcttcgtccaagtggccccttggggcgcactcgtcttctgtgccgatgacctcggggtcggaggacgacaggagcggccttcccacagtggcctcggggccgtcctgggggtcgggggctcctggcatcgtcggacaagcgggcaaagggccaactccggtcgtcaggggcctctggcctccgttcggctcgggggcctcttctccctgctctttcccgggtcggctcagcacagggttagcctcggggtcaaagggcgttaagtgcggccttcccgcagtggcctcggggccttcctgagggtcggggacacccagcaccgtttgacaagcgggcagagggccgtctccggtcgtcaggggccttaggccaccgtttgactcgggggcctctcctccctgcctgctcctgggccaagtcggcacagagtgggggtgcgcagaatgaggattgtcctcatcgcgctccacaaccaacgctgcactaactacttggggggtcgctgctaagtaaagtagcagggactcatttggctccggggcgactagaaccggaggagagctgagatacgccttcaactgggcgagggcattttcagcttcctccgtccaagtgaacggccccgagcgcttgaggagcttaaacaagggtagcgccttctctcccagccttgatatgaaacgacttagggcggccatgcaaccggtgacgcattgcacatccctaagtttgctaggggggcgcatccgctcgatagctcgaatcttctcggggttggcctcaatgcctcgggcagagaccaagaacccgagaagcttgcccgcaggtacaccaaacacacacttatcggggttcagctttatgcgggcggagcggaggttctcaaaagtttccgctagatctgaaagtaaagtttcttggttgcgcgtttttacaaccaagtcatcgacatacgcctcaacattacgtcctatttggctacccaaagaaattcgagtagtacgctgaaaagtaggacctgcattctttaacccgaagggcattgatgtataacaataggttcctacgggggtaatgaacgcagttttttcctcatcctccctagccatgcgaatctgatgataaccagagtatgcatctagaaaacacaaaaggtcgcaccccgcagtggagtcgacgatctgatctatgcgagacagggggtaaggatccttaggacatgccttgttaaggtcggtgtagtcgatgcacatccgaagcttgccgttcgccttgggaacgaccaccgggttcgccagccactccggatggatgacttcacggatgaatccggcctccagaagcctcgccacctcctcgcggatgaaggcttgacgttccggggcctgccgccgcactttctgccggaccggccttgcgcccggccgcacggcgagacggtgctcaatcacctccctggggaccccgggcatgtccgctggtctccatgcgaagacgtcagcgtttgcccgcaggaaggagacgagcgcgtcttcctatttgccatccagaagaccaccgatccgtgtggtcttggatgggccgtcgcccaaggcaacctccttgaccgggacctcgtcgcatgtggcgatccgctgcctcggggcggtgggggcagaggtgccaagcctctcgtcaccaccctcgggcttggtcgcggcagcgaggtggtccgcgcgctgctccatgcaagcaagcgcgactttaaggtcgccacggacagagatggggccaccagggcccggcatcttcatctggaggtaggcataatggaccgccgccatgaacttcaccaacgcgggcctcccgaggaccgcgttgtagggcagactgaggtccgccacatcgaagcttacccgctccgtgcggaagttggcgggtccaccgaaggtgaccggtaggtcgatgtgacctaatggccacgtgtgccccggcgtcacaccgatgatcggttgagacggctggagcaccatccccggggccttgatagcatcaaaggccgcgggggaaagaatgttgagagccgctcctccatctatgaggacacgtcccaacttcacgttgcagatggtgggggaaaccaccatcgcaacctgccctccccgggcaatgcacggtgggtggtcggtctggtcgaaagtgagagcgacctccgaccaccgcgcccgacgcatcgcctcatgagtaggggccatggtcagaagctctcgcttcatagccttgaagctccggcgagagacgtgagcacacgctcctccatcgacggtggcaatggtggccccaggttcttggaaacctaggtcatcatcaccatcatcgatgtcaacagcgggggccttctgcttggcctcacttcgccgtttgccggaaggaaccgccggggacttgccctcacggcgttcctgcctcctgtcctcctcccacttcctcgttcgctcagccaaaattttgactgcgcgacagtccgcgagatcgtggagggaggtgttgtggacggagcaccacctgccggcgggacgctccctgctgggagtaccagcctctttctttttgtcgctcgcaggcctcccctttcgggtggcccgcggagtgccctcgacggcgaggacatgaccctcgtcgccggaacggtccgacctcttcttcctcctcctgtcacgccgccctgtctgagcggtggatccgggggcggccgaagctgccactccggaaccggaggagttccatgtccacgcttcctccttacgagccactcggtccgcgagctgaaaaagttccgcggtagtctggggctctttggaggcaatcttttcgagcatgcggttgtgccgcacaccccccctgaacgcgtaaatcaccgcgtgtgcagggatgcatggtatagtattgcggacttggcaaaaccgctgaatgtacgagcgaagcgactcattatcgcctcgctgtactgcatgcaagtccgcttcttcgcctgggcgcggatatgtgccttggaagttcatggtgaactgttggcacaaatcttcccaggagtggaccgacgcgggtggcaggttcattagccaaccccgcgcctgtccttttagggccatgggaaagaagttcgccatgaccctgtcgtcacccccagcggcctcgatcccggtcgtatagacctggagaaactcggtggggttgacgctcccatcgtacttctcggtgatggcgggccggaaccttgggggccaacggacattccgaagactcgccacaaaggctctacagccaacaccaccagccggaggcacggagggctggtcctcacgtccatgtcgaggtgacactctggacgaggaggcaccctccgttgcacggggggtacgccggctattacgccggcgctcgatgttgaggcgggcatccggctccccatgctgatcctcccgagtcgaaggcgtcgacgagggagtagcagccgaatgacgtgcagccgccgccgctcgccgcgccctccgccttgacgacacggagccggtggtagcggcgccggaggtcttggtggtggcggaccgtccaccagcacccaagcgctgctgagccgtcatgaccaagttggccacgtcttccagccatcgttgggctggagactccgggtcatggacgacaggcgggtgtcgtaggagcgcgccagcagcctgaagcgcgccctgaggcgtgctgccgtcgccgtagacgaggaggcgacgctccccatctcgccgttctcctgcatcacctgcggctggtgacgccgcggatttgtcgaccctctcaagcgcctccccctgcttaggactttggcgcggaggaggtggaggagtacgagctcgacggcgtggattcggctccccgtcgtcgccgctcacactcggcgagatgtcgtgcgtttttccttgctcggccattaggctgaacaagaaaaacttggggcacacggaagagtctgagagctcagaaagcacacgctgagacccctacctggcgcgccagatgacggagctcgtggctcctcaccgggagaccgcgcaggcccccctttgccggttcggccgggggcttagggtgcgatctcaagctctctctgtatgtggaaagatgctcgccggcaagacacacgagacacggccgatgtatacaggttcgggccgctgccaagcgtaataccctactcctgtgtttttgtggatttgtgtatgaatgagctacaaagtgagagcccacttctcccgcgctctaggctgtaaatctggcaagaatcaaccaaccctttctctatgggcaaggtcctccttttatacttcaaggggataccacatgcacccttccctttccaaactggactgttcttcttctctttaatgggcgaagattggtatggttgtcgtccaaatgacacttcgatgggacagctcacacctacctccactcccggcggagacgggcgcaacgtgagatcgtggctgcccgttgctgatgcgaccagtgtcagaccggtcattcttgt

SEQ ID NO: 13548 - DNA, 3374 bp, Oryza sativa
cgcagacttctttaaggggtcgggggtgccccggccctcggggccggagcaagcgcaacccgacccccccctcaggggaaatcacgaggagggcggacacctcaccctcgggcccaacgtccccgaaggtgccaggccacgtgggcgattgcgtctgcctcaagcctctggtcatgatactcccggtcccatatcaccgacacatatgttgcatattggactagctagtagcaagttttttcactttagaccatgttttattacctaatattgcgttttggactattttagtgagcatgtcagtcaccaaaagcatcttcttccacctttcatccctaaagacaattccagagcatatgctgctaaatttggtgaggagaagtgaatgtttttttttttgaggtgaacgacggcaggagctctgccggaatttcattagaggagagaaaaatagttcagagaatacaggggaagacatcgaaggagaagaagggagaaacctgaaaatacaaagggaatccgaaaaagaaaagacaattaggggggttggaaagcagtgtgtctgagatcaagttcttcctttactattctcgcaacgcgatcctctgtgtaagagatgttttgaaaaattcttctgtttctttccaaccaaatgttccaccaagtggcgagaagagatcctttaaccctgaatttgaaaggtttggggtgtagttgattgagatcagcccaccaagctgtgttgtcatctgcaggctatgcccccgggatgttttgctattggcacaccataagccaaacttttctgaagaaggggcagacattaaagagatggttagtgtcttcaaacgcctctccacacaggctacaaatccaattgcaaggccagtgccggtgcaaaagattttgggccgtgagagttttttagtgaaggattagccatccaaagaagcgcatctttggttcagctgggcacctccaaatggaatgaaaatcaatcggagagaaggacccttggaactgaaataaataagcactgtttgcaaagtaggatcccgattcattcaggttccaagtgatgtcgtcattggtttgcggtagaagctgaacattttgcagcattcccccaagctggacaagatcgctaatttcttcaattgtagttatttgccgaaaggaaaggagccaagaattgtttgtcaattccgttttaaccgatctctgtttgcgcttagctaggttgaaacacaagggtgcaatgtcttttggacatgtattttgcagccatttatcatgccaaaatttgttttttctccattacccacagttatcgtagtggcagcctaaaagagtcttttgtcgcagtcatcacaaggtaaatccattccaacccaaggcttgttgtcctctttccatttgaaccagagccaccgtagtcttagagcgcgagaaaatttctcaaggtctggaattccaaggcctcctaaaaatttaggtctacagactgtaccccaattaaccaagctacttcccggatttggtttgtctgggtcttctcccttccataagaaggatctgcggtaacgatctattctgctgattacccatttgggagcttgaagggcagttagatgaaaggtcggcaatgcacttaacactgattgcacaagaattcttctcccttctgacgtaaagtagcgtcctttccagctagggagacgcgatccaatcttttcaattagaggcaagaaatccactttcctaagctttcgaaaatgtaaaggtaagcctaggtagcggcaggggaaggatttcaaagttccagggaaagaagtaatgacatgtgtcaagtcggtggtgtcgcaacagataggagaagtgaatgtgaaggtagctcaactggcacaggaccaaaggcaacaatgacaagcatgagcagtgtggtgcttgagctcagggcagcgaagaagttggagccttcagaaagcataagcgtggagaccatctgctcattttcctagtcattaaggagccaacgaacagaactatgtgggcactgggcaggggcggcttgatctcgttgtgccctgctcatggctacttgctcagatctgcgtggctcttgaagaatgttgtggcaggggtcaccaccattcctccatattcggcccaaaacactactaaggaggagattgagtctttattctaagtatccgggtggcaaagagtcattcgaacaggaaaacggtaaaataccattcgagttggaaaacactattcgagcaagttcttgctactaagccaaatcatatgttttgagtgttttctaagttaatgacaggtcaattgccaggtaagccgaaaagggtggtcgagatggaaaagacaacttgccgtagaaaagacccatggagaagacccttggtggtggaaaaggctctcggtcatgaagaaggcaatttgagcaataaagatgccaagagaatattctcggggaccacttgaacactctatctagcttgcgccaaaagactataatgacccctgaaatataccaaaataatcttgggattgctgatgtggcggggggcaattgtaatctcacatgggcccaatgaggggcacaattgtaatctcacatgtacagctatgaactatataaagtagataaaaagcctgtagcagacaggacatattggaatactaaaaatctcatcggtcaaagcgtgtgtacattttgtattcgggctcattcctcatgataggcgggaaaatggtgttttctcgtctatcccccaatcttgtccgtaaccttgggtcacaacaaagaagaagaagaaagagaggagagagatggggcagctggaggagaagacaggtacaatgtaaaacattttgcaaagaaacctggtctaaagtgaaaagtgtattgtaaccttagtccaaagtataacatgggtaaaaatacatggtccaatgtgcaattctctcttaaaaaacgtagtaatatttctaacacaaacaaatatattgtcaaaatatatcatgtgttagctttagtacgtgaaactaatttgttattgtatagataccactacatttttctataaattttaaatttaaaaagtttgacttaaaagttcaaaaaaaattataatgcaaaacagagggaagcaacaagaacaaaataaaataaaataaacagtcccacttgtcaggaataagagggtatgggtgagctacactgccctgacgcatcaatgggttgaataggacacatgcacaatgctccctcctcccattttaagtatagccatgatttttcatgcccaattttgatcgcccgtcttatttaaaaaatttttaaaaaattt

SEQ ID NO: 13549 - DNA, 9884 bp, Oryza sativa
aaataagacggacgatctaagttgagcgcgaaaacttatggttgtacttaaaatgagacacagagggagtaagaaaaagaaggaagtgaatcagtagcgtgcgaggagaagggaagagaagggagatgggacgacttttggctcaaagcaagaagatggatttttaaagcctttcaattaaaacaactaggtgaaactccgcgcattgctgcgggaatttagtatgataacaaaaaaaaaataacgtgtaagatagctatataacatcagattaagtaaattaatgtggtttatgataatttaaatttaaatagtatgtagaatggtgattcaaacgtaaaaagtgaggtggtatgactttatggaagaaaaaagtagggagatagtttggaccatagattaatcatctaaaagctaaaaacaatttatgtgatatgacttaattagaggaaaaaaaggaaaaagataatttggaccatagattaatcatttaagcactaactaagtgaggatgaactaaataagtatataggatatcataaaacataataaagatattcattgaaacattatgtgaattatgttggatgataatttaacatgtttgtatttgaaaagctcttaaattataaaaagaataaagatatagcatgtttgcatgatgtttaatgtgatgattgttagtggatgatgatgtggcatcttgttaattagtggatgatgatgtggtatctttgcatgttaagtttaaggagttagtgggggataactttatagtaagataggaatacagaaatgctctccccttcattaaggccttgtttagttggaaaaaattttgggtttgattgtcacatcggatattcggacacatatttgaagtattaaacgtagtctaataacaaaacaaattacagattccgttaggaaactgcgagacgaatttattaagcctaattaatctattattagcaaatgtttgctgtagcaccacattgtcaaatcatgacgcaattaggcttaaaagattcgtctcacaatttacactcgaactctgtaattaggtttttttccacgtttaatactccatgtatgtgtccaaacattcgatgtgatgggtgaaaagtttttgttttcggaactaaactaggcctaaaaatgcatcctatgaaagaaaaattgcttgaaaatctaaaaaaaaaatatgagctacaccacaaatattataccgccaggcagtagtactccaatgagtatctccacggtatctaggcaggtgagatccatacacacatagtaaccacctaccctcacacggtcatgaccatgtatgttttaatgtcttcccatataatactttcagtgtcggacaatgaacaaagaaaatatttgatgagatagataactcagtagtctgctaatgaagcatatgttgcttatcatgcatactttgttggtgagctgaagatataccacggagttcaacattccatggtttaaataatttatttacctttaaatctatatatgttgtgagggtaattagaaaaagatcataatagttgacttcgtgaatctcaagatacacctaacaatgagaactccaatttatatatgttgtgagggtaattaaaatttattcttttagcgataaacgacttacatgtcactattgatgcgcttgtggtgacttgtgaatatcatgccgatttagttttagagtacttataagatagggtgtgcaagtgtgctcacttatataggcgcatgtgtctgtaccctgtttcaaaaaaaatcacaaccgttgagaagaaaaggtaacaagttcaaaatagaacaaaagaatgtgctttttttaaataaaacaaaatcaccctcacataaatattaatattttttaaggtaataaaatttcatgcaccattaaaattaagaggatgcttgtgataagaggcgaagccaagatttatagataggcggtgtcgagattttcagagactcggtaagacggccaaaactttcgggtttttggattggccatcaaaggagcacaacacgtcgacatgtcatgactatagatggccaaaaggcccgaggcccgacggcctggcccacggcatgacattttggcccagcccaagcacggcacggcccgaccaccgggccgtgcctaggccccccactggcacgttgggctggcccaaaatgaccgggacggcacggcacgatgggccgacaggccaggcccgacacacaaagaatagggactaaaaatagacttattttagctatatatatatatatatatatatatatatatatataggacactcatatggggcaccatggtgcccgggcaccatggtatctaatgcacaaaatcactcaaaattttcaaaatttttaaattgtgagtatatacctagttataataattcgattcatacctatacttatcaacaaaacaactcaaatttaactttatttcacaatcagtgattacgtacctaagtaattatatgtatggatgctatatacctagaatcaaaatctaacaaaaacaagttcaaattcagtacaaacatgctttgaactagttagtaaagtagttaatgttaatacctaagtaattgaaaaagtttcatactcatttgaattgggtatatatatataatatgtcagcccaaagaggagggaggaaaaatggacttattttagctatatatatacatatgtcacagcccaccgaggagggagagaaaatagacttatttaaaaaaaggcacgatagaccacccgtgtcttcggaccgacacgacacggggccgtggcagggctggaggtgtagcccatgggccagcacggcccggcacgaagtgccgaccgggccatgctggtccgatagctggtgggccgtgtctagccgtgcctaggccgggcgggccttatggccatctatagtcatgacccactcaccaaccgatgaagcctcaagtatgtcatgaagaagctgagcagccgaacagttgagactcggatgcaagttttattggctcatgcattttgcatctctcttttttagtattgctaatagttcttatactgagaaactatatttaacaacaaaccacctcattactatagaatacctaatgggtgccatttgagaatcccacatagatactagacttcgtaaccgacactgatgtggagaatcatagatgttggtgcacctttgaggttctagaaatgaaaaaataatgtggctcgacgcatcggcttcggctcgaattgagcacatgttttgagccaaggacttaatcccaatccaattacaaatccaacgcaaaaatttaatcctaatccatcacaaattagaataatcaccgaatgatatatagaatatcaacattcaacacaaaaggttaactacaaaaaccgaatcatagtccaccgaggctatcgcggccattagttgctcaccgaaggccaagcctatcaccatcgccactcttcgccagtcctcctcctcgccgtcgtggtggtgccgagctcgggggctgccggatctagcccccgcgcatccttctccacctcacgggacatgagagtagaggagaggagagggaggcacgagtggagaaccttttgtgttggtggaatcggatggccgctgcataggggagaggaagacgacggaggaagacgcagtcgctgttgcaccggggagagcgaaaaaaaccatcaccgtgcctatggtggttgtgcctagcagaggcgtccggccgccactcaccaaccaagctcgggtggggagacgagagagagggagcaaggacaaaatgatgagagcgaacgagagagaagaattggatattgatgacgatagcgttgggaggatagggatgagacttaaaaagatgtttttttttctcttctcccatgctcacgctcagctcggcttggctccaatgaagcgttagtttttttctttttactaaaccaacacttttattccacatataagtgttaaactttgcactaggatcacctaggttagatctagtcgggtggttctatttgggtttgatgaacgacattgtagatgaaagggagagggtttagataccgaccggttgaggagatcgtggaggaagaggcgccggacatcgtcgttgtcgtcgcggcttgacgtggatgcggcggtggcgtttcccgtcactggctgcgccccctctcgatcggattagggttttgtggggtggagttggcggcggcggtgaatctcgtaccatgtgccgtgccggcctccacccctcttttatatggcgcagtgtgacgggggcccaccagccattgggctgggcgcccccgatcagggcgcggtcaaggcccccttgagccgttgggctcaaggggagagagatctatctaacattctcccccttgatctcactttttcttttagctttttctattccatcacagatttgtaaatagagcatgtttcatcgtcacggtcaatcgccgatggattcgacagccactatacacatctctattcagaaacagatactttacttttgggccctgtagtccaggattcataaggcttcccttaaacccatgccggctacatgttccttgaacacgttgggtggtaggcctttcgtgagcggatccgcgagcatcctttctgttttaatgtgctcgagactgattgtttgatcccggactttgtccttcacaacatagtactttatgtcaatgtgtttggcagcaccacttgactgattgttgtgagtgtacattactgcgggttcgttgtcgcagtataactttagtggtttctcaatactgtcaaccacctttaaaccgggtatgaacttctttagccagttcacctgccccgttgcctcatagcatgctataaactcggcatacatagtagaccctgcagtgatagtctgttttgagcttttccatgaaatagctcctcctgccagggtaaacacgtatcccgatgttgactttgtattatcttttgcaaagtcagaatctgagtaccccactatctggagtgattctgatcttctgtaagacagcatgaggccttttgttccttgcaaataacgcaagactttctttaccaatttccagtgctctaggcctggattactctgaaatctgccaagtaacccggtaacaaatgccaagtcaggtcgtgtgcacacttgcgcgtactgtaggcttcctacagctgacgcatatggctttgttttcatttcattgagctcatactgatttctgggacattgcgatgccccatacttttcgcctttcattataggagcaggtgtagcactgcatctgtacatgttgaatttcttcaacaccttttctatatatgtcttttgagaaagttccaatgcatactttgttctatctcggtgaatctctatgcccaaaacatatgaagcctcaccgaggtctttcatgtcaaaagttgaggacaagaatttctttgttttctgcagtagactgacatcactactagccagtagaatgtcatccacatacagaattaggaaaataaatctcccattcttaaactttggataaatacagttgtcctcgacattctcttgaaacccaaatttctttattgtcccatcaaacttcaagtaccactgtctcgaagcttgctttaatccataaatggatctctttagacgacatcccatattttcgtttcctttcatgacaaaacctttcggttgcgccatgtatactttttcctccaaatctccatttagaaatgccgtttttacatccatctgatgtaattccaaatcataatgtgccactagtgccattataatcctgaaggaatctttacaagagactggagaaaatgtctcattgtaatcaatcccttctcgttgcgtgaagccttttgccacaagtcgcgctttaaacttttctatattccctctggagtcatatttggttttgtagacccatttacagcctactgttttggctcctttaggaatttcttctaaatcccaaacatcgtttagtttcattgatttcatttcatctttcatggcttccaaccattcagatgagcgagcgcttctcatggcctcttcatatgaggtgggatcatcctccatatgcgactcttctatattataaactttatagtcatcacggatagccgatcttctgactctttcagaccttctaggggcctgcacatttggcacatcctgtacctgaggctcttgatgagtctcctgtactggcacattatctatttgaggctgttgtagctcctcctctggcgtggcaaccatttctgttgaatcctgtataacaggttcctcactctcattcattgttgccacaggaggggtaacaacaggtgctggtacctcaatgacaggcattgcaggcacaacatcagcaggtagagagaagaaaggttcctgagtcgacggagcgggtacagacacccgcctctcctcaagatcaatttctcgaactaccgagctccccctaatcatttcgtcttccaagaagacgtcgtgtctcgtttctacaaactttgtataactgtttggacagtagaaacgatagccttttgatctttcaggatagccaataaaatggcaactgactgttttggggtccaacttcccaatatttgggttaaatactttggcctctgcaggactcccccacacacggaggtgagttagcgagggtactctccctgtccatagctcatacggtgttttgggcaccgatttgcttggaactctgttgagaatatgaatggcggtttttaacgcctccatccataaaccgagtggtagtgtggagtagctcatcatgctgcgcaccatatccataagcgtacggttgcgcctttcagctaccccattctgttgaggttcgcccggtgttgaatactgggctactattccattctctagcaagaaccttgcaaaaggtccagggacttgcccataaggcgtatgtcgaccatagtactcccccccacggtcagatcttactactttaatctttatatcatgctgattttcaacttcagctttgaatatcttaaatttatccagtgcttctgatcgctctttaattggataaatataaccatagcgggagtaatcatctgtgaatgttatgaacgagtcatagccatccacacttttcacaggaaatggaccacaaatatctgtatgaatgatctctaaaattcctgcgcttcgttttgcaccctttttgatgctctttacaaattttcctttaatgcattctatgcattccaatggaggaagaatttcattcttaactagtctctcaattctccccctcgaaatatggcccaaacgacagtgccataatttcgatgagacatcgggagttcgctttcttttcttgttttcttttgtcaacgaggacacaacattcacattctcagaaagagataacaaataaagctcgtctcgcaacacagcaagaccaatacatgcattattatgccatagttcacatttgccacttccaaagcggcaatcatatccatcaaaatccaactttgatacacttattaagttcctttgcaaagaaggaacataaaagacatctcgaagtaaaagtatgaagccattcgcgagctctagaggaagatctccaacagcttcaactttttcttcaactccattggcaactctaatggtgctttctcttctttgcgtagtcctcgtcgaacggaatgcctttaaacaattacaagcatgaatagttgctccagaatcaatccaccatgtggatctagagtaaccaacataatgagattcatttacaaatgtaataatgttctcacctttctttgccatgatcattttcaaaaagtcaggacaatctttcttgtagtgtcctgtcttcttgcagtggagacattgatctttctcaacagcgaactgttgttgctgaggcagatgctgagactgtttaccttttgaggtgggagacttgtggttctttttcttatctttaacatagtttattgaaccaccatttgattctttgattctctcctcctcttgcacacaattagcaatgagcttctcaaagttccatttctctggacttatgttgtagttgacaataaaattgtcaaactgctttggcaatgaggccataaccagatggaccagaaagtcatctgttatgcccaaatccattggcttcaacttggaagccatgttgctcattctaagtatgtggtctctaacaccacctccattgtacctttctgtcacaagctgcttgatcagctgtgtagcataagtctttgaagagccagtaaactgactctttattctttcaaggtactctgagacagcgtcacactctgggatcgagcccaatatggtaggctcaatcgtattctttaccacagccaaacatttcttgttggctaaggaccatttcttttgttcaatgtcatacgacatgacgagaggagcattgtccctctgtctcttttgccagtcagcatctgactcattttcacctctgacaaggtcagcaggttctataggacatggggtagtcaatacccagtccacctctcccaagataaaagcaaggtcgagttttcttttccattctgcgtagttatctccttttagggtcggaatatctttaatgcaacccatcaaggagtagccacctgaaataatcatgtgcggtgagaacaaaattaacattaaaatattatgcattaagcctacatcaccgttgggcagaattagacataacacatataaccataactataatattgcaattaacaacgttggtcagaaaattacaacatcatagcacataattaatgttcctaaaattaaattctcccgttggttcgaaatttaattttagaaacactaattttcatcaatttcatctatttgcagcggaagactatataaaatcatatgaacagtagcaaaatctctgtaattctctctctgtgaaaattctcccgttggttcaaatttaaacagaggtaaaacatgcaaaaatctattcaaaattctattgaaatttgcatgaaaaatcgacaaaataaaatggaaaaattgctactgttctcttttattcattttcggccccgagggacctaaattgaacttttccggcctttgccggtcggcctatggccactttgcgcgcgggcgagcgccccctcccctcccccaggccgaaacctgggcctgggccgggaaagccgccgccgcgcgctccccacttgggccgatttcggtccggccgccgccgcccgtccgatcagctagggtttcgatcggacggccgggcgccgagatcggaggatcaaaaacccccctctcccggccggccgccgaaaaccctagcttctcttctcttctctctctcacgcgaccgcgtggacggcgtcgccatcgccggcgaccttcgcgccgccgcgccatggccggcgctcctttcttttctcttctccgctccccccaccgtctctaacccccaccgtgtgagagagagatggcgacgacggagatggcggcgccgccgcgggccccctcgccggcacgcgcgtgcaggtgcgcgcgcggccgtcgagtggctcctaggcggcgcctctttgcccctccccccctccgttgccggcgtcaacgacggccggcgacgaggtaagaattagggttagggtttttggttcttttgatccgtgcggatcttgtgcttttctttctttggatttctttccccgaaacgatctaaacactagggttgctctgataccattg

SEQ ID NO: 13550 - DNA, 36878 bp, Oryza sativa
attcaactatcgattggatgcatgcatcactagaacacctggcatattcatttatttcgtcaccgccgcttgcattcttctatttctgcagcttaattaattatgcattacggcacacaacaatcacacacacacagaggttagctacatatggattctatagatcgattattgcccttttcttgcgctgatgctggaaaattaagagacaaataattctactagctacgtacgtagaaatctgcggcgacgagtgaccacctaattatcgagccatcaccctggcggcggcgacaccagcaaagtaaacggagcaacctctccaaaaggaagcctcgtagagtagccaacgaagcctcctcgccgcgtcctcctgcgacgtcgacgatggccgcggccctgcacctgctgcttcctctatcgtcactaccacgtccggatgtcgccgcgccgccgccgccgccggcgtcacgttcttaccaccagctgcagcgacgccggcgtggtggtaaccgcgagccgtagccgccgtctgattcctggcacgctgggtgaccgcgtgtgccgcttgacgcgccaaccgctgcatcatcatcacggatccactcatctctcgaccgatcaatctctctcgctcgctgtattgtagtgccgatcgatcaatcgattctatgtgtacgggataaactaacccaaaatatatatacaggcgatcgatcgattaaactactggttgtccaatccgaatcagattctgagaccgtctcgatgatctcggttgcttagctgctgcccagcagcccagcttgtcgcagcgaatcagacggcggcgccggcggttagttgcacggttgcagtcggcattggatctcgccactcgccatcgatcaaccctgccgtccgctacctttgcttcctctcttggaactaaagatcatcgagttccagacacgagattccacgtgcaacaacgaactacaataccttaattatatacttcctttgttttatattatacaatgtttgaattttttttcaatcaaattgttttaaattcaaacaaatttataaaaataaaggcatgtagtaacatttctatagatgtcggatttagtaaaattaatttggcgttatattagatgttgctacgctttcctataaaatcaattaaattttaaaagtttaaaaaaatcaaaacatcttataatataaaatgcaagaaaaccatcattaccatgaaatatacaaatatatataactatgaacatacattaattagtattggtttaatttgttttgtttacaaatttgaacatggaggctgtgaagtgatatattttgtattaattatattatcattttttctatatatatataggtggtataaaaaaacgagggaatgcatgtcctctccaattatgaaaatccatctccctatatttatatactagaactatttgtaaaatagcactccactgtgaataaataaggaaaaccttcttcctaatcatctctttaatttccccgcaaaaaaaatcatctctttaattaaactgatgacatatgggtcccacttatagtgactggatgatgttacttccatcacaaaacgtactttcgacgacatataattgtcactctaatcaaacgcgatctgcttgcactatatatattaattatagtagtagcactaacgctagccaacgccaagccactccattctaattagtattgcagctgcaccagctgcgccctcaggcgacacgccgccgtcatcggtgccaacgccgccggcgaaccggcggcggcattgtcatcgtcatccacggcggcggacgcctcgaggaagcggccgaccatctcctcgcacggcttccacaccaccggctcccacgtctccctgtgcggcgccccctccgccatgcgcgccaccaccaccgtcgcgtccacgcgccgcacgtcccacccgtacagcgcgctcagccgccggatcttcgccacctgcgtcgcggcgaggcggtaggtgttggccttgatctcgcgcacggcgccgtcgagcatggcggcgagctcgccgtcgtcggccgcctcgccgcccgagcgctcggcaggaggtacccgtgcatctccgggatcccgatggcgcggcgcacgccgcgggtgtagtagtccgcggcgcaggcgccgtcgacgaacccggcgcgcgcctcgcccaccagcccgcgccgcaccatgtcgtccacgcgcgccgcggtgtaccaccgcagcaggcccggcgcgacgtcggtccacaggaagaggcagtcgtgcgccgcgcggaacgcgccgccgccgccctccaccagcgcctcgacgtaggtgttcgacccgccggccacgacggggaggcggcccgccgcgaggacgcgggcgacggcggcggccgcctcgcgccggaagtcctcggcggtgaagtcggcgtccgggtggaggacgccgaggaggtggtgggggacgccggcgcgctcctcctcggtgaccttgttcgtgatgatggggaacccgtcgtgcacctggatcttgtcggagttgatcacctcgccgccgaaccgctcggcgatggagatggcgagcttggacttgccggtggcggtggcgccgagcacgaagacgaccttgggcttgggtgactgtccgatgacaccgccgacgtggtactccattgatgaaggtgagctgctcaccggagaagaggtatataagccatcgttaattactttttgcaaagatagtaaatttacgacctaaaatgtacgtgcactcgatcattcttactcccccgtcccaaaatataatatacgagattttagatggatgtgatataagtttgttcagattaataatattaggatagctaagagcttgtgctttgtaacggacaacaaattgagtttctaatttattaaatcaattaacaaacacttatttagtccaagtactgagagccaacggtgaaacgggggaggactcgttaaaagataatgtaatggtatagattgtggggctcacacggtagtagtagagatggtgtgggaatggacaccaccagaactactaacattttaaggactatagattacatctacccaaaatcatttacattttgagatggaaggggaacatatactatatttaaatggttataatacattttctaaataaggattaccagaagacactataccattccagaatggaatactttatttctggcatcaccataacgccagcatggcacaaatttggtacttatatgatactagcattagacatgataaacataggaaccatatctaatatcggggtatcatacatgatactcataggtaacagtatttggtacctagatcccatgctgatgtcatgatgatgttagtaaaataaaccaccgttgtaacgatatagcatttttttttattttttttgttttcaaaaacagtaatgctgattgtaaatgatcagtttgatgctaaattacctatatatcatgataattaattgtctctagttaatttgttgtgaacgagaatttaacataaaactagcaatgcaagttcatggaacaatgtgggtgcacttccaaattatcatgcatgaaaaatacatctctgcacaatttgttaatcttacagtcgaaaacattaaatatcatgaaaagcattgacaagtaattaatcccccatatagattattcgcattgaacttccttattttactttttttaagagaagttcacggttcatgaatgaataataaactcatctgtggtcaattttccatcaacttcataaaaccaatctataccaaaggagaaaaggatgacagtacgtataaataaaaaggatgataacatctgctgttgtatgcatattctagctagcaaaattaacaaaatcaatcattaatattactacttcttgagggtaaacttcaataatttctttatgttcatcgtcgctagttattattcagtgaaactttaactttgttttatgttcaccaccttctaactttgacatatagcgcaaaacattatctcatatgtatccgcaaactattcattcctattgaacctatgtctggtgttcacatcatacaaggggtaaagacaaagcctagggcaattaggactccctaatcccttttaggtcctattgaaaagtaatgaaaagtcaaaggtaaaaacaagatgcattagttcggtcttaagtttatatatgacatggaaaaattataataacattgagatctatgtgaatgaaaaatattagcccttaaaaaaagcctcaacttagatatctaatatatcttacataaaaataaaatatctatcgctcaacataaggattacaaagaaaaaaaaatctttttagatcaaacaaaaaccacccatatatatggatctatcacggagacggggtttgagcgcccgctactaatatatggattattagagacccttgagcctccaaaattttccgacatagatacagaaaggccaaaaataagttggagctttgtctagttttttttagcccctgcttttttcccccctagatccacccctacacccacatattttttttgataaaagaaaaagaaaaatggatattaacaagaaaaaagaaaaagaaactagcattgcgacacaaaaccttgcaagcaaaaagcatctatactcatcttatcagttcaagctggattacgaaaaatggacggtgattaaccaagagggtaacacctaccgcgaggagatcgaccacagagctagctgctagccggccgccggaacggaatcgatagctgccggagtttatcaagtaccaacttggtcgccggaatcggtggccggagttgtacaggggtgaggtttattccgacgaggtaactgtatatagcctctcttgtgtatttatacagtccctgcaggacctatctggctgatgcagatatgcacagtagtataccgtgtcttaatgccttccataatcagataatcagaagaaaacatgtatctgcatatgtcgacctgtatgacagaattaattggtatcgaattttgagccagccaagaaaagcatggataacaatgcaataaatagaatcttggtcgaacagtcacacgaaaatagtacgggcattgtacagtgctatctcttggctgcagtgtatatccgtcagtaagagtgttgtaattatgtactgtattaattagtactagctatttgtgagaatatgtgagattatggtaaccgacgattgactttcctgttattcttgtatatatccagatatacacatccaccaattttctagccgttaatgttattcctatcctagctatcacccgtttcgagaaatctgaaatggtatttttctttaataaccttaattatcactccccggttgcatatatacacactttgaagtttttctctcccttttttttttagttttggaaacaattgataaatcgagaaggggttaaaaaagtactacattcatccatatatctttttagttatgaacttgaataggtcggctgagagaactcatatctagtttcatatctaaatatatatatatatatatatatatatatatatatatatatatatataaggatggatagtgaagtttattgctctcaccttagaatctagtagcaaacattgcaaatagttactagataaatacaacgaaaacatgcacaacacgttcatacatcatactcattcacacaccacttgacctccacagcacattttttagttttggaaacaattgacaaatcaagaaagggttaaaaaggtactacattcatccatatatctttttagttatgaacttggataggttggctgggagaattcatgtctagattcatatctaaaaatatactttttttaaggatagatgtagtaaacaattttacagtgaagtttattgctctcacattagaagctagtatcaaacattgcaaatagttgctagctagataaatacaacgaaaacatgcacaacatgttcacacatcacactcactcacacaccgcttgacctccgcagcacgggaaatgtgctaccctgtgtaccctagctagccatctgtcctatttaccaatttcatcccacaaaatctagattgtttgagctacggttaataagaaataaaacaaataaataaaataatcaaaatagattgaatatacttttatacttctatttatattactagcacgtagtccaaaaaacaaggttgaaaaatagagaacaatttaaagccctaaaatcaactctaaaattaaattgtaaaaattcaaattttgattgtggcttgtaaaccagcgagaaaatttatcatgaggcggtagtaagtccaatggtaatatgttactagcctagttgttagcacaatccaataatcgtgcactatgaattgatatatgctcaactggttagattttttatgatgaaacctatctactcaggtttaaatctctgatgtagtatatgtgcccacattttacgatatttttgttgtttctaggtaactgatttacaaatcaacagcgaggcatctacggtaatttcgtcaatgtcacaatgtggtatctttcgagtatgtgatgtttatagggccaggtaggagtgtgtttgggtgttcatatcgatgagtataataatatcaatgtaggtaacgtgttttgaaaagaaattcaatcgtacaactctggatatctttttaagatacttagtactccacttaattgaataccaagtagaagtgaaagctcaattagttatgcaggctcccttatcctaaaacttgcatacttagatggaactcgtttacttgacatgcatggatatggatacttgtattttcgtagagtacttgggtgtaaagacgttgacggccaatctcttcatagacgtacgtatgctggtgccaggacgcatctgcatggatgtatatacgcgtgaatacggtgtgcgcatcagtggcggatccagggccccgacacgatttttttattttttatttttaattttaaaaataaacccatccaaattttattttcaagatatgaatcttttgtccacgcgagaacaatactgttacgccgctccgctggcgtgacagcgttatttggccacatcaacgttgcccgcgtgacagcattatttggccacggcgctctcgctggcgtggcaagataaaactgtcacgcccgctgcaagtgacatgctattattgttttgtcacgtcagacgggctggcgaggctaagaggttcagattttataaataaattttgaaatgatttagttttaaaattaaaaattaaaaagttcaaaaaaattaaaaaaaaaatcccccgacaccagcattggattagatgcttaaataacagtgcttagtcattagcccggctacacatgtactattagattagcactaattgtcatgtttagtcattagccagcagcttaactttgcttccgtatatgataaaatgctctatgtagttttaagaatttgtgtctacttgttaatttgttattatcgtcgttcggtttgtccagttcaagaaaacgtctaattaatccggtcaactgctgtgcatgggttgtgtccgacttagtaaaagaagactatatttatagtatcatattattttataaaaaatagtctatttttttactctacaattacaacaaattttaaaaattacaccgtaatcacagctgtactgtaatttttttctggtacagataacactatatataagaaattaggataaaaacaattgattgttttacttcaaagtttggaagggacagataggagacatataagcattagaaaaggtgactgcaatcaagtaaaatatatatacatcaacaacagtaaaactgtaaaataaaaaataagaaaaccacgatactccctccgtctcgaaatataagggattttggatagatacgacacattctatgtccagatttatggtattaggatgcatcacatccattcaaaatccataatattttgagatggatggagtagatttcaatacatcaactaacaaacatcggccagcctgacacattattcgtaccagaaattaagcctctagctagacctgatcttggtacaccacgggaagcccacagatgcagcgcttgcttgctttcaaccgatgcgcttagccggcgtagccgtagaccacgcaaggccggccggctggcctatcgatccattccagttgcagagacgttaattgcaatgcaatctctgccgtttttagtactgccgcctttcccccctatccactatccattatccaatccatctgatgaacttccttggtgaggtgaggcgcccaatcttcttcctcaatctgtaattttttaatcttcttcctcaatctgtaattttttttttgaaagattaacggcaggagctctggcggatatattagggtaaaaagagtcagacaaaacgaaaaacattaaggttcaaagaaaagaggggacatccagaaaggaaaataaactcataaagcctattacagaggagaagagaaacgactcagctgagacctagcctttaggcttatctcgaaagctcaattaaatcaatattttctttgatcgtgcaagctacttgtgattcgctttagcatttatgatggaagattcgacgattgcgctcgagccagacctgccaccatgttgtgagtagagcgccaatcttcttctttgctgaatctccttttgcaagaaaaatctaggaatcccaccaattcgaaatgggtgtgtcttgccaagattgtgggggagagattgtaaccaagccagctgcatactaaattccacacatttcttatgaagctgcattctttggccaagtgatttgcatcttcgaaagtgtttgtacacagacttcatatccagttacattgccagtgacgtctcagcaaattttccgccgttagggttctctaatgcaaaatgagccagccgaaaaaacgatgttttggttccgcctgggccttccataggggagagaagtttatgttagtgatcatacattagaattgtgcttcataagcgctctttgctgagtattctccattgggagtcgatttccaacgaatgtcatcgggggtgtttttaaggagcatgacttcttacaatcggctacccagccggaccagttcatcaatttcacttatcgtggtaatggggtttaggatcgccagccagtggttgttttgaaggctgaggtgcacattgtttcattttctcctggacaggttgaagatccctagagctaaatctttaggtaagcaaccctgaagccagttatcagaacaaaaggagcatttctttccatttcccagggtaatgactgttccagctcaaaaaagcactctgtccaattcatcacatggcacttcaatgttatgccaaggtctattatcttccttccagccaaaccagagccagtgcagccttaaagctcgcgagaatttttccaaattgagaataccgaggccccccaaattcctaggtttgcaaatgttctgccaattaatgagactactacccaaactgacattatctggatcatctcccttccatagaaaagcacgccgaaatcaatcaatccttttatatagccacttattcttattcctcaatctgtaatctttccactcttttgttctttctttcttcctgtttcgtgttgttcatggatcatctctacgactctacactcatagtattacgtttggggatgatggctctggttgattggtagtaattggtagtattctctagtttcaagctgtagaatttccgtgtgagattattggtcggtgaacattttgcacaaccctgcagtttccactttctagttacagatctgtgtgggggttgatatgtaattggagtgttatgggcgcttcatgggtatggattgttttagttcattttgggcactcctctgtacgtagagagaaggggtcgatcaaaaacggaagttaattgagaaatgaagcgactctagcctctaggactgtttttccgttcagtcgatattgtggtttcgattgatcattgcgcaacaacacaggttatagctaggagcaatgccaccaggaagcttctatatattctacctagtctgaaatataaatttcagttttgaagtttgaaaagttaaatcttttgtcataatatttaatatttatagccatcaccagccactattatatttccttttgagataatagtgtggaactaagagaaatgtaccatatgttataaacttacaatttctatactctctgtgtgcatttttttccttcaaagctactcaatacatcaaagaagtgaattgggtatctgcattgacacgggaaggaggaaactacggcgaaggccttagccctcggaccaacaacggcgacgcctacgggcgccgcattcttgttggggtgttgttgcgtttctcctatccaatggtttctttaggtgaaaaccacgtcctggttctctaggacggatgacggcagcgctcttagcgtcattcagaagaaccattcctctggggtgttgtgtgcttggtttatttttagtagcaagatcagacgtaaatgcgtgttgtgactatctttttcttttttttcctgactatagtcttccaggactatagacttgtatttttcctactatatcaatagaaatatcatactatcttgtgcgggttgtttaaataaaatgggtatctgcatttgtacaattgatataaaatatgaaattacaagatctatcaatacatatcacttgccatgctaagcttacaaactaattatcatcccttttttctcttctgctccaggtgtctaccaatacatatcacttgcctatccattccacttctatgactcggctacttgcttttctacgacacgtcaagccgagtcatgacgtgaaaatccgtggattaccctttatttaacatataagtaagttcgcgggtctgtccgtttgcatccataagcggtgaacctggcgagctggcaccctctgggagggcagcgacactggccgacgaacgccagcttcgttgtccggttcggctccgtcctcccggccaaggaggcggccttgctggctgctaccgtgccaggtcgctgagtatgtcctgctcataaagttccatgttgtgacggctatggcgggggagacgccgccattggcgctcactctgaccgagctgagcatgcggatcgaggagatgggcggtggtcggttcgacgggcggcgcagcctggtggtgctgaaggaggcactgggatgctgtcatcggagcggaaacctggaggaggtgatggagtcgtgtcatgccactcatacctgagggcgcaaagcaagctgagggaggagaagatctgcagcgagtgccggttcgacgctctgtacgtcgtcggtggcattgcagtgtttgttgccctgtgtaccatgtggtacagaaaaaacgctcgagagcttgtgaagctggagcagatgtatgatgaattgatgtattggccatattcttttctccaataaaaactggataaacttttgaataaaagtggcacgcttttcaaactgctaaacggtgtgtttcgtgcgaaaagtttttatatgaaagttgttttaaaatatgagattaatctatttttcaagtttgtaataattaaaactcaattaatcacacgttattaccacctcattttacataaaacacttaaactttatcttcatcttcaggagattcaaacaccaccattaaggcgtaatggatgatagggatttcagaaatgtttgttaaggaccacaggagtaactgtggactgggtagtttaaaatctagacggtaggtagcttctgagagcggtttcccaacttgtagcttttagttcattttctgaattatacaagttatcaaaataattctcaaaatctaaaaaagctatactattaggaaaagtttctatttggatagaaactttcagccccatgtttggttgtttggtagaataagccaaacggtatatttataaataaaaaataatttttgaataaaaatgttatatacatgatctaaacgatttaaaagcaaaggctgaaaaataaactacgatgaaaaagctctacaatcaactctaaatttaaggttgaaattcaaattttatcaataagcataagcgaaaagaagagaccgtttccaaacaaaccatatgtttaatcccaggcgatgtttgtgacatcgtaaccctgcatgttctgttattttggtaatgtggttagaataatacgaggtataatgaaactagaataatcagatttatccatgcaaaaaaagggaaaaagaaaagagggacaatcagaattgcaataagaatagaaccatgcataatcaccactcaacaataagaagatttatacagtatgacagtaccaggaatctcaatacaagagaaacaaaaaagtggaagtctgaacatcaatgtgcataatacattccaaaacctcgctagaaataaccgcttgtgccaaattgagggtaaaaataatatacacatggatggacaagaaccagaacaaagctcggaacaatgtagtgacgcccttggtgctgcatagagcagaccatgtacaaataaagaataccctgtaaaacttgggataacggcagagtaagccaccggccaatcgtcttcgaaacatgaccaagattgctggcaaacatggcctctcacgtaccatgtcaccaatcaagcaaaactagtaaacatgcagcctttgtagtgggaaagagattcatgcttcagaaaagatcatgcttccttttctgtagttcttgtttccaccctggctgctggtagaactcttccttcgttataccaaatacagtctggaattcgctgtccgacaaatatgtctgcagaagccgcacaaaagttagccattgaaactcatgcaggccaccattcacattatcaaggtgttcatatgaagcattagcagacagtaaaggctgtgattacagatggttgctagtaatggaccaattgtgagtttgccactgttttgttttaaactaagaatatctgttgcaattcctttttgaaggactagagcaaaaccacaaaaacaatactatcgatgtatcaatccttccgttgaagtttgaaaaaacaggaaaaaattgaagggtctggcagatagatgattggcaataatcccaaaaagggtctggctgaagccaaacatgtacatgcaaacagcaacaatgggggataccaaagaagaacatggtatcatttaattgaggggaaaaaaaggcaaccaaacctcccaccaattgagctaggctcaattcctataatctaaatttctttgagggcactatctagttggcttgctctacctttgagtggcttgcttgcatgttgcaagtcatgcacgaaataacaccaggttatatccacttggaatactgaaaccttgttgaactcactgcaacttctgttatgtactcgagttactaaacaacatatgcattgttactgtggttttactattacaaagttcctccaaagttttattactaaaagtcatttctcctgctattttatatggctgtgctcatatcattttttatgttgcacaggtaattaactcacatatttatgggtaaggtaagtgcttatccatttcacaaggtagcagaaacaacacataacacctactttgcttccaaggttgcaaggaaaataacaaacctctctgcgtttgtaatctatcccacgaacagggttggtagattttgatatcagccgatcatagctgaaggttgtttcacctccattttcattagcagtctgttccactgatacgtcaggctcagttcgccctccctcagataatgccccatctcctggggcatctttatcagcggaaaattctgatgctccttcagacagaggggatgcagcagacggagttagttcagctgtatctgcatcacctgaaattggcaagatccaacatcaacaaaaagaaatatttgttaactctaaattttgcaagcatcgtcttcatctactgttcttgcagttagtcaatgagtacagtatcgcccatccaaaatttacaaaacaatcaatgcacaacaatgcatcaaaagtctcacattataagcttacagaggacaataagcagagacctagggtagtgtttgcatctcctgaagataaagattaagtgtttcacgcaaaacgcgccatttagcagttcgaaaagcgtgccacgaatatccaaaactttatccactctttgtagtggaaacgaacaggactattcatgaaatatgtctagcaaaaagaaacgatgcagtgcctagaatatctattattggttagtagcaccacatgaaggaaattgatattgttacccttaaaatatatgcaggggaaggaaatagtaggccacaagtcatacctgccattggggaagacctacctatgcgtgggctttgagatgaaccctcagcagtcaaaacattagacagcgcagcaacagcagctgctcgctgagaaccttgacctgcacgttgtggtgggcttttgggttttgctgatggattgaacgctgatgttaaggcagccattgctgaagcgcgctgagtgggtccaccatcagagcttttaggcctatcattaccctaaaaagaacacaacattgcttatagtttgtaagatcaacaaattttatattttttctgctgtgcattgggagtgttaacaataccttattcttttgggaagatgggttgaatgcagatgaaagagcagccaatgctgatgccctctgagttggtccaccatcacctgaactcttagatccactctgcaaacagttaatgagatgggttactaacaagtgaatccatacacattacgtctccaaatatctgcttttcacattaagtgaggataattcatagaatttcaaactttaagagcaaaaaaaaattaacgtacctctgagcgcattccgaaaagaagtgaaagcttcttctgaaatgaatttccatgaatctgtttcaagggtgaaaagtattatatcctgtgctaaaacaagtgtgagcaaagaaatggtacgaccaaataccacagtataggcaagtacaaccaaactgaaaaataagcttgcagaattgatgaataaataattgaagaaagcatgatagcttccatgtgccagcctcatagcaactgtgcacattcattcattcatatgggcaaggatgtccttgttctccagtcctttagattaatttaaattattttaaaatcaactggatcctttcttgcctccccaggtcccttttacttctattgaggactaccaacctaaattagcataacgaaaagaaattttccttgtttcttatgacacccttaagtcggattcgacaccatatgtttaacatggcaacaatctaagcatacacaccacaaaactaccccaaacataatagctgatctaatgagacatatatgtggtaggcatttattagtttagctaagaaacagggaatgaaacatatagcaaaacactgaaggagctccgtgtagctacatgcatatgtactgaagtactgatggacatttagagctgctcagaaggaaatatgaactacgaacataggatagatctcttatacgaaaaattgcttccaaggtgaaatctcttaaatacaaagttccaattgatagaactgagaaaaaaagatatagtggtaaatatccaatagcataccacagatcttgtgttatcccaggagaagtaagttctgaagaagcatggttcattcccttcaacgactttgtacagaggcacatcaggagaaagagattcgaaggccgccgcatgttctgcatatttctgagaataaagcagttattgctgagttgagcaaagatgatgatatttaagtcagcaagagtaaatcttcatatcatacctggccaatttcaaatgccttctgcttctctttagcatccacacactgacccatccaaacaaagacttccccatgtgtatcaagaaccatcatgtcttcagtcagcaaatcatcttgtgaaaagttgaaaatttcagtgacctgcaaataaaaaggtttttgagaaactaataatcccaaattgttgaagcatgacaataagagtaagacaacatacctccagtttccctggtaaatggtgatcatgtcagtgcaaacgaaaccaaaaaaaaaaaagagagagagaaacattagggctctgatagaatataagaaacacattgaaacaacaacaggacaaattcagaatcaagttttggctggaactaaccattcctcaatgagaatgtatacaagtgaggctctctaacaacatcatgtgtggcatttctgcttgtgtaattctgctttccaccaagagcaaaccaaaaggcagagctctcagttccctccttgcaatgtttgacagcaacaccaggctgcaagtttggaaacatcagataatcgtattgagtgagaaatagctaggaattcaagaaaatatcaaatgctttcggtttattcagaacaaaacattctggagcaacaaccaagttagttctatcacagcggaaacagatttccagtagttagtaacctcacagggatggtatatttgtgctagtccctttcattcatattggtcaatcacataaaatgataactgtactttagaatccaatcaacaaatgtgtgcccctctgaaaaaggtatgccttacatatatagtttcaaaaacacatttggataatatagtcagaatgttgtaacattgctaatctggactaacagtagatcaactggttgtgacaataggactggtacttattgcctacatgatcaacttcagtcttaataaccatgctgttggaagctttcttccaaatcaagacacaaccaccatattttccttcctaaaggttcattttgaatttctataaaagttcccaagaacagaagacattgttgttttcaagcccttaaactttctactttctagtggacattttggaatttggatatgatcataattagcaaaataaaaaaaagaagaagaagaaaagaaaaataacaggaacaaaatttgaaaatatatttttgacctgcaatataatattcaagtgcccgcataaagaaattctttccaataatgtccacagcatttttttcccgacaataaccacatgaagtggaatattaaatggggtttcctcatttcataccttcaagaattcagcaacttttgcagcccattgttgctgttcatacgaactggcattgccaatccatgtaaacattgaatttccagattgcaggacaaaacaatccgtgggactcaagtttgatgacacctatagaaaaatgttacttataagcagatgggcgcagtaaattaaaatttacagataatggatgcctgtgaatttcaaatgagtctagtaagaagaaaaaggtcattgcaaaggacaagaacaatgtggctaaaatgaaatttctgcatcagcagcacactcagaagaaaatcaatcgatgtatttatgccacactcttctgtgtttccataaaaagaaaaatacagacaaaaataatgcaaggtagattctctagctgcaccctaaggaaatcactaatcaacattatttgagccctcattgtttatctgtttgcagttgttatactctacaatctcactaaggccatcaattatcaattatgctattaaatggtctacttaggcctgccactaggaagggtatgggtgacccatatccatacccaattttacccatatcaatttcataattagctgggcctcacatatacaaatggctcaaaacttgcacaaagttgcttctctgcaataaatcatttctacaaaattcaaccgaatttgacaagtttttatagtgcggatgcaagttttaaaattttgggtccaagctttacacacataaaatgggtatgggtggtaatgatgggtattaccctcccctaatcaaaattgaaatgggtaattcctccctacccatacccttcccaaatagtgtgggtaagggtatgggtgtgggcattggatacccagtggcagccctaggtctactctgtcatgtctctatatatgagcacatagaattttagaatagtttgctattataaagtaccattttgaaaacatacaaaaccaccaacaatattatcatgttgaatcttcataggcacagccattgcaggagaggtaaatattaccgcatcaacttgaagcactttattgttgtgaattgatgttccagaaattcgaaaaagagcaatgccatcgccagaatatgtttcatccttcaagcccttttcttctacaaatttctggtatccagagctgattccaccctgcacaatatgccaaatacacttaactgatattgtttgaattgagattggacattacagttcagctatatagacagtgcgcacctagttccttagagaacacccactattaccaactgcttctatttaacatgaatatggtaaggatcaagtaccatacctttagaatgaccatgggctggaaaagggcaataaattgtggtggttctttcccttgataaatacgaccctacaacaccagatataatgtatcaaactcctttccagaaaatctgtccacattgtcatagtaggaatacagtaccagaataggccttcctttcagtgaattccaaattgaattagctgtttggaaagccatctcttgatcttcctgtatgaaatcaaccaaagagtaagttcacagatcacacaacagtggtatgaggcgacaaaaatgttgagtatatggtacttagagtcataataggataggattgatttgtatggactccttccttatctctaaatccttccttatctcctctacatgtagtcctatatataccgccccccaaggctcaatacaatctgtccaatatttgcagtatttctctccctatactattcaacatggtataagagataattttgtcacccataagatgatactccctccgttttataatagatgacgttgtcaacttttggacatacatttgactattcatctttttcaaaaaaaaaaggtgcaaatatgcaaaaatataagtcatgcttaaagtacttttaatgataaacaagttacaacaaaataaatgataattatgtaattttttaataagacaatggtcaaattaatgtccaaaagtcaacggcgtcttctgtaaataaataaacagagggaatatttattttcacctgagatgactagtaatatttaattgcacatgagaactggtgattatttgacataaaagtcaagctcttgatgagaacacacataacatggcattgacaggactttgtgttgatcacagacaaagtaagaagaaagcactatagtatagaagttcaagaataagattgccaactactccctccgtttcacaatgtaagtcattctagcatttcccacattcatattaatgttaatgaatctagacatatatatctatattcattaacatcaatacgaatgtgggaaatgctagaatgacttatattgtgaaacggaggatgtacattctaaagcttgggagcactggaaggtacattaccggtatgctgtccttgccaatccaataagtcaaataaaattcttctctcttgtcaccagaatgatatgtatagagaacaatatagcaatctccgctgtaaaactttccaagctcctcctttggaagagcagtcttagcactgccattgacacaataaacctgaaatatccacatgtttcttatggttacattcctattattgcattttcccagtcttcctttatagttgctgaaagcttataaaatatacctcaagttttccatcgccttctagcaaaggaggaacttcctcgtctactggagcgctgctttttgaggctcccttgatatcaactccttgttgcttcaacagagctataggaaaagcaaatattatcaagaatgatctaagggtcaattattttatctcagagaacatgaacaatatacacaacctgcaactttccctcggccttcctccgcgccagcacttcctgcactatttactggccatgattcaaacttagacttgaatgtatgattctcgtacccttgaatcactcgggttactcttgttgtctttggcctattttgagtagcaatgaattcctacaaaggcaaatttagatcctaacaaatttgaataggcaagaaaaaaaaaagaagaaaacaatggcttgagacttacctcaactgctgcacttgcagcttttctctcctccacttgtgttagtcgaccaacccatataaataaatcagacccacagtcgaccaaaaagcacttattgttctcaagaattgattttgtcagaactgtgtcttctaactttaattgaccattattgatgctgcaagcagttgatggcatggaaaaaaatcaggatacaaaaataaagttaagccactgggaaaaaaagtaagataaacatagcgatatatatatatatagtctcagacctaaggatatagtaagcgtagcaaaccaactaaaactgtgatacccatttagtctatgctacaatacaacactaccaaaaacctgagaaaacctatataaaacatgggaaaactattaaacttatgagaagcctttgaaaaggtatgaaacccttcatcaaccagaaaaggacaaatcaatttattggtaaaaatgtatctacctaaacaggaagctatttacagtaacattaagctgcaaatacatacagctaaaatggttgtatctgcatactgaacattcgttgaaattatgtcagaagttgcttaatgtactgtcagaaatccaaaagtaataaagttgaagtaagaagtcctaaaaatggatgtatgtaattagcatcgatacttttcaaatagcatcatcttaatacataaatatacacatgccttgcacacaactgatggataaatttttggagttttatatgaagtttagcagcctgtgtatgatcagggaggaagttagtccatgccatatcatgtgttagaacaatgcttttcggcacagaaattcttcaatgagcgcaccctaaaataacttcactgtgaagtgcgtaccatacatagggaaggcaagaatatgaagttgtttggagcatctgattactaaaagacaagggtcctatctggattcacaattctgtaagcgcaatttaaaaaaaaaatcatacctgtaaagcttgggggctgtggtttcaagaacaacatcatcgtcacatatagctttcttccctattggtgcaaaacctccaaaaagaacccagaattcaccagaatctgattctgcttgcaattttccatcatctatcacaaaaattttgtatgaaaatgtgtagatttgtgccagaaagttacatgaattgagatttggttgtcgagcataccaacaatcgcaacatcacacactccattgtggtatgtctcctttaaatgttgaatcgcttccaaagctttcgctctctcttgaatattggagtttgcaccattgaattgatatattttcttttccgtatccaagataaatacatcatcatgattcaatgtcgagcgagcgaatgcaacctaaaaataggccatttagtgtatataacataagcagatacagtagtctaagaaacaggaaggtgaaatagtagtcccctctttaactctgatagctctcttccctttgcaaatatatagccttgtttcaaacttatcctcttcaggtgttttaaacccagaggcgaaacctccctccaagggtataatgcatggtttaaagtacgataggaacttatcagattcatagccttgaagttctctgtgctgcactgcacgacctccgagcatggtgtcaagttcaactgtcttaattgctgcagtcccagcttcatcctgaatgagaacacatcaaatcaagaagtgggctggaaatgccatttatcagtacatgaaacttgagatgttagagaaaatgtacttgactagaatctttcccaatccaaaagtggatgtcaaaaagataggcgccaccacctttgctgcaagtcgtctacaaaacaaaatgaacagatcattgaaactttccatagtggagataacagaaagattcttctaaaatgtaaatataaaaaaaatcacctggagaactatatatgaatctccattgtaaaatttaccgtaatctgcttttggcaaaggaactggcttaaaatcttgaatcctccatatttctgtgccactatattttaattaaggggctaacagcataaaaggatagaaactcttgtacgtagatttctaaaagaagacaactaaaacaaaccataaaggcatttaaagaaggatacggtttttggccaactccttgaaatgcaggatcaagcactggttttgcacttgacattgagcagcaactttacaaaggtttaattgaaaacagggtagtggaagatggctccaccacagaataataggaacttgcacactgaaaaggggaagaaaaaattatatgtcaacaagattagaaagaaaaaatagccaagctaatttggacttctatacatggatcgaaagaccagatgttaaaagagcaatgatattcaaacaaacaatcaactcgaatcaagacaacaaatagagtagttagctgttgggaaatatgaatgaatggaacacacaagtgaatgatcaaaacgaacatatcctgaatgaaaccatcgtaaaaggggtatatcatgaaggaaagcatcatcaattgcatgcagcccagtaatgactcaccagaatcgcacaatttcactcttataaacgaatcagtaagtcagatcaaaacaggtaaaccggaataaaccatacacgacgtgctgattacatctacctgagcccccatctacatttgaaagacactgtaacgtagagtacccattatatttgctaatggagatgtacccatcagaggactgagacccaaatgcgcccatctattctgattgatctcatcacgaagccagtggctgcacagcgccaccggactcatgcccacaaagcaatcgcccccgtattctcgtcaaccacatgggctgcattacgagatcaatcaaaccaaacacatcatatgcagatctcatcacccagctccctcacaccaatttggaagatgtgtgctcgtgttaatcatcttctatccatcagattggctgcacgagcacgtgccgacggcagccaccaaccagagattgggaaagctgattcggcgccacccaaccccactggggtcactgatcagctgccagtcaccaccgcccccaaagcggaagggagcggattgagagctaatccacggatcaacccccgcacatttcgcctccgatctcaccgatcggttaggcaacccacccacctagacaccccccggatcgccggagacgaacaccattcctgacccaccccgcgcccctctctcccccacacaatggccggcaccaccaaccggaacaaacaacgccgcgcaagagcggatcgtcgagcgagaaaccaaacccaatccgcttcattcccgaagaaccaacgagcaattgcgcgcgcggggagacgcacgacggcgagtcttcgatcgaggagtcgagagggggtacgtacctggagaaggggaggaggacgacgacgacgggatccgatcggaggctgacgggaggggaaggggaagagggggcggcgatcgaggtggccggcggaaaagcggagagaggggtgacgcggcctaataaaggaagcggggcgctatgattgctcccttccgctctgcctctctggctctctctctctctctggcctgtccgtgcccttgggctgggatgggaggggggaggagatgcgaatgaatggaacggcgtagatctggcaaagcgcgctccctgtttttagagcgagcgtggcgagagcggtgtctagcctgggccggtggccgccctggggtccctggacggtgggggaaagaagtggcactaggctgtagcggagaaaatggggaggcgttttcctcgatggaaatttgaacggctctccctcttggctaacaaatgatgtcatacgtcggtgtcaaagtaagcgtattattaatacggtcaatttgatcctttcattttatatactacctccgtttcttttttttttcattttatatactacctctgtttctcaatatatgcgtattattaatacggccaatttgatcctttcattttatatactacctctgtttcttttttttttcattttatatactacctctgtttctcaatatatgatttttttttatcgacatctgatcattcgtcttattaaaaacttttgtgcagatataaaaaagtttaagtcatatttaaagaatatttgataataaattaagtcacaataaaaataaatggtaattacatgtttttttgaacaaaacaaatagttaaaacatatttttaaaaaatcaacgtcgtcatatattaaaaaaaacagagtgagcattttattttcggttaacctaagttttatttggagggagagacgttttactcctagtttgttgttcgatagtagagatgataatcatgagtcaagtgagaattgaattgtacgcaatgatatacggctttagatttatctagtcgtacctagaagagaattatgtcccaattatatacccctgctcaggcattaaaaaggtgggagttcgctcttaaacttttaacgcccaccaaccgtcctcatttttaaactcatattctctactaacaatttccccccaacttaataagccattagtctctagcgtttcattttggtcgaatcggtccttgagcttttgagctttgctcttttgttccatacgatccataacgcccacctaatgaatcgggtgatcaaggcaactcaatgaagatcaatcttgttgatgaatgtgacgccctgcacttttaacattgaagataaaagtgccagactatagattattatttacaaactattattcccgcacttttaacattgaagataaaagtaccaggctgtagattattatttaacaaactattattcccgcacttttaacattgaagataaaagtgccaaacggtagattattgccaaataataatatagcacttttatcttcaatgttagaagtgcgaactgccaaataataatctacaatctggcacttttatcttcaatgttagaagtgcagggcgtcacaatgaaccatatagctaaaagactaattcaccattatattttaaattccaacataaaataacaatgataaaataagctatagaatccttcttaagtagtcatgggaccaaccgatgtttattcttagacttgtttcattgttcggactataggatagatataggatagtgaagcaatggaaataggaaaggaatcccaacgtaaactagggggttaaaaaagagtttgagatatgtcatcagtatctcaatgacatgtaggacccacatgagtcaatgacatataggatccacatgggtcaggatggcatatctcaaattttataaaattataatggcatggttacaattttcccttaaaaatatatgtcagttctatcttcctccatccttctttttctttcttgcccatgtgcagttgaggctaacggagatttttatgtgcagttgaggctaacggagattcttatggaaaacgcgacggagtggcaggttccaattccctaaattcccatgacacatatacaatctaaaataacatatttgtattggcatggatcgaattaacccatcgtttttaatgtgttttttcccgtggaatcgatggtgtaggaaaatttcttgtgatttttttgtgtttggcttttgcgatccgaatggtatgaaaaggaataaaaacctatgaatagtattcctccaaaaatcccatggctatcctgtaatccgaacgaggcctcaaatatatacacaaggatgtaacaatcatttcgctgttgatatcaacacaatagatacacaaggctaaacttttcttgagttatgttcgtattgtagcatattaggttcatccaattaccacgttgacccaaaatgcaagctttaagcactgaactgtacaaaataaagcgttacttactccatttcatattataagactttctatcattgtccatattcatataaatgttaatgaatctagatatatatgtgcctagattcattaacatttatataaatatggataatgctagaaagtcttataaccaactgtcaaaatagcccttaagtgaaacttagagggacaaaattgactattctctcttgtcactaccacaactcattctgttcaaagtgaattctcgttagtttgccaatcatcgatcataccatggatcaggctacaatgcccagaggtgttacacagtagtatgttggtgacgacaaaagctgacaatacctactaagacaatgcataaatgtcaaggatgagcaccgaagcaaggacaactaagaaaatgtcgcaacagaaattgtactattggggtgtttagattcaggggtataaagttttctcgtgtcacatcggatattatatagggtgccgtatggggtgttcggacacaaataaaaaaactaattacataatccattagtaaacagcgagacgaatttattaagcctaattaatccatcattagcaaatgtttactgtagcatcacattgtcaaatgatggaccaattaggcttaaaagattcgtcttacaaattagtcgcaatatgtgcaattaattattttttagcctatatttaatacttcatgcaggtgttcaaacattcgatatgatagggtaaaaaattttgggtgtgatctaaacagggcctgtcatgtgacatattttttcatagacatatttttttagtattttctcttttccaatgtacaataactacatagtatatgcatgagagtttttcaccgattcctttttttcggtgcaacttaggccttatttagttggggaaaatttttgggtttggttgtcacatcagatatacggacacacatctgaagtattaaatgtaagtattaaacgtagtttaataatagaacaaattacatattccgtcaggaaactgagtgacgaatttattaagcctaattaatctgtcattagcaaatgtttactggagcaccacattgtcaagtcatgacataattaggcttaaaagattcgtctcgcaatttacacacaatattgtgtaattttttacctaacattaatactccatacatgtgtccaaacattaaatgtgacaacatggaaataatgcaaataatgtgccagatctaagatggtctaccgaacgtcattcggcacaaaattccaatttccaaacctgttgtagtataaaggtggtactgtcttaagcaccgagagggttagtacgaacaaagctactctcgttagcgtcgttgccagatgtatagataaggtgtcacatcttgggtggaagaggtggatgccaaatagctggtttatggagaaaatttgtctgatgaatgtgggggtgcaagctaggttccgtcgctaacatcacgatcaaaaggatacagtgtataagcggcagcgacttgagatggcaatggcgccgtttcctgtttcccgtttcctacagggaattctcttattagggagcagtgatggttagaattggttcttcgtggggatcaaatgggaggattgatattcccgccgggtttcacgggagcggggatggtcctccattccatgttcccgaccgccacggagagcggcatagggatacaagtttaatgctttttttaagttatcttatgtgactaaattacttgtaatctttaataaacgttaatcttattttttttatcatgtgacttagtagatatatgttaatatattaatataaaatatgaatatatgtgttacattgcatatataatttgatatgtatatattgttttaagcggggacatagaccccgcgagggttaattccccatgccaggtggggaaaattttgttattaggagggggatggggatgcattaccccgtggggaattcccaatttccatttctagcggtgatcggccagcaagtggaagagctcaacatctcgcaacacggttagcggaggatggtagctaggcataggcattcgatagttcacaggtggaggagacccggggcagaacttgacaatgaccagagaacgggctacggatgggcaagcggaggatttgggcggtgaacgataggtaagcggacgagtaacgctatccgattggaagtgaacaggtggatgaaaggtgaccggcagacatgcgaacaagcggcgataccgggaagtagataactcagggggtaactcgacgacgaccggtggacaggcggacgagtggtgacgattggcgagcgggcaagcgaagtaacagcacggctcacactgtgcgcccgtctaagtgggtcaagatggtccgctcatttttaccgaacggtttggacccggaactaaggagaatattcctctaaggtgataacccatcccacccatctccaaaccaaacacaatagtaaaaaatagagtcaacccatcccatccttccaaccaaatagtacaaccttaggttcttcatcttcttggatccagcgctagcaggaggtggccgtagtagccatagacgctagcaacaacaaaatgtgggtcgaggtgcttaactatggcgctttgggcagcacatgaccatgacaccgggatatgtgtgacacgtatgggctcctcgcgccaaaccgttgtcgatttacctcgtccaagctatacctttttctcaagctcacccaacgtcgatctctaccttccatatgagctcgcccaccgaagcttcaagccctctcggttacctcctcctcatcatctctttctctccttccaaactagtacgggaagacatgttgatgactagctagctaggtcaggtgatgatagagcttctggagaaggtgttaaagggtgtagtggcccgccatgccttgtcaaattccgtgccatgatgttgcctgcaccgtcgcttgccgtagtttctcgctgccactccttccttgcgccctcgtctacatcacggcaagctgccgcttctcccttctattgctgtcaccgctcgctgcaactcctccgtggctttgctaccttgcaatatactccatccgcctcattttaagtgcagccataagttttcgcacccaacttcgatcgtccgttttatttaaaattttttgagtaaatttcactttggaccatatttgttgaccaaaatttcacattgggctagggctaggcttatgttttcacttaacaccatgtataattaccattgtttgtactttggacctgattttacagttaccatcacacgagttgttgtctaggtgcttagcattttacaagaaacaatgatatggaaatttttgccatgcaaatatgattagcgcaagaacaatgattgtaacatgttataggatatcctatcagattaatgggacttcattactactacatatgaacattcacaacccttatactagagacaaaattggagaaatattgagtttaagaactatttttctagaaaagtacacgttttacaatacccaactgtagtgttagttcaaattattgaattctaagttttctaaaaaaaaaagaaataagatcagatctacaatcattatactatgtgtaatttgtgaaacccggtccaaagtataaattatgataactatatatggtgttaagtgaaaatataagtctaactctagtccaatgtgaaaatttggtaaataaaggttgaccaaagtgaaatttacttaaatttttttataactagtatttttattattatgagatgataaaacatgaatagtactttatgtttttaaattttttcaaaaaaattctaaataagatggacagtcaaagttttgcacagaaaatcatggttgcacttaaaatgagacgatgggagtatgttggaaacaactagtctgtcagaaatacaatatctatcaggagaacaacaaaattatcggtacccatatactggtaaataagaaatatgtcagtgcatacttttctcgactgcttgacccctgacagaccctagtggcaatctaagtgacagcaaaagtctttaccacattgtgccatcaatagctgtttttttttcccgaccgatcgagcgtttgagaaacaacacgctgaacagctcaagaaatcgagcttatctctgtatatatatatcggtgattcagtgtacacgagcgcgggcaagcttaatcatctctgtttctttagaagacaaacgcagctgcttttttagaaacatctcaggcaaggcaggcagagagacgatcgatcagacttgtgatcgcaggtgggccgggcccacgcccagccttaaccacgccagcgcgtgtggcccctccggcccggcacggcagaccacagcagcttcaatttcttagaggcacacgtgggccccacatgccagccagcgtgccaagacaatgcatttggcatcctcctcccgaagatgacgcacacgccccctgtgtgatccgtccctcccctccaactccaccgtctttttcctcctctttttgtagagtggacacgagttaagccacgacatcgatagcaagatggtgccgatacgtacgtactgtactagtgtgctgtagttgactcgatcagagtaatggtcaggctttcgtgatcggaaagtggtttgggctgagttgtttttttcactttgctaacttatttctcccatttgccatgcacatatttttttaaaattactaaatggtatgtaatttttgcaaaaataaattatacgttaatgggtaacactattttctatacgaggctaccgaacacagtcgttgagtggacacctccgcgcggcgttggatcagagataggtgatctctctctgtagcacaagcgcgcgtcgtgtcgttggattcgtggaggcgaagcatttgtgcaaggcgagtacgacgcgtacttcagttgatcaatggatgaacaaaagaaggaacgcatgaagcaacggcgtgcacttccgttgatcgatcgttggatcggtggaggtgaagcgtctgtgcaaggcgagcacatcgtgtttggaaggccgcctgcggcaatggcaacagcagcaacaaccgcatgttactcttatgcttgtggcactgttgtcgttggctgcaccacaactacaaccacggctgtcgaatagacccttagcagaacagacgaaagcaatagaaaagaataaccaaatggctggacagggattcagattatttcagctccactacagtctccatttctaagttagatttaagagttagagaggtactaaacatgttcttaaatttggaccacatacgcatacgtaatgtacaggtatgtgcatatatatttcggatcaataatggcataataacgtgcagtagcataccatgtgtataaaatctaagttcagttcttgtattttacaggcatctaagaatgattattcggtggaccacggttatccaatattgttacagtaaggcacttaccacaataacatatgttaactgctaaaaaccacgtgaatttcatctcaaaatgttgaattcaaaattcaaaaattgtagtaaggtttacgataacaacacaataagatgctataaccgtgttctttgacttgaaagagatcatatggaaaaaggatactacaacatcacatttgactaatgtcgaatatactagatatatattactactaatcatgtattatttgtagggattttttttaaagaaaaactgaattcgaacaaatttaaccaaactctatcatcaataacccttgccatacttttagcatactttcaggataaacacgttacccgcaaaattaccggcaatgtgaaaaacctagaagaacccatcttagattcttatatctataatcgcatacggatctaaaataagattaaaggggaacccatctctttcttcctcgtcgcaccccctctcttcctcctctcccttccctctttctatcaatagtgatgcagtgagatagggggacttgatcaagtcttcctcctctcccttccctctatcaatagtgatgcagtgagatagggggacttgatcaagtctccctaaccccacgctagatccatcccattcgataatgaattcatctacaaaacacatgtaaacgtgaaccacattactctgcaaaagaacctacgacgtcgatgacccgcaccacggtgagcttccacactgatatgttcatgccaaatactcccttcgtattttaatgtatgacgccgttgactttttaaccaatgtttgaccattcgttttatttaaaattttcgtacaaatataaaagtatttatattatgcttaaagaacatttaatgatgaatcgagtcacaataaaataaatgataattgtataatttttttaaataaggtgaatgatcaaatgtttggataaaaagtcaacggctacgtatgaaatactgtagcagctgagctagctacccacacaaacagtagcactgcacgctggcgagccccctacctagctcccagggggatcgtggcgaagacgatgcgttcgcacatgcttagcttttaacgcgaggatccttttgcggggcgggcacctcccatctccccagctcgcatatattgcacgcaccgctgtcgaggggtgggcccctgccaaggtccatgtgtgctcgggtaagctgcattgattaatcatgcatgtactctcgctagctacacacatgtcgatcgatccgtcagtttacacattgtggctgatcagcgagtgtgtgtgtggctgtgtgctgctgctcgctagtcgctttacagcaaacatgctggcaagctgcgcagtgtattatatgccagatgcataatcatgcatgcatgcaggaagggttgattaattaactaattaatatcactagattggtataaagggaactggccagttgattaaaccatagtcgatcggcgcattcgtactatcatgtggacaaatctatatattcaagcatgctagcgcagtagcgcgtgagtgaagatacataatatactcactcactcagggagcttcagttgtttgatatactcagggagcactaaccttgaatggttaaaaattgaacatcacataagctagcttagcgcaaggctaatagtataactcgctactagctccaattcatttatagtcaatctaatagccaattcatataataattgcttactatactattaatatatggtcccacatgtcatacacacattacatattggagtccgcgctgcagctggctacagatctgtagcccgctgttcttctctctcatagcaagtttaatagtatagcccactactagcttcaatttatctatacccaatctaatagccaattcatacaatagttacttactatagtattaatatatggtcccacctgtcatacacacatcttgtattggagtccgcgctgcagctagctacagatatgtagcccgctgctcttctctctcatcctttatctcattaaaatatgtttacaactagttaatagcttgctattgtacttgctctcatcttttatctcattaaaatatgtttacagctagttaatagtctgctatagtacctgctcttactggcacatcggccttggccttgaaatacgtgtcttacgtacgtgttcttgcagtattgtcctgcaatgcttctagaatggctgcgccaaatctgggtaactacgctagattgcttaagctgatcatatggatgatctgttgatctcttcgatccggcggacggcggtatatgagtgtatctgtcatcaataaaccgagttccattttcatcgcatgcaataatttccaacaaggtagccaacggtcaagcgcatgcagcttcattatggccttgtttggataacatatacaatccgccccagtgaatttagttcaaaatcccggtcaatttcatgggctcacggccttccaaacaaggcctcaagggcatgagcaatatgttggaggaataagttcatctgacatccctcaattgtacgcagagtctgtttaaggtcccctaacctcaataccagaaatgtatacccctaaactatgcaaaactgtctaaaaaaggtcccaaggtagtatagatgcctggtttcgctgacgtgatatcctagtcagcaaaaaataaaaaataaaaatatatggggcccacatgtaagtgaaaggaaaaatatggggtccacgtgtcagcattatcttcttcctttctcttttcttctcttctcttctgacgttgacggtagatggggagagacggccgccgatgaccccgcgccgctcgaccttgtcgatggcggcggcgaccaaccccggctcccctgagcccaatgcactgcttggcctcagtgctccgaaccacccaacccaggcatggatgagagggagatggcggcgaggagagcgccaagcctagctcgttgtgccatgggtggtgtgcggcgttgcgggggatgggatttgaggacgacgacgacgtggatgatgcggtcggcaaagtcgtggacgatggcgatggactcgcaaggccgccgctcggaccccatgttaagcgccatcttcaccctcgagaaccccaaaatggcgtaccagaaccgccccgtggaacacgtcgacaaacctgccgctggcagtggagccaacatcgacctctgcacgagtgccgtcgtcactgccgtccccatgtcctcgggagcagtggaggtggagacgaagaaggcgggcgagagcggagccacctctttttgccctatcccgtcggcctcatctcccccttctttggccgacttcctctctcccctcactgtctggcctcatctcccttctctccggccatcaccagctgctgtcgccgccatcgccgccgcctctcaccctctactaccagcgggtgaagaagagaagaaaagacaaaaaaaaaagaaaagaaaagaaagaggagaaaaaaaaagagatgttgactaggatgtgggccccacataatattttttaaattttttctgactaggatacagcatcagtaaaactgggcaactatactgccttgggaccttttttttttacggttttaaataatttaggggtacacatttctggtattgtggttaggtgaccttaaacaaactcagtgtacaattaagggacgccaggtaaacttattcctatgctggaggagggaaggcctagtttgatttagattactcaacggatttttgccgcggatatactcaactataatgacttaggctgtgttcggcagcccctcttcccaacccatcttcctcattttccgcatgcacgcttttcaaactgctaaacggtgttttttttgttgcaaaaagtttctatacgaaagttgcttaaaaaaatcaaattaatctatttttgaaaaaaaattagcaaatacttaattaatcacctgctaatcgctgctccgttttccgtgcgggcacttagtgttaggaaccggtggttccgaacacacccttaatggatgcagtgacttaataatgaataaaaatttgttttcattccatgccttttttctactcccccgtttcatattataagttgttgattttttcttagtaaaacttttttaaatttgactaagtttacagacaaatataatattattttcaatacaaaacaaacctattataaaaaatatattcaatttaaatttaataaaatagtattatagatgctgctattttttttataaatttgatcatatcttaaaaaaaaaactttgatagaaaaagttaaacaatttataatagtacttgattattgtgttaggtggcggcataccccgtgctctgtgtgcctcgtacgtgtacgtcttttgtgatttttttcttgggttactgacagtggaaaaatagtccaacggcattcggcaaacagtccaaatcgtccaactcgaccgcattatccaaaatctccacacaatcgtccaccatctgaagcaatcatcgttgcctatcatctcatcatttggagaattcgagggagagagagagatagaatagtagactagagagccactcgggcagttgcattagacgtgaccacctgcggcggcggaagcggcagtctcgccgccggccggagtcgagccgggtcgcggcgatgaggccgccgacgcctctccccttcctgctgctcctcctcctcctcctggtgctcctcctccagtcaccgtctgcggcggccgcgggcggcgccgacgggtgggaggcgatcggcgcggcgtcggcggggggagaccaccgcagggtcgcgtcgccgggagagcagaaggcg

SEQ ID NO: 13551 - DNA, 11038 bp, Oryza sativa
tcgcggcgaaaattacggtcgctgctcgattggatcaggatggcgtcgtcgctgacgggtttgactttgattctctcatccagggtggcgtctgcggcgggtcaagctgcttcaggattagtaatgcggatggctcgcgcagaaatggagcagaaattctgtacgcttctaccgctctcctctgtgtgtgtgtgtgtgtgtttacttcccagttttttttatttggaacagaattctatcctgcttccacggtttaaatttagaatagttaaaattatggagttatggtctcaaaattggctttgtttaaataggagtggttttgtaggaccttcaactaagtctgatgctatagcacagtagcacttatctatctgatgctaataaaactgtaaaatatactaatgggttgacataatgaaaaaacgccagtgcgaagtatctattttggcaactgttccttctcatgccggctgtctcttttagtaacttttgcattttgtttttcaaaactcaaaacattgccttcagctgagcatagataggggaatgaatggagaacaatttgttgatatacggctaccaaaactgaaaatttgctatggttacattgcaaaagtgaatgcaattacttatcattgtgttcaggatccagggtaccacagcggtcgagctcgcctctggtctccactggtatctcaagtactggtgtggtgcacacatttcttgggacaagactggtggcgcacagctggcctcggttcctttgcccgggtctctaccgcaagtaaaagggacaggagtgaagattgagcgacctgttccgtggattactatcagaatgttgtcacctctagctgtgagtttcacaattttccttttttcataatgtttggtctgctccatagaccatatctgctcagtcttcaacctccagctccaaatcctttattatacccaaaccacttttgtcaaattggtgataatattatattgcactctgaaaaaatgatctcttttcctttttatcgagttatggaattggtcatctaggtctgttgcaaaacaaatgcttgttggatttctaaaacgccatcatgattatatgtttgtactgatgcaatataaatctattattgccactgtgcgtgtcaaattgaagttcttttatttggtctaagcatttcagtcctgcaattctgccaaaagttttttttttaatttctgtattctacctgtttcaaagatctaccttttgttcttttcaagatcaaaccacacatttttagtttgtaagaaatatctcccaatctggctacttttactcttctttacttggtttccaactgtttatctctgacaaagttcatgtagcatctctatagactcatttgtctggtgggattggaaaagatgggagaaagaaattgactggatggcacttcaaggaattaatttgcctttagcatttaccgggcaggaagctatctggcaaaaggtttttaaggtagtatgacagacacaatttaaactctgaagcacattttcaaattctttttggagtctaaattgttaacatacagcaaccagtgatgttgcttatgatgggccatgcatataaattagcagaagctgcgtctgtttccttacccaataggttacttgggctggctcagtccaataggatgcgtgatcttctctctctctctctctcgcttatctaagggaactttacattctagaaagctcgaatcaaatactctaatttatctccgtgtctgtcactatttggaatattatctttgctgagtgccagtcttttgtgctgccttctataattttatcgaccattttcccaaacgatagtcgataaaaaatttgcattaactgcatactaatctgtaccattgctgttttgtgatcaatctggcatctttaaacattacagatccagaagttatcttcagtttgacatttatattgccactgtttttgttttccatatatgccactgtggaatcataatgcaatttttgctgtgttcaatcccttgctgatgactgagttctatttcagagttttaatgttacagacagagacctagatgatttttttggtggaccagctttccttgcttgggctagaatgggtaacctgcatgggtaagcttagcataaatttattataaagtatttgatctgaaaataattatgagataaatagtacaataattaaaaaagaaataagggtatgttgtctatgcccttttggttttagttcacagaggatagtggattgctttatgtctaacaaaagtgaaccttaacaaaattatcacccttctaaaatacatatcctgttgaggtgttcgcagtttgaaattttttgcctgaggaaaatctttactgaagctaaattaggttagacatactacagaggttttcctctcagctcaaatcatttctttcagatgacagacaatactttgtacttcttaaaaggttaaccatggcttgcattatcagggacccacatagccagtacatagcactgcccaaaacattgaattgatatttttgtagttacacatagtatgctaattatgactatttggtcataggatccttcagttagcagcatatatttgttagtatgatgtgaaaaaaacagtgcagtttgatatatatgtttattttaaaacaaatcttagatggggtggaccactatcacaaaattggctggatcaacaattgacactgcagaagaaaatattgtcccgtatgattgagcttggaatggtcccaggtaataatttgttttacattgtagaatttcagctctttacttctttagcaattgtttgtctatttatgtgagacaaactttggacatatgctattgtctattgtttgtctattgcatctttcctcgtttcatgctatgtttaaagctttgtcacatttgctcttatcctatctttggagtcaggaaatatggagagtcagttaacatatcaatgttaccttcgatgtactattagtatagtgcactaaatatttgattctggttatatacttcactgacattaattgcaatttttcagttctaccatcgttctcaggaaatgtaccgtctgtgtttaaaaaattatttccatctgccaacataaccaaacttggtgactggtaatgcactcttctgtgtcatttccattagttggctgacatttcatgctagttcaggtgtgaccaaaatttcaaaatcttgtctgtgttttatagtcgcagttcacatcaagatacctattttataactactgttagtttgggggctggacctcaaatttggtgttgatgtattcatgctttctctttgctaaataatttccagagtttataagtaaccgtggaataaacagataaataagtttcaggctatcagtcttctgttcttccttggcattatgtgggttgtaggtacagggtaaccatgcacacaggatagtttgaagtcattgtttatatgatcgaacatactttgaaggtctagtattctgtttcagcccatgaatactgtatttacagattcctttgcttcaggaacactgttgatggtgatcctaggtggtgctgtacttatcttcttgatccttctgatgcattgtttattgatgtggggcaggcgtttatcaggcaacaaatgaaaggtcagagtctttccatgaaaagataccagatttcatttattccaaacttccaataccttttgactgttctttcgccaatagcttcacgaaattgctgcatggattactaacagtgcaattttaatgtatgtttttataacctgcatagggcgtgtttaccattctaattgtttttgtattttgcagaatatggcgatatcaccaacatctataattggtaagctctgactgatctgcttctctggtttttttttcagtagaatttgcatgaataatttgtttcttgcaaagtacctggactgtacaatacactatagtttagcatttttagcgcaaatgattggctctccttgtaattcatggagatgaaccactgattgttaattttttttttaaaaaaaactataatgaaccttgatgcaagaaatgttgagtgcaaaaatatttgaacatataaggtacttaataccaaaacagttttgtggcaaggtttaaaaaaaaatctggtttttgaaaatgacaagagtcctttcctttctcctcacttgattcttgctatcaggttagaagattttgttcctgataccattcagaattctacatgatatccagataattccattgatatactggttgttgataaaaaaatgtaatattattggtgtattggtttgctttgttcattgatttagtacttatttatgttccttgtccacaatgtctttcatacattatgatcaatatttattgtttgttttcagtgacaccttcaacgagaatacaccacccacaaatgaaccggcatatatttcatcacttggttctgctatttatgaagcaatgtcaagaggtaacaaggatgctgtgtggctgatgcaggtgtgcttgctctcctttttgacctttgaagtgtaaaatattatgtattcaatagcatcgccacattttccaatggaaaaaaaaacatatggagtacccattcatacttgctttgtcccagtttgtagagaaaaaaaatgatgtcttaccatgctgtagttttgccagtaaaaaatcatttgccctaagccacagtggcatatagtgtttaattagcatagttttcatgagcacatgttacactcatggcaatttttgaacattagtataatcttggaaccttcttttcttgattcagggttggctgttctactcagatgcagctttctggaaggagcctcaaatgaaagtaagtttcttcgttttattctgatttctgaacactcatagaaactatagttgagcctggactgatggatatctgtttcatcattctgaaattcgataatagcgaaagaatgtgatgatccaatgttcccttgtatcttgtttcttgcactcaacttgaatagagaaaatagcatctagagctatagatctttaagtgtgctcaatctaagttgccatctatttagaacctatgtagtgtagtggaaataactttagtacttatgcactcaacagtctaagagaaaccttgaatcattactggtgagatttatggaaaaaattaatgtagtgcttctcagtgtttatgctactgtgtttgtgggtccatctggatagggacaatgggacatggacttaattgagattgctaaagaaagctcaactgagaaatggctctggacaatctatttctttccaaatccaatcattccctcctttgtgcctttgtatttctagcttctcaaaccatgcctgttgagaactgtcttaccttttctatattctagcactactggtttgtcctagtcttctagaagcatgtaaggaaaaggctggctcatgggatgcagggcaagagagggccttctgcactaatgtcttttagtttatgcatacaataagccgtaactattatgaatgccgattcatggatatggtaaagatccaaagactggggaatacgacactcgcactaaattaacgccagtaaggctactccctgtcaaaaccaagggagtctgaggcttattggactaactttagagattcaattgtcgattgatagcggggtacacatggtgttcttttttagggagggatccctgctacatttccatgggtagaatctctacttttctaaaaaaaacatatctctaatttcctagtagtaattaactaacaactttcattaactgacagacaggataccaattgactaacccctatcctactaggaaactagttcattattaaggaaatagaattctaatcctgatgccacagtattatggtactgttcacacatggccacacagtggtgctaccatagcagtaacagaagcaaaatattatgtgtattcatatgaacgcatattactatattagcaaataggtagcaaaagcatctacctgtcttttccccatatgtaagtttctgctcattcttatagatggagataaccattgcctgttttgtctttcaggcattacttcattctgttccaactggtaagatgatagtccttgatttatttgctgatgtgaagcccatatggcaaatgtcctctcaattttatggtgtgccatatatatggtatgttttgactccaccctaaagcttcaaatcttcttatttcttaaatatcacttttatactctattagttgtaaaagtatgcatggtggttctcattgaaactaggtgcatgttacacaactttggtggcaatattgaaatgtatggcatacttgactcaattgcatctggccccattgatgcacgtacaagccacaactcaacaatggtacattttactctcttctattaatatagtgtagagcttatatgagctgagattgtccatcatttgttgcaccaaacttgaggtgaatctatcaatgagttccttaccactcctctaaaaaaaaagagttctttaccactgatctggcactgcagattatatatcatggcatgattcctattaatatgatacttacatttgtgccttacctcctttaggttggcgttggcatgtgcatggagggaatagagcataatccagttgtttatgagcttatgtctgaaatggcattccgtagtcaaaaagttgaagttgaggtatgtacaacaaacatgcatatgcctcgcttgttatgaaccactgtgactgtctcatctccttttcttttgtgaccagctcacctgtcttttcttcataatactgcctgacatttttcatttgctgaagttgttgcatgtttccatttgtcaaatggccatctaatctgtattatctcccaggattggttaaaaatatactcctacaggcgatatggtcaatcaaatgttaaggtggagaaagcttgggggattttgtatcatacaatatacaattgcacagatggaattgcggtttgacatcatacatatgctcctctacaaattatgctcctgcattacaactgtgctatgattattgacaaatccactgatcatatcttctttcatatgtatattgcaggatcataataacgattacatagttgaatttccagacatcagtccaaattcatttagctctgatgtttcgaaacgaaaggctatttcagaggtgaagaaacataggaggtttgtcttaagcgaggtgtctgcaagcctaccacatccacatctatggtattccacaaaggaggctatcaaagcccttgaattatttcttaatgctggaaacgatctttcaaaaagtttgacatataggtatgttttataatcgccattggtccttcaaacatcctgatgccatgcattcttctttaactaggtatcagttaatgctgaactgtttgtttctagaggacttgtttcgaaaaatgaaatgctgtggcagtttcaacatctttatgctgatacatgaaattcatttctccaattcccagaaaaagaaaacaaaattatctgctttatctcatgcctgtttgatctgctatgcctttctagagcatagatgcatctacttagtttgtttaccaatcatgtcagaataatggcattcacagaatcaacccacattttccaggcttggagtagggaaaagtctgaaatgtggggacactaatggtgaaatgctcatgtgcgattgtaattatgtatgtgagagtactcacaattattaaaatagtccaaaaatgtacagcagagccaattgaagctttgacaagaatacaacaaaaatgaaacaaagccatgagcccatgaatatactcttgaacacaaatcttagccatatgttagaactttcactgccagctgctaattaatcaaacaagctgttctgcatacatgatatttttttttaaaaaagaaaactgtgaattaacgataattgttgtcacaggtatgaccttgttgacctgacaaggcaatcactgtcgaaattagcaaatgaagtgtaccttgatgccatgaatgcttaccgaaagaaagattcaaatggtctaaacttttacacgaagaaattccttgagctcattgtggatattgatacactactagcttctgatgataattttctgctggggccttggcttgaagatgcaaaaagccttgctaggactgaaaatgaacgaaagcaggtaaatttctcacccttcatccagtattagtcacagatattattttttttcttattattgactgactcaatttcttttttttttcttattgttgactggctcaatttcttttctatcagtatgagtggaatgctagaacacaggtaacaatgtggtatgacaatacaaagaccgagcagagtaaactacacgactatggtaatatatatagttgtttcctccataattttgaagtacatgccagatatatgtatgctagttatacttctaggttattaaccttcctgcctttcttgacaccatattaccagccaataaattttggagtggactgctgaagagctactatctaccaagggcatcgaaatacttcagtcgattaacaaaaggcctacaagagaaccagagttttcagctggaggaatggacgaaagattggattgcctactcgaatgaatggcagtccgggaaggagctctatgctgtgaaggctacgggtgatgctttggcaatttccagctcactattcaaaaagtacttcagttagctgcaattgtccacttcgaattattagatgattgaaaatatcacatttccagcccctgcactaggtgcacacgccctaactgttggaataaagccaactgtctactttgttgatgtggtaaataattcatacatcagaaacacactgtttagaagcttgagaatcgtgcaaatgaaggtcgaaaatataaaatgagaaaaagagcaggacctcagctctctaaagtcagtaaaatcacttagcttgaaaaacaactctaaaattctggatccaaataaaaccacaacaaggtaatacccatgctaaaataagttcattttgcacacataccgatacaaagttaaaaggactagggtgtctttactttagcaaatctcaatacaaccatttctcaattcatttacttctaatacattattctctatttctacaaactcagatataatgattactctaaaaataaatttattttgagacaaatgaaagaagctgaaagtaaacttattacgggacaatggaagtattttggtttgatgctttgatcctctttcagacttcgagcatgagtattgtacgtgtcttctctgtattctctccaccataaaaaaaattaatttagtattgaatttaacacatgctatacatatttatagtactagcatgttttaatccgatactaggttaagcttttatgaaacggagcgaggacatgtcttttggacacgcatacttcctccgtctcaaaaaaaaatcaacctatgagggatgtgatctgtgctaggacaatgtgtttgaacgtagggatgtctctatgtctagatacattgttcatatcctctcctcctagttgtttttttttttggatggggggagtaccagctagtcgtaggctgcgacagtgcgaggcgtagaggagacaaccaagtggatcccacatggccacttcacagcatcgatgatcggtcgcttgtgtgttacgagtagttctagatagggctgtcaacgagccgagctcgagcgagtttggctatataggcttgagtttgacatgaactcgagctgagcctgcataccgatcgagcttgggactaagctcgagttcgagctcgagcgagcttcgagcctactcgagcttgacagcttgacttggtgaaactccaaagaacttactcttgtataagagatattaatacaaattatcggtagtcaaaattaatgggtgctacttgtcttgaatgaagcctctgcagcttttctcatgaattcatggctttgaaacattacaattaacaaaagctagctactacatctaataggaatagtagtactaattctaaaaaagaaaaggaatagtagtactattactagcagccagttaattactttattgagaagcattgatgagatcttgagacttgagcaggtcaagcacgatgataagtatacattgacccatcaagaatatcttcctacgtgcaatgcatcttatgctaattaagccctaccgagctattcgagctcgaacttgctaggattgcgagcctcagcctaggcttaagcttggcttgtctagtatttgagccgagctcaaatcaagcctgtaacgaatcaagctcgagcagcttgcaagctccgagcttttttgacagtcatagttctagatcagctgcaatagtaagatagactgcaacttaagttattgtagctgctaagttggatctaactctaacggcaaggattagtttggtcactgtagtaaaatatattgtatcataaaacagtgctcagggtactgtagggtgaacactgttgcaattaatttggaccattatcatataaatgaaatgactaaaaaatatatgcagtcctatggtgcggccgcagttaagactacacccaatttcaatccttaattagtggctagacggtcctatcttttcgcttatgtatataattttccaagctactcattactaacttaaaaaaaattataagtaatttttttgcatacgtgtttttaattatttaaaagcaaaaagtatgataagaaataaaattaatttaaaaattatctcgtaagcataagaaaaagaaggtgttgtcaatctcttcagtattgaccaccaccaacgcacgcacagtcgcacagtcccccatcggccc

SEQ ID NO: 13552 - DNA, 8087 bp, Oryza sativa
tgctctatacataaaagaaaaataaaagtcccagccagcaaatagatgagaagaccaaaagaattaggaagagattagatgccaataactcaaattagaaagctattttctgctccatcaacgatgagatccgtttgttctgtttgtagatgcatcggccccttcttgacgcgatggccagcagcagcgccagcccgcggttgtcgtcggcgcccgttgctgccaccacgttcgcgatctgctgcgccgcgagcgctgcgttcgtcgatgccagcggccgagtcgccgagaggaacgcccttgtcatcgccgccaccacgggcgccgacgacatcaacagacccttcttggtcaggcttttgagcgagattgggctaggcgtcggggtggaagacaattgcaaacggcggtcggcgaagacacgccaggaagactgggcggggaatcgacgcggaagacaactgcgaggcggtggccggcagagatcgatctgcgacactcccgtgaggagagaaacaagatgggctgcggagggggagggaatacgctgcatgtcacacgggatcggatggctcgtcgtgagacccacaaagcacacacgaacccgtgctattgcccggctatagattagtcgctcgctttcttctctctcctgttcctctctcttccacataggaatttaatgagctggatatttttagagcctgctcagtcaacttattgtacctgcttacgtacaatcacagcgtggtccagactccagacgtaatcacataccctgtacacctagcacacattagtgatcagtcaatggaaatggttaagtggattttagtttgacgagacgcagtccctcacgaacgagctagagacaatttttgaaaagaaacggtgcgtgcagcgctgcttacgtacgtgctccgatccacccggcccctgatccggccggctaacttttgcttttacttttgtggcgctgatggggatgcacagtctccggaatgcaagaacacgggtgcgccagctgctgcgtgcgttgcatgcaaatgcgtccaagcaaagcggtcgtcccagcagcttgactgaaacttgaagacttgaggtgctgatttgaaattttcattaggctcaattggccagaaaaagaaacctaaaacgattgatcaaaacaaaaagaaaggtggtttagccttgatctaatcagctaaggtcgatgaattaatccctagttagctgctcatctcttcagttcaaactagtagtatagctatagcccagcttgtgttgatattcagatactgtgtgcaaatgcgtgcaacgcgggcaggcgaccagatgatcctgaagctgggctgtacagtgcctggtgcagaggagatgatagccaagtggacccggccctctacatggcgcagggcaggggtacgtggagtgcccagatttgttgtcactcgatcgatcgtgtgatctgcgacgccatcacgtgagacagacatgcatatgcactcgccgtgttcctgtgtgttggccctggactagtactacagtaaatgtaccgcaggaagtggattttatgggtacatccccttgttttatgtatggtgtttaaaaaattataaaaaaatttgaaaaaaattatcaagatagattcatacatgatatatcttttcgcaaacatgtaagttaaaattcgatttatacaattcgaaacaaaaataacaacattaaccgtgaattacgcgttctattcatagtcaaatttgttatttttggttctacatgtataagttgaatttgaatatgcatgtttatgaagtgacatatcacatattgatctatcgtactaaattttttaaaattttttgatgattttttaagtgacataaaaaatgagagaatatccccttaagggatgaatacagttttccatataccgcgttgcatgttttatttaccacacacggacatacacctggtactccagttcaaacctgagttagttttgcaaactacggttaataatactcgtacttaccacgcatgcacggttaataataagctcttgcaaaccctgtgctagctagctagctaggagtaacatacatcaaccttttttttcaaaaaaagaaaaaaaaaagctttcttgatactttctctcgcggagggcaagctgggccaggcggaaacggccgccacggctacgcgaccgagcagcgtcgttgcggtagagtcgtagagaccgagccattgaagagctcttcccccccttgaccaccaccaccaacgcacccatgcgtacacgtggtttgtcaccgatcgagcgctcacagagagagagagggggagatactccctccgtccaaaaaaaaaaaaaaagacaaaccctaggttttcgtgtccaattttaactgtcagtcttatatgaaatttgtttataattcgtattttcattgttgttagatgataaaacatgactaatattttatgcgtgacttatctttttaatttttttaataattttttcaaataagacgaacggttaaatattggacacggaaaccagagtttgtttttttttggacggagggagtatgtgtgtgtgtgtgaggtgggcgcgccatgtcccgatgcgcgggcgtgtcgggggttgggcccgatggggatttctgttgttggttggaggcagaggcacgcagatcgcgcgtgggtgggttggggacgtactggggtaaccggtggtaacctgaccaacccacgcagctcaattcccgtgctggcggaagacaagggcatgcatgtaaggcggctgtgttgggatggaggagatgggaatcaatctcctgtgcacggaaaacggagtgatctattagtatgtgaataattaagtattagctaattttttttataaatggataaatatgatttttttaaacaactttcgtatagaaactttttacaaaacacacaccatttagtagtttgaaaaacgtgcgcgcggaacacaggggagaggagttgggaacctcttatgccgaacacaccaagcctgtaaaaggtgttgatcactttatcagaaattcagatcccatgttaaccaaactcaagagagcctactccttccgttatataatgatcattatatatatttatacacaaagaaaaagaataatttaaactgtattaatcaagacacactatacacatacttctacaatacatgtatcgattaaaacaccatatcatttatactatagcatgcacatattctcccatcttgcattaattgtatttcgatagaatccgtatccatgtgattatatgatgatcaatttgagaaatatttgatttcattatatgatgattagtttctgaaggagaaagtaataacataatacccacacctaccacatactatgtcatttatcactcaaaagaaaattaccttttgcttttactttcgggggcgctgatcgatcggatgcatgcgtgatcaagctggccgccggacactccctgtacgtttcacctcgcgatctgcagagttcaaacttcaaagtgcaagaataagtcctacgttacccggtcgagcggggacgcataccatggccaacgctaagatgtgacacgtacctctagcctctcccacgcggacgcgatgccaaaaagcagcaaaaagcacgtgcctgcgaggaggcgcgaacctcatgcacccctgcgcgaggcgtcgggtctaaggccagggttcgagccgtggctcgcgctgagcagcttgaggcctcttgggcgtgtagctttacgcaactttacgataaataaggtctcacttgtgggtattacctctattaattggagaaataagctctcctgtgtagccttgcccacctaacaaacggggctacggtttgcgtcggtcatggcctaagcaggcagtgtagtgtatagtagtagcctcgattgttggtgcatacgtacccaggcagcaccgtgcatattcttatcggattaggatcctctgcagtcgactgcaccgcgtcttttatcattgacatgtgagtctgaagatcatcagacccatatgtaataaatgcatctggcagtgaccgcagaggatctcaatccattctcgtcgggttctctttccctcctgcaaagcccggccggccgctgccattcaccgagcggcagctagccagcagcctacagcctgcctctcgctggctctgagtagccaagagtccaagacgtaccatctcttttctgaggccagagaacgtaggtactagtgcaaaccaagataaaaagttaccggagataccaccaaatatctaattattgaataatctgtattccctggcgtttttacattataagatgtttcagtatttttcaatttaaacttctttaattttaactaaattaatataaaaacaaagttaacaaatatattcaacgttaaattttataaaataactttatcctagatggccttttgccgattgccattgaactttgaacaatactacagtgctacgcctgaatatgagtccacgttcacagctcggctctacaagatcttaaacgaaaattaaattgacaaaacaacctcagattaattatccccaatttgaacctaatcacagcaattacttgcattctccaaaaccagactaaatattgattcttgagtagcaagtttgattagcctaaccacaccccccgtacacacgcgcgcatacagtcaccgcgaggtaaggtcacctcccccccttttcccttgcagtgggtctctcgccggtcgatctcccccacgcctccgaagaatataaaagcccccttcaccctctgttgccttgtagcctcaacacctcaccagtgcaccaccccaccaaccacctctcgttttgcatttctctgcgctcgctgtcgctgccatggattacggaggcggaggccgaggagatggtggtgtgcgcggcggccccggccgcggggagccggcggtgggggagcacagccgtaccggcccaccggcgtcgtgtggccgccgccgccgccgggtagcacccctgtcaccgtccggagggctccaccgtcgacctcgccggatccgcagccggaggcttcgtcgtcgtcgacgtcgacaccggacaagctggtgaagcagaacgcgatggagatcgcgctggcgccacccgccgcggcctctccagatggtgaggcgctggcctcggacaatctcgcgcaggtatggaagaaggaactcgtccactcttctcgaggctatggtgtattggtgtacgtcactcgcaaccacgttcccatcaacaaactgagctcatcttaccctctccccttcccacccctctagatctctgcacaaccgtttactactcttctgctgttgtttctatatcgatatagtagcggtagcggcctagatccggttctaggcatgggtttcgagtgctaattctgaatgttttgattctaggcatgggtttcgagtgctaattctgaatgtttttgttgctgatcacgatgaacgttttcgtgtgtgcactgtgttcgtttacgaatctcatgctgcctaatctgttttgagacggcgagattgttgatatatgattccaagtatcgaggcttccgatctcatcctttgttcgtttacgaattttagtgctgcttaatttgttcttgagacggcgagatgttatgtgatatgatccaaagtatcgaggcttccgatctcatccttgtgatgtttggcagaaaacgaaaaccaaagcatatttgaacgtttcttagatgtctttttatttcttattttgtattacatctttattgcatccctgtagagtacattacagtttaatgtatcctcctgacatcttttctgggtgagaaaagatgtattgcattttgaatgcataagtgtcaatactgtacaatttgaatgtattttgagatagcatcttcttgtgttacatttttattgtatctcgctaaagtactgtgctgttgaaatttattccgagagcaattttggtgacaccatgtattacattttacaagaatacatttaagaacacatcttgtaaaatgtgtggtaagatttaagagcacactttgattgcatctgtagataatgccgtgcagctaaatttattccgcgagcatttttctcttgtcaacaaatgagtactgattctaaactctaatgtttcaaaatcttcagataaaaacagcattaggtggggtttgcattgaaacaaatcatcaggatgataaaatcagaaggtacaaggggattacccctattcctttgagccagctgttgtacttatctttcatctgctgtttctgtaactttaactccctttctgtttatgttctctaagttaagggaaatcaatgtagattgttgaccttctgaaatacttgttgaggtgttcacagtttgaatttttagtccgaggaaattcacttcattattctacattagactagacatactacagaggttttcctttcagctaaaatcttctcttttcagaataagtattcccaaatgacagagatactttgtcctccttacaaggttaatcatggtttgcattgtcagcccaaaacattgaattactgtttttctagtaacacattgtatgttaaattttattatttggatcctaggatcctttgttagcatgctgttaaaaacaacaggtctattaacacattatatgttaagatcatgtattgattgctgtaatgataaattgtttggcttcaacccgtgaatgccgttagttacatagtcccctgcttgaggaatgttaaggaatatagagtcctttacattgtggaaagcttttaaatctgatttttaaaaatgtcaaatagtcctttattttcaatgtagattgttgatggaatatttgaatggtctttgttaaggattttgggcatattagcatatcaattatatctggatgtgggatgaaatattttttccctttaaaatggttatgacttagatatctttcaatcttataaacgatccgtgaatattcaactgaaatgatgtgtaaatgaagtattacacgatttccctgacctgggggagtatagcatgtgctatcatctttttgttagacctgcatttttatttatgtacattggtgtttttttttccaaactgatgcccagtatttaatgttatcagattttctgttgacaagaatgggacaagatgctgcctagactctagcagtgagtctggaccatggtactccaagaagcttaataacaagaagggagtgactggaatccttagtcaatggcacaagcagacggaacagaaagctcatgaggtataatgcgacttatatgcagatccaaaccttttatgccttttgaattttagctccattttgaatatgaccttttatagattttcttagaatgatttgtgtgtagaacatgagactttttgaatatgaccttttgtagattttcttatgatgatttgtctgtagaacataagattgtatttctcttgacgatgtaatttagtcatgaatcatgtatttgtcttgatttccatctcattttttgtcaggttgttatctacaaacgttgtactgcttctggatctgcagttactctttttcttattatgatgagcttggtttgtacggtgagaggaagcaaccatggaactgattgcgacatcggcgagtactcaacgagcattgctcaagtttgtcagtatggtgctcctcccgcagtgtgttgcgaccttttacaatccgctgtccacacttgtggcaatgctagtgttttgtgtgaaattggcagatctgtgccaattacttctagaggtttcaatgttcatgatgttatggattggcaccgagagtgcacgggtcaaccagaatcatccagtgtagatgcatcgtccatttgttatgtatcaggtatatttccctttgcttgtgtgatctgttagcctgctttatctgtttactgaacaacattgtcttatctgatctgttagcctagctagtttaactgtttactgaacacat

SEQ ID NO: 13553 - DNA, 2710 bp, Oryza sativa
cacaaaagaagagggccatcaagtaaatattttgattgagaccggtaacaaggagtgcaacgcaaggaagtcaacttctactaatccgatgtttatcggtttaggaattgggtttggatcggccatgctctttgctttcgcgctggtggtgatttggctgttcgtgagaaggcgatcacaaggtatgagtttttctttaaactagtataattctgtttgcttgtaaatacggccaattgaactcattttcattttgcatatggtcaattgaactaaataagaattcttattcctgcaggaggtcctctggtgccgcagattagcttgctcgcaatcgcgcctcacttctcccaagggcttcctgcgctgcccttccaagagcatcctgcgctgacgcttccctgcgggcctgtccctgtcccgacacctcaagaagttacaacagtgcagccagccaccagtgcatatggtcagccagcgccagtgcagccagccaccactgcatatggtcagccagtgcaaccagccaccaatccaatggcgtacttggcatcagtcgtttcctatgcgattgtagacagacttactagccgccgtcgtcgctagtacttgtgtttgtctctcctcatacttttttacaactttcttctcatacttgagacaactattgagtttgatgatttagaatacttgagatgaccactgaacaattccggttactgtaaaatttgagacagctagtgagtgctgatgatttctgttaatttggttctttaaaatacctggacgactattgattgagggctgatgtttttttcttttgttaatttggttgtttggggtatccagaattcataatttcagtggactccggacttcggaacggttcgaaaacacaaaccacttgtttttaagtttttttaaaaaaataccaagtatatcttaagacaaaaggcacgagggcatagcttttaatagaaagcagataaaattcaaattgaacttaaagtttttggaccaaatttattcggactttattgattttagtcggtttatcaacggattacatgaagagatgtgcttccaatgatatcattcagtagattttgatctaatattaggattgtgagatcctgtttagatgggactaaaacttttaagtccctatcacatcggatgtttgtatattaattataaatattaaacgtagactattaataaaacccattcataatcttggactaattcgcgagacgaatctattgagcctaactaatccatgattagtctatgtgatgttacagtaaacattctctaattatggattaattaggcttaaaaaatttgtctcgtgaattagctttcatttatgtaattagttttgtaagtagtctatatttaatactctaaattagtgtctaaagacagggactaaagttaagtccctggatctaaacaccacctgaatctgctggtgtgtttgattagagataagaaaatatctgtttatttacgttttaagggcctggtgtagataagggcctgaatgaggaacttctcctccatatatttatgatgtttccctagggtccaaatgaaatacgttttctacggctccatatattgtgcggcaatggcggaagctaagtcgaggtttttttttaatggtggaatcaaatgtactacacctatactaatataaaaaggatcaattcaaactttttgctatggccacccaactgaaatgtacaccgaaaggtctcatccattccgtagccgtttgatcgtctcatccaacgcctcaaaacgcatctaccacatgatgtgtgtgtcaatttcagggagtaggaaattggggataaacttgttgcattgacttagctctatgggcaatatattgtgtacaagagggatgggaaataaccaaaatatccaatacacactattacacttaacacccccactcaaatgcaatgtgtatgcaataacgttgcatttgaaaactacaactaaacactaaactaaatcaaaagtccatgcttgatgatgacgtcgaagtgtgcagttcttgaaatgatgaagaagaaatgattcatctcatcttcaatgaagcggaccttggagccttcacggatcgttcttcagcctttaataccttaagccttcacaaattgtttttcagctcttcattgattcagagatggtgacaatgatattgaaggaccttcacaaactgttcttcggtccttcatgattgatgatgatgtcagctccaacggggagcatgatggaccaactccggcagggagttggtgatgatgacaggacaataatgaagaccaactccgatggagagttggggaagttggagatgacctgctccgatgtggagctggtgatgaactgatgatgacggctagctccgatgtggaactagtgatgatggagatagattggcaagacttcgacaaattgaagaataggcaatgacttcaatggactcaatgggaactagtaaatgacatgacgatgctagtatatactccctccgtattttaatgtatgatgccgttgactttttaaccaacgtttgaccactcgtcttattcaaaaattttatgcaaatataaaaatacttatgtcatgcttgaagaacatttgatgataaatcaagtcacaataaaataaattataattacataaatttttt

SEQ ID NO: 13554 - DNA, 4401 bp, Oryza sativa
taatattataataattttcaaatgatttaagcgacatataataattaatttcatcataatctttgaaataacttcacatcatattttgtggtgtcaaatataacttgacaaatatataacactaactgaaatcgacatgcttgaaaacgaaacaacattatgctttgtcagttatatatgatttaattttaatttatggagactaagattctcaaatgttttttttcatatttttcaaaactatttcattggtattcctaggcaataatcttgctataatacggccccttaatccatacgtttttcccgccagattagtttgttaacaaatgtgcattaaattactcatgatatattttgtttatagtcgaggaattctaatttgtcgggtataaatgatagttgatagttgatgaatgtatgctataagtgcactccaataaattagttatttttaataatttttgaaagtaaataaaatttaaaattagtaaatgtgtctcatgcaattatgaaccaattatgaacaacaggtgacgaaaacaaaccatacgctaaaatattgatctttgtcaaaatataaacaatgatataatggtatgatactctgaagatggttatggtcatatatctgtttagcgatacatttcttaatgatcaacctcactcatttcaaagcagaatattgtatttatacataaaaaattaggtagtactgctcaatactagaaaaaattatgtctacacaaaacgtaaaaacaattattttttatgggaagaattattttcattacatcaatcttttcttgctttctctaaaggctattgaacatcttttacaagtatagttgaggtggccccagtggaaaccaccgttgacaatagtgctcaactttttacttactcatgcaatcatctttaagaatgctgatagtgaattaggacttaaaattgtactgcacactgtccttgagaggcatgagtatgtcgatatggaacccatgtttaaaggcaaccgagaaataaagacttggtatctccacctgttagaggggatattcatgtctaattttcaacactaatatcacatttaccaatagatgcagtattttaagtatatttatttatagatttagaactatgtgttgacataaacacttaggtatatagtggagataaatgttttatgtatttatgatgtattaggcttattttggtgctacagatgcagttccgtttattaaaaaggcatctagcgacaatggtaagaagtaatggtgacaataggcaagtttacataatcaggacaaaagtgatttttttaatataagaaacattcctatcgtttatattaaaacctacaatatatttcacgacatagatttttgttattatgaggtaaaatatataatttcttatacgcatatgatgtgatatgacttaattctcataacgttatttttataatcataatgaataagttccccgcgtatctgcgcgggctttctttctagttactagcaaaagacccaaagaatgctagtgaacgtgttgacagtagcaagcaatgagctaatgatctaactaccactccaagccatcatgataatttggagatgtaaaatgggattatgataagcagctaacaataataaaatacggtgataattgatgagtgattatcggatgcagcgaccagcaagcacaaaaattaactgcatatgtgtgatggagtacaagctcaaagacatgaaaaacaaatcgacgattttgacagattttgcaactgaaattaggagcaaccaacaattttgacagatgatgatgaacaatgaagcattgatgcatatcctttgttctccccaaaataaaactgaagcagcacaagctacatcagtacatgcaaagtaatggagagagaatgtgcagagaagagctggagcttgcgttgacttagccataggcgtcttagcagtgacggctaaagatgaaattgtggaagaggaagagaagatgtggaatatttgcttgctggttggagatgaaatagactacgacggggctcgctgctgctgcatcaggcaggacccctgctgctgctgcttgactccgcgagaccgttcagtctcgctctcccattccgcggtaccacgcggtctcgcactttcgccgcgcgataccatccacgacgtcattcccacgtcgttctcgtgcaacatttgtgcgagaccgacgatatatttacgcaaaaaaatttacatcccgaatatttataagaaaaaattgaattaacagtatattttcaaatttaatttctaccttagctgccaggaactagagaaagctccaggcatcagtcgtttagtaattttgatgttcatattctcgtgagttgccttgccgcattatcatgtacagttttgtgaatcaaaatgaaaaccgaaggattataggttctggaagttccatgctcaaaacaaacaattgttgccatgttagaatctgaagcatgatcaatttagcagtttcttttcgtagctgtgtcttactactttcagttatatgcattagctgcttcaactatgacctgaaacccaaattctactcaattttaagttggaacgaaactagataaaacatgctgggtaggcccacatggtgcttgtgtctatcgagcaatagctagacttatacttggtgggtacaagtccaaatttcccaacaacatcacaattgtttatatgatctgccatatccctgtttttcgtttggatatgttgctaagccgagtaaatattcttaaaaaaagcagagttagaactcaagctgtggcagagttgctctgaaatctgaaaataccaagttcagaacaagcagcacatggtacaatttagctgtattcaaacacatctagtattactgtttttaggatgtacgattttatctatttttagtccaaaagaaaggaaagcaccatatacttcatcctagcaacaataggtgcaagttatataccgtacccttcatttgatttccttgtctttgattcaccaagaactagttctacctgaataccaacattggtactgtatgatagatatgtatgttttatggttctagattttttgagaacccatgttcaagtcttttgtgccaatgataaatttggccgcaactcatggccaatatgaacataactgaaattcccggtttgaacttcattggaaactatttcagttttaattgggactagcacatataggccttgtacttcagaaatatttcaattttactgatgtaaatcggttgtactgcactggtttgcaacctgaaactccatttaaaaatttaaacctagatcataagatattcagagataatggcaagaagtagccgggccactgaagctcatggtggcattagtgctatattataatttctcttgcacttgagtgggtccttaaacaagtattataccatttcagttctgcttcagcactagtgttcatctttttcctggagttgcacatctggcgtttgcagcatttctgtaaattggcatagtataatagtgttgtcactatctcttttaaggacattctgtaaagcacgcatggatggctttctggtctggacatgcaggagaggagcacttatgttatttttttagcacttctattcagggtgaagacatcctttggagcaagcattagtgtcggatcttatgtgattgaatatttgcctgatacttttacctttcgactgagacattttactgcttatgtgattgaataagtagatgtgtagggacagttcttatcagatctgtcaaaccttgtgaattgtgatgatgctattgatgttcagatgggcaagcgattaattctgtgtatatgtgtgctagtgagtatgattaattatgcgtatgggtgctaatgtctatgattaactagatgggtaccccgcgcgttgctgtggaagaattatgtaataatatagacttaatatcggttgagcagtaagaaggagaatcggttatggaatatattcagagatttcgtaatgtccgcagccgatgttatagtttgagtctaagtgatgagcaactagcatatcttgcattccaagggctatcaacacctatcaaggataaattattttgccacgagttcgacagcttagctcatctaatgcagacagtaagtaagatcaattttggagttattaagactagactgaagataatattgaagcatgagctctcgtactccaattttttttttttggagggggggcctgtgttaacaatgaaatttggtaagccttgaagacgtcatcagcctaaaatcaatatcggcttcagagttttggaatcggccgatgagaattatcaagtcgcca

SEQ ID NO: 13555 - DNA, 493 bp, Oryza sativa
ggacgctcaatcgtattctttaccacagccaaacatttcttgttggctaaggaccatttcttttgtgcaatgttatacgacatgaccagaggagcattgtccctctggcttttttgccaggcagcatctgactcattttgacctgtgacacggtcagcaagcactataggacatggggtaagagctaagactgctcttgcaaaggaggagcttggaaagttatacagaggagaatgctatattgctctctatacatatcattctggtgacaagagagaagaaacttatttgacttattggattggcaaggacagcataccaggaatgtaccttccagcgctcccaagctttagaatgtgcatcctccgttttacaatataagtcattctagcgtttcccacattcgtattgatggtgatgaatatagagatatatggctagactcaataacaataatatgcatgtcgcaaaatgctagaatgacttacattgt

SEQ ID NO: 13556 - DNA, 1299 bp, Oryza sativa
tttggaaaagcgagcaaggcaaggtcccatcatccttgagcatattaaatccaagtttataaaattattttgatttaaatattgcattatcgctttacttaaatccccgcgttatcactgtttatttagccatgcctattaacctttgttatgaccttattattattgttattgatattatacccttgttcaccctagattaaacaaaaccccaactagtggacactctactcatggtaccactagtatgattttaggtagatgcttcgctggttaattaggcaacattaggtggttttacaactctagactttgggaatattctcatcacctggacaccatggaatggatggattattgtggaattggattcacacctccccctctattcaaaaccctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcagcccggtagtcgagatgtcatggcacagggccggtgtcctcctgctaggggctcaatcctgcctacctgtcccgtgggttcctgtcacaccccgaagttctcctcccaagcctaaatttaatttacaaatgaccctaagaaaataccggtgcaaagcaagagtaaacccttttaaatcaatgcaaataataatcggaattggcatgtggaatttttcttgagttctacatgtcgaaattctctaacaggatttttagtggaattttcagagccctagaaataattttaaccaattaaaattgagcaagcaatattttaattccagggaaaatcctttttcctttttctttttctttttcctccctttttcgaatgggccgctggcccattctctcctttcctccccctcctccctgctgggccggccgcaggccgaggcccagccaggccgccccgccgccctcctctccctgggtcgccgacaggtggggcccacctgtcgggtccttccccaacctcccgccgctcccgccgcgccgccgtgcccgcaaccgtcgccgcgcccacgtctccgcctccttcgggccacgtcgaccacgcccgcgcgtgcgccgcgttccccgcgcccactcccctctctcacccgctcgcgcccgcgcccgagatg

SEQ ID NO: 13557 - DNA, 46196 bp, Oryza sativa
  unsure (1)..(46196): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgtgctcatagtggaccaataaagtcaaacactctatgtattagacccaaatccacttatgccagaatataaaaataacccaaacatgagatacaccagaaaactgataactatttgtgaccactttaacaaagctatgaggaaggcatgccctggctctaggtggaatgaagacatcaacttgtggaggcaagtatttgtcaataatccggttttcgacaggtaagttatcttctaaaaactcgttcaaaccaataaatttaattctgtagtgcaagggtagctaactatcaaatttccttaggagtttatcgggttttgttgttcatctcttcatgtgtacatggaaaaataaagaaccacatttgtcggctattaatgtaagtcgtgataggcattgattatacatataatacattattttatatttaccaatatttaacttattataaatacatgtgcaggatagtgacgagctaaggaaacttttttttgctaaatctactgatgtaccaacaaaatgagtgtgaaagcaatattcctaacggcgcacaagattttctgaagtgtataaaaaatgcacaacattagggtagttatttaactatatggagtgatttaatttgaggtgatcatccattagaattaccgtatctagaaatgctggatgttccatattttttgcttgtgctttatttgtatgacatcatcaaattttcatagctgtcttctatctatgttgctttttataatttaataaacgccatgagattgttttatgcgccaaaaaggttgcactacacttctataatgataacatatatcttgctttcaaattaatctcaaaacaactatgacttgtagtttcttttcgatgccagattttatcccccgtgatcaacaaaattccctgtagcaacgcacgggcaccctactagttatatatgattattagaatttttaacaattttaaatcttgcatgtggtaattacatatgattattagaatttttaacaattttaaatcatgcatatgatatttatatatgcttataagagtttaaaaaaattttaaatcatgcgtttgttaactatatatgattattataatttttaacaatttaaaatctttcatatgctaattatatatgattattagaattttaatgcattataaatctagtatttgttaattatatgtcatccacataatttactacatattttaatctattttaaatgttttgtcattaattttgtgattttaaatcattttaatgcattatttactattacgttaaacccatatgtaatgaaaataaataagcactgttattatctttagtcccggttcttaaccctaaccggttcaaaaaagaacttggaaatagcgggaaaagatcttttcccggttggtggctataaccggttattaccaaccgggactaaagatcgtctctttagtcccggttggtgagaacaaccgggactaaagaaatctttagtcccggttggtgagaacaaccgggactaaagaaatctttactcctggttgtagctgttggtatttcttctttactcctggttgtagctgttggtatttcttctttactatataattcccagcaatagcactagaaataatcctggtatattacagttactgatgtgatccgcaagtacacgtatataccattgcaacatttcacccgggagtattccaaggtatcatatttattttatcccaaggaaaaatatgataagagagtactatgctaatagtttatactttacttgtatacatcaaggtctatgcacgggtaagttaagcttaagggtagagtgacagacagctgaggatttagctaactcctacatctcctaattatagctaagtggtagtagtttaaatatgttccatttctgtacttctagtatacaacatcttagtatactctaactagtatacactatgttgtataacccctttaacaatgcagcattgctaagccgtaactcagctatgccctcacgatgcatcgcaaagttaccccgggttgctgagttttttacaacaacctgacataaccctccaaccgaagtaggatacataggtgtatccaaccccagtaaattgtatgtagaaatataaacggcggggaagacgtccgtactaagctatcaccatcagcggcctgctactctcccggcgaacatacctctaaataatgatgagtgataacctaaaccctatgcttaagttactacttattactctacagccttgcaatcggtgcagagcatctgggtcctcgggccatagctctcgacctagccagagcagacttatgacccggtaatcagatattataccagcatcaatgcaaatcccagaaggtttaaccacacagattatactacttatgaataaactaagactgatactcatactctatgattggaataaagtaccaaacttgtataaagaagaatattatatttataaatggaagtcttacaaagaagaaaggaaaagctatagaacctttactgaactcctcgaggcctccgcggacttggaactattctaactctactccactaacactaatactaacattgtagagagctttgatccttgcttgagtgtgtgttgaaagtgaatgaggtgaggtccttttataggcaggtatgacggttgtagagcatggtaattgtcggaaataccccacaaccgccatcaggagttcgtccagagcgtccacaccaaaccccatcctgaacggctgtgatggggaaccatgatatggcctaaacggcccaatttttggcaggccgactccttgtttgctcctcaatccaaaacatggaattttgggcttaattgatcatgtcttttctgagttctcagcccatctatctataagtctgatcctcggcagcacctgattgatcgtttgtctattttctgtcgattctcctcatttatatgtgcttctcctgcatacatgttagtagcaaagtatatagtggaagtagatattttatttggaatttgtgcattgcaagcatagctagtcttcatactttggttaatattgatggtcgaaactggtcgataatgaccgtcaacaaggacattatggaagtcacagccgcgccacagccgccgccgccgctgccacaggccgccgccgccgccatcgataccgacgccgccacagccgccatgcccctgccgccgccctgtcgacgccgccatagccgcggccactgccgtcgcctctgctgatgccgccactgccgccgtgccactgcctctgccggcgggcaccagtgaatgaacgtgaacgaacgagaaaaagatcatgaacgaacgagaaaatgagtggaacgaacgtgaacgaacgatagaaatgttagaacgtacgtgaacgaacgagaacgacagaacgaacgagaaaatgagtggaacggacgtgaacgaacgatagaaacgacgcacacgccgccccgcaccgcggccgcgccaatgccgccgccgccaatgccgccgccgccatcacctctgccgacgctgtcatagccgccgcaccactgtcgccgcctctgccgacgcggccacagccgccgtgccacagtcgcggccactgccgctgcctatgctgacgccaccagtcgccgcgcctctgcctctgcctctgccggccgccgcccgtgaatgaacgtgaacgaacaagaaaacgaacatgaacgaacgagaaaacgagtggaacgaacgtgaacgaacgatagaaacgttagaacgtacgtgaacgaacgatggagacagaacgagaacgatagaacgaacgtgaatgaacgagaaaacaagtggaacggatgtgaacgaacaagaaaacgagtggaacggacgtgaacgaacgatagaaacgatagaacgtatgttaacgaacgaacgagaacgatagaacgaacattaccgaacgatagaacgggacacctcgttaacgaacgatttaagttacatttatattagaacaatttagactaatacatttgtttgcattttactgaaaaatacatggtcaagcactggtcgtcaccgttgctcaagcctaagtggtatcaagccctcggaggaatttgctcaggcaagtgacattaacgatcaaacgtgattcaatattgttttgaattgtaacaatcgtttgtgcccaaattaaaattgttattacattgtaataataagttgtatttaacatacacccgacataagtcaatatatgattattagagtttaaaccaattttaaatcttggacgatgtaaattgttctcgatgtattgaagatccatataatccaattgttgtgtggcatatgttaattatgtatgattattagagtttaaaacaattttaaatcatgcttatgttaattatatatgaatattataatttaaaacaattttaaatcatgcttatgttaattatatatgaatattagaattttaaacaattttaaattatgcatatgttaattatatttgattattacaatttttaacaattttgaataaagcatatggtaaatatacatgattattagagttgttattacattgtaatagtaagttgtatttatcatacacccgacataagttgtaaataacatacgcctgcaaatatttcttgtatgaacagatggctgatcgcgatgacgaacagatacaatacgacacgatcgtagagggaagcagccagtactagaacaaagaagaggggaacgaggatccgaaccagtaactaaacgaggaggggaacgaggaggaggagggtagtggaagtcaaccctccgctagacagaagagggcacgcggacaacgaggtgctgtgaagaagattgagggtcggcacatcataactgaagtggacaaagacagctgaccaagtgccccgtcagatgcagcctggaatttcgtacgacacagcggttgggttgtgagggataacatgcctgtcagcacggtgtactggcgcagaataaggacacacggggattttgaatgttttgtcccagattcagagaaagagatgctgtggaccataatgctcgagacgttcacgctccatgagggtacggaagacaaagtgaaagagtggactctgaagaaagtgactgaacagtttcagaactacaagggagacctctacaagaaatgcatcatgaaagggcagacaatgaacttcaactcattcccgaagctcagggatcattgggatgactttgttgcttacaagacagggtaacaagggcaagcgcagatcgaccgaaacaaagcaaatcccgctaagaagaagtaccatcaccacctggggtcaggcggctatagcatcacagtgccgaagtgggaggatatcgaagccggcttgattgagagaggtatcgaaccggccatctctaaatggctggaatgatcaaagcgctggtactatgctcacggtggaacgctgaaccccgctgatggctccctggtgttcagcaatcagatacgcgaggctgccaatcgactaacggaagcagtggaagcctcttctcagggcatgtttcgaccggacagagagaaggacgagcttacgctcgctctgcagactcccgaatatccaggacaaacgcgagggaaaggcgtggttccttggaagattggattcaaggaggacatccacatgtacaggagttggatgaggagcaagagagataccgaggcgaagattgcagatctcgaagatagggtatcgaactatgagctcagtatgcaagaggaggtggcaagaaaggtggatgaaagtatggccgcacagcggagccatgagccccagccgtacattcctcctgtcatggtcagcccctcaggcaatcatagcggctgcacctcaacggggtaggtaggataacagagcatcgacgcgatgcaagctcaggatgaaaccacctgcctcgtcgatgaaatcacgcaacggacgccatgtgagctacatattccctttatgaacttatcaatcaaggtatgctcgtagttttatgatttttgacatgtacattctgcaagttgctgcttaggttgattactaatagataacctctcatcacgtgaaggtggcgtcaggaatggccattccaatggacccttgagggacttacatctgcaggccgattccacctggatactcgagggtcggagttgagctagtggaagccgtgtacgaggacctcgagttggactaccttggaggagacggcgagacgcatctacgagacacaagccacgtcattatactatggcgcaagcgctacatcatatttcttgggcgacaagcggcgtctcgtgcaccatctcctccagctcctccgcctcgtgcaccgtctcttctgcctcctacaccatctcctcaggctcctgcaccgtgtccttcggcaccttccaagttaaggtcttgccaagctccaccgcttgtccgcacaagggcaacgaagaaggcgaaagttcaagaccagccgctcgccgaaaacaaagaggaccttgatgcttatgtggtaggagaagtgaagaggcaattcaagcctcggagtctagaaaagaagatacctatagacccgagtgtgaagtacttcttcaagaaaatgtccacaacaaacaaggaggtcttaaagataacggactatgagcgaacacttaagaaagcatattacaaaatgtccaaaccagtccctcagcttggagagcaaccaaaccaagagatcgagccgttggtgaccggccaagaaattggcataaaagaattcatttctgacactgtactagctagggatcaactgcttaaaggcgcaccaatcccaacggcggaaatgaaataccaatttgaactcggtaaaccgcttgtcaagcctgagcagctgaagtccctatcaacacagatgtaccgattccatgaacggtacatggaaatgagcgccaacggtaaacagatgttcggagcaagaatcagaaactcagacttcttccaaggagaagatgttctctggatcctgttcgaggatgtcttcgacctatactatctggatgcccacgatgtctctcttctaagcacatggattttgtaagtatcattgagttagatttatttcattccttaattagctccttgtatatatgtacaccataataattccttttatcgttgtagaatgttgatttaaagggcccgacggtgaggggtttactatactggattcatcgaccctcggaaagttaacatcgaaatgatcaacaagtattagcaagacacagaggacaatctcatccatctcctgacgcagcagcatttcaagatgttcatactactgtcgtacagcacagagtgagtttttactgacttttgaacaaatttcgttcccgtacatacatgtacagtttcatatatcatctcacgcaaattgcagattccattgggtccttttacttttcgacttggaggcatgcgagtcaatgtctatgactcaatgaataaagaggagtctacttttgaccaggtttttcaactgatagacaggtaatgtcatctattccactgtcattacgaattttgctattgctactatgcagatctcggataataattaatcatagcttgcaactgcatgtagggcttgggatcggttccgtcaattggtccatgggacttggaaagaaaaacttggccggaggtttaattttccagtgagtacataatctctaattaaaatataagtgtatattaaatctctcgtcgtttctcatgtagtgtgcaaagcagacccagggaactaacttgtgcggctactacgtatgcgagtatacccactgcctatcaacccaaatctacaccacaagagagctcaatgtacgtattcaaaatttcattgcgtatcgatttcttgtttattaatttcatatattcataggttattcacatgagggacaacctcatacacaaggaatttatcacgtctgttcaagaacaactgataggattcatcaacaaactagtccttttttcttctgacataacaccaacgtcgaagtcgtagctagcgagcacatcaatgaattgtaatacatgtatatatttatatatgtacacatttactttagtgtaaatatatatgttggtaatatatgcacataaactgttaagtgctttaaattatacttgggtaattcatatatgaatttatacatatacatatgcatttgactattttgtaacatcgttactgcggaaagtagttgtgttactacacattgaccgtcgagttactatgtcgttccagcgagacaggaactaaaaaatgtataaatctcaatatttagagagcaatatctctcacgttgtatattatttttctaatccgtctgcaccgtgatgttcgtaaaaaagtgcttaacaaaactagatccatcataactattttttaacgttgttactgcgagaaagcaaacgtgttactgtacaatggttgtcctgttactgcgcaattcttacgagacgaggacagtaatgaggtgggcgtggggggaaatgagtaggcgggtttgaccaacgtttgaacggcggggggcactttgactaccctttgactgaggtgggatgtaggttttgggccctaggaagggtggggaaagtggggttgacccatgggagggggtgtagaatagttattctaggggagggttgtagaatagatttgctatatatatatactagaaaaaaatacccgtgcgttgcaacgggtgaagtctattttaatcttatcattgttatatagtttagttaagaagaaatgcactgtgagttagaaatcatgagctgcagttaggagtccaatcgtctcaagttaacatgcgagtttttttaaaaaagatttcttatatgactccttctgtatttctaaaagcgaacaaacttaaaaccgatatatatatttttagaaaatcatgagctacagttaggagtcaatcgtctcaagttagcatgcgggttttttaaaaatgatttcttatacgactccttctgtattttggaaagcgagcaaacttaaaacccgacttaaatacggatctgtattttcaaaagcaaatgaacttaaaaactgactcatacacggatgatgtaccaaagtaccggtaaaaacatcttcaacttttataatagtagagatagagatagagatagagatagagatagagatagagaagagatagagatagagaagagatagagatatttgatggtttttcatcggatatattacggtggtgatggtggtgcccaacggccaaaagcggatagccatggtgaagcaaagtgacgagccaggtcccggggagattagatcaacttctggaaggcattccatgggctgatgaatagctggatgtgggaaatattcatgggccgatatggtaaagctcccgtccatatttattggatactcacgtttgcctttctttttttcgggaaggatactcacgtttacgttcgtgaaaaaaaaaattcgatggactcgtcgcggatatgaaacagaatcagatatagatgacagtacgaaaagtaggtaaaaacatctttaatttttataatagtactagaaaaaatacccgtgcgttgcaacgggaaaaaacatgagaaatttaagaaaaggttaagaaaaatttacattatgtaattaattaaaatataaaatcgtagctatacatgtatacgatgttgaagaaaagaaaggctcataaaaatcaaggtaaatgtggaaaataaaattttccaaataagctatggctggatttaatttttattaaactctccatgattaattacactatgtgaaatttttccagtattttcagagcaccattgctaattttaataatacaaacatcattctagcatttatttaaatggaaatctaaatgaaaaccctcctttctccttgggccattttgagcccattcttctttagcccatagctgagccggcccattaacctcacttctcctcccgtccaccttggcctgtaaccgcacatccgacccatcaagcaaccacaaagtctaataagcatcccttctcctcctctcactttagtgtggtcccagtgctacagggttgtccctacctccgtccgtatatacaacgcttctaccaggtccgcaacactattccgtgcattccggcccacgcggtcgtttatgcgtttcggaatagcgtgcggcacaaccgcatgctggagaagattgcctccaaggagctcaagaccaccgccaagctcttcgagctggaggacaaggtggctcgaaaggaggaggcgtgggcctggaactcccccggcaccggcgcggcggctgcagctccccccaagtccgttccccgctctaagcggcgagataggaggaggaaaaggaagtcggcccgctccgatgacgagggccacgtccttgcggccgatgggccctcacgggccccgcacaaggaaaaagccaccggcgacaagccgagctccactgctccctccggcgagggtcgatcggcagacaagtggtcctcggtgcacaacacctattggcatagcctcgctgactgctgctcggtcaaaaacttggccgagcggttccggaaagccgatgagaagcagcagagtcgacgggagggcaaagccctcgcgacccccgccaatgaccagcgagggaggccaagaagaaggcccccgccgatgacagcgaggatctggaattctagatacctcagggaaccgtcgccactctcgacaggggggcttgtgcttacacctcccgccgcggcttcaagaccatgaggcgtgagcttttggccgccgtcccaactcacgaggcggtacggaaggcgcactggttggaagtgaaactcaccttcgaccatagcgaccatccgatagtgctcgctcgggggggggggggaggggagttggccctcgtggtctcccctaccatccacaacgtcaagatgaagtatcctagtcgacgggggggccagcctcagcatcatctccccggctgcctttaacgcgctcaaagcctaggggatgaagctccagccgtcattgccgatcatcggcgtgatctcgggacacacgtggcctctaggtcatgttgagctcctggtgccctttggcgactccaccaacttccgcaccgagcggatcgacttcaacgtggcggacctcaatctgcccagggcaggcccgcgttggtgaagttcatggctgccacccactacgcctacctccagatgaagatgccgggccccagtggccccatcattgtctttggcgatgtgaaggtcgccctggcctgcgcggagcagcgcgccgacaacttggcggcagccaccgagccgcagcccccggaggcctccgtgtcccgcgcctccaagaggcgtcttgcctcggccgacgaggtgcccgtcaaggagattccccttggcgatgatccgtccaagaccgccaaaattggcggtacgttggacgccaaataggaaagcatgctcgtctccttcctacgggcgaactccgacgtcttcgtgtggaaaccgtcggatatgcccggggtccccagggaggtgatcgagcaccgccttgccgtgcggccgggtgcacgacccatccggcaccaagccccggagaggcaagccttcacccgagaggaggtgacgcggctcctggaggccggcttcatccgagaagtcatccacctagagtggccggcaaacccggtggtcatccagaaggccaacggcaagctccggatgtgcatcgactatatggaccacaacaaggcatgccttaaggatcccttccctttaccacgcatagatcagatagtcgactccactacggggtgcgaccttttggcttttttagatacctactccgggtatcattagatccgcatggctagggaagatgaggaaaaaaactgctttcattactcctgtaggcaccttttgttatacaactatgccttttggtctcaagaacgcaggtcctacttttcagcgcatgactcgcattactttgagtaatcaaatagagcgcaatgtagaggcgtatgtcgatgacctggtcgaaaagacgcgccaccaggacacgttgttgcaggacttggccgagactttcgacagttttaagtccacgcgcatgaaactgaaccccgaaaagtgtgttcggtgtgccagcgggcaaactccttggttttctagtcttctcccgaggcataaaagctaatcccgagaaaatacgcgtgatagagaggatgcgcccaccccccagcaaacttagggatgtgcagtgcgtcacgggatgcatggccgccctaagtcgattcatatcgaggctaggagagagggtgctgcccctattcaagctcctcaaacgccccgggccgtttgtgtggacggaggaagtggagcaagctctcaatcagctaaaagcttacctcactccccccatcctggtagccccggggccagaggaaccgttgctactctacttggccgcgaccccccacgcggtgagtgccgcccttatagttgagcgcgacgaaggcgacccgcgtcgcgagcccggccatgaaaagggaccaggggcccccttgattggcgatggcccctcgtcccccgacggcccggtgcctgaagccccgaacccctgggagggtcccgaggcccccgtgggaggaatagaggctctggcgggtggccccgaggcctataatcccgacatggcccgagatccccccggggctcctgagcacgggcgccccaggccagctgcccctgacaacaaggaccggccccaccgaaaggtgcagcggcccgtctgctttgtcagcgaggcacttcgagacgtgaaaacccaatacccacaggcccaaaagatgctttacgcagtcttaatggcctcaagaaaattggccactacttccaagcgcatcaggtttccgtcgtgacctcttaccctctcggccaaatcttgtacaaccgagagggtactggtcgggtcgaaaagtgggccatcgagctcgctgagttcgacctgcacttcgaaccacggcacgtggtcaaaagccaggttctagatgacttcatcgtggagtggaccccggtggacgaccctgttccgtccaatgttccctccctcctcggagatgcgcagaagctgagaagctcgcgcgtatctctaagcagtacgagctcgtagaaggagccctctaccggcgtgccgccaacgggatactcttgaagtgtatttctcgggagcagggcgtcgagctcattgctgacgctcatcatggtgagtgcggggcccattcggcctcacgcacattggttggtaaagccttccaacaaggtttttacttgccgaccgcgttgcaagatgcccaagaatgggtctggcgatgcaaggcgtgccagttccacgccaagcaaacccaccagccgccccaagccttgcaggtcatcccgctctcttggcctttcgcggtctgggggctggacatcctaggacccttcaaagcggcccgaggcgggtattagcacctgtacgtcgccatcgacaggttcaccaagtggcccgaggcttacccggtcgtcaagatcgacaagcattccgccctcaagttcatcaggggcatcacgtcccggttcggagtgcccaaccgtatcattacagataacggtacacagttcaccagtgagctatttggcgactattgcgacgacatgggcatcaagctgtgtttcgcctcgcccgcccaccccaagagcaacgaccaagtggagcgagctaacgccgaaatcctcaaaggcctcaagaccaagacgtacaacgtcctgaagaagcactgggattcgtggctcgaggaactgccgcagtgctgtgggcgaatcggaccactccgagttgcgccacaggggaaacaccctgtttcctagtgtatggcgccgaggcggtcctaccttccaagctttccctgggtttgcctcgcgtagcgctgtacgatgaggccaaccaggatgatcttcgccgcgacgatctcgactatttggaagagcgaagaaggcgcgcggccctgcgagcgacgtgctaccagcaaagcctgcggcgctaccatcagcgccacgtccgggcccggtcactgtaagtcagcgacctcgtcctacgccgcgtacagtcgcgcttggggctgagcaagctctcaccaatgtgggaagggccatacaaagtgatcggcgttcaccgagcgggctccatttggctaaccacggaggatggcacggagttgcctaacccctggaatatcgaacacctccgtcatttctatccatagggttgcgcgttttttgctttcctggagctcggccaacctccgcacatccttcggcttgtgcgggtttggccgggggctatcactattaaatatgttgtatcttttctcttccccagcaataaacttttccgcttaagcggaggccgttgagcgccctttcttactctttcctatggctcgtcctggttcaaaggataattcgcgcttactcttgaccctaagtggcgttgggtgacctgaaaaccgccgaaagggagcctaaacgcggggcgcaccctgggctgcggcgaaccctgggggctcggaagggcctacgcatggccatccccaacccccggtcgtcgtagcctcggtctggccagacccgctgggcagctccctcggggcgatggccttgcccctcgccacctaggtgccacagaccgagcgcgaatttcccttttcaccggaacgagcccggggggggggggggtataaagggggtaagaatggcaacttaatcacaagaaagtcaattgaatacgttcgctttggttttttttttctttacttgccgcagacattcaaaggacaaagcaagaacgtaaaggtgcgaaggggaagctttatttacaaacaggatggcacgatggcctaaagtttgaagcattcactgcgagcacataacaaaataaaagaaaaaaggcggggatagtcacggagtgcccgggcccccgaggccggcgccgctgaccacctcgtcctagtcctcgctgccgtcatcgccaccaccgtcctcgctcccgctctcctcatccgaggcaagcgcgaggttgaaccgaggggccgacccctcgaagctggagacgatcgcgtcggccgcctcccggacttgctcccgagcccttgcctcggtccccgggggaaagtcctcgagcgcgcgtcacgggaagaagtcggggtcgcgagcttgatggctcgcgagaaccagctccaccgcagcccgtgccaaggaagccgacgacgacttcacggcctcgccgacctcctcctccagcctctccaaatctgcagccatcccatccagccgaagtgcatggagatgcctacccggcgccccgcgcgctccagccgttcgatggcataggagagttggccaggcccaatctcgttggtgaggcggagggccgcaatctcctcggcttggtgctgcaccaggcgtcccaggtcggcgagagtgtcttgagccgcgacgagctggctgaccaactccgcgccgccgggctacccgcctgccatcaactccttctcccgagcctccagctcggaagccctcgccgccatcgctgcgcgctcagcgcgggcgctctccagatgccgggcctcgcgcccagcgatgacctcctcacgcttggtgagttgctcgcccagccaccgcgccgccacctcgcgacggttcacctcggcctcatgtacggcaagcgcggcgtcctgttcccggcacgcctcctctcgaagccacagctcctccgcgcgacgagccaccaaagctctgcggtgagggtggtccggttgtgctcagctgcggtctcctcacggaggcgaagggaggattccgcctcggtggccgttctctcgtgggtggccaaggtggtctcgcgctggtctagcatgcgtgcccgctcctccagtgcccgggtacgctcctccagcgcccgagcatgctcctccaactcccgggctcgcagcccctgttcccggctacgcccgtcctgttcgcgctggttacggtcgaggacctcgatccgtcgacggatcatggcctcgaactcctgcatggagcgggcacgctcgtctaaggccttgcgctcggcctcgagcgccgcagtccgagcccgcagcgaggcgtcgacctccgatgcccgccgctcttaggcggccgccgcgtcgaggactccacgggcgtcttcccagatcctcggcgtgggcctcgtactgcaagcggatgtcgcccagcgtctcatccaggacgcttgaagcgatgagcgccgcctggcactcctcctgtctcccgcatgaccgagtctagcgtttcctcgcgcgcctggatctccgccagttgggcttggtgcattttgcgccccacctccaccatgtcgtccatggcgcggcgcccctcgtcaacccgcgtgcggtccgccgcgagctgtgcccactccgcctccagggccgcccgctcgtccgctagggcttgaacttgggcattgagcccctcccggacggtggaatcggcggcggcgagcacctgcaggagtggctccatgctcgcgggagttggagaagaaaaagtcgcggtccgcccccgggatgacggagtgctgctagaccccccgcgatattgggggctgctctcggccccccttccgcacggccagccctgaggacgccccagatgcagaggggaacggttgcccccgtcaccccccgccttgggccctcaggaagactcggcctcccgagtagcgctcctcgtgggtcgcgccctcgggatcgccctgggggggcgcctgtaacgtcccgccttcccccaggccaccccaggccgggtccacttacatctgatagctttcataggtcatagactgccctcacagaccaacacgccttcccccaggccaccccaggccgggtccacttacatctgatagctttcataggtcatagactgccctcacagaccaacacatgtcttttctgcacactttgtcctcactcgtgtgcacccggtaagaatttcccggtcggtcacccatcccaaattgctccaggccaagcacgcttaaccctggagttctttggagattggcttccggaaaagaagttgcaacttgttgatatgagtattctattaatcctattaagccctaggccgggatgttacaccctcaccaatgttacagcgccgccgctgccatcacccgcggctggttgcacctcggctgtggcgaactcggagccagacccgccgtgtggcccgtgggccccgccagggtgctgcgaaggctccgtggcaccgggtcggccgggtcccggtcgatccggtcgcttgaattttgacccctgtgagggatcggacgccgagaccccctaggaaggaatcccgctacaggagaaccccgatcacgttaagaagaaaaagaagggggaggagcaagaggccaaggtggatagagagcaccgagtcgggcgctagcgatcctacctgcgagggggcgtttgaaggtctacttcgggggctcgatgaaactcccccggcacggctccgtttgccctatcttccggagccgcttcttcttccgtccagcctcggacgtggcggggcgtttgtggcccgctggtggatggtccgccgttcgcttagcgcgccctatgcgcgggggagaacgcggccgagattcggacacctttcgcttccctttcgggtcgcaggcccctgaggcgatccgtcactgcgtcgtactcctcgccctgcgtcatactcctcgcccagttccaaaaccgccaaccacgcggcggatcgtttgggagggccggcggggagccgaagtcgcggatgatccggcagcgcggtgtaaaaccaatccgtcttccaatcctcccacttcttgcgaaggtggctctcaatgtactgccccgccgttcctggccggggctagaagtagcatcctcccaccaccacgccttgcagtagctgtgggacgaagaaggacaggaacagccgcatcgtctgcgcaccccgacgaacatctcgcagaagtgcgcgaagatggccagcgtcatcacagcgttgggtgcgagatgctaggcatgaatttcgtagaaatccaaaacctcatggaagaacctggaaaatggcgggatcagccccaccatggcgaaggacaggaggtgcacggatcgctctgggtactgcggccgcggccgcgactcctccaccctcacgacggcgtcctctggcatgatcttgcggatgaggctaaggtgcctctctgccatgatgagcgacgccgggggcacagcgtcaccagcgtcttgggccatggtgaccggcggggaaacggcgaggagtttggtgtacggaatagcgtggagtgagagaagcgttagggcttgaggagcgagtatgcgggtgagcagtcggcgagaggaaggagacgaactctccacctccctatccttttatccccgcctcgcccgcgctcgcctccttgtttcacgcccccgcggttgccccctcgattcctgcacctgcggtttcctcctcgactctcgcacccactcatcacgccgccccactgaacccgcgccccgcgtttggtgcacctgtcagcggcacattcggcgcgggccatgcgatgttcacgggcatggttaggcgggcccgctgtcggtcccgtcgcgtgcctggcaggcgggggagtcgaggcggcgtgggtgatgattctgggcgtggtctggccgaccccccgattttcgcgccctaagcgcctccatcatcggcgcagttagtggcggtcaaatcgccgttatgggcacagttagtggcggtcaaatagccgttatgactaatgcgccagcctggccgcccggcggcaaccgtctggattcctcgtcgggcccacaactcggcacgggaagtcgtgaggcgccacgtcggactgccctcggggggccaatgtccgacgcggtgccgggggctactgtcggagatatgggcccgggggtaggcaaagtgaggggaagttaccttcccatccagtcacgtggctctacagcctggccctccccccgcgcctcgcgagtcgcagaagtagccagggggcctcggggtgccacgtcacgcccctcgggctctcgcgctgcctcccccgaggccctcgtgtcacgtcccaaaacgaccctaaaatatatcctctaaattatgcctagaataattaaaatccgtgtgaaagcctccaacaattaaaatgtgcaaagttaaaagtcaaataatgcttagaggatttttgtatatttcctaaaagcctaaaatacgtaaataaattttagtggaattttcagagcacaaataataattgttaagaaataaacaaagttaaaaaggttttataaaaagaaaaaaccctaaaaagtcccccttccctcccttgggccgacccggcccatctctcccccctctctctctcctctccccgcggcccatccggcctctccccgcgcgcgcgccgctgacgggcgcgcccgcccgccaccctcgctgacaggtggggcccacccgtcatccccttcctcccgccgcctcccccgcgccctagcgccgccgccgccgcgaatcccgccgcctcccgccgtccccgcgtgcaataaagtggggggaattactccccgtgatcccctctccctttccccccatttttccctctctctctcgcgttcaaacgggcggatttgcccccgcaaatctcgccggcgccattgatgacggccggacctcccgcgccggtttccttcccctccggccgctctctcccccttccaaccctatttaaaccctccccgcacctcctccgtccgttttcgcctctcgccgccgtcgccgccgagctctggtccgccgccgtcgtcgccccggaccgcctcccacctcggcgccgcctccttcgccttcgccacatcctcgccgacctcgtccacctctctgtttcggtcgccgaccgccgaaacaccgtcgaccccgtcgacccgagccgtgccgccgcctccctcctctctgaccgccccctccgtcgccgccgtcgccccggggtaagccgtggaccgtcgcctcctttcccccttccctcccctctctcgatcgccgctccgccgcgccggtggttgccggcggcgaccatcggggcgcgggcgcgccgcctcccaccgaccacgccggcgtggccgccctcgtgcgcgccgagtggctgccgcgtggggcccggccgtcagccgcccacgccctcgggtgcggctgacgtgtggggcccacggcgccggtcggtgcgagccgggtgcgcccggtccaccgtggaccgtgaggctgccgcatgggccccactcccgtggacccggtccgcgcgcccctctccctcggctgacgcaataaaccctttttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgttcctgctggttatatggagtttattagagtaaaagccttttcttttccgttggtcgtgtagacgctgcagcttcggaagatccgctcttcgtggaggttgaagccgacgtttgggaaagcgagcaaggaaagtcacatcattcttgagcatattgaatcccagtttataaaattattttgatttaaattattgcatgatcgctttacttaaattcccgcgttatcactgttttatttagccatgcctatttacctttgttatgaccttattattattgttattgatattattaccttgttcaccctagattaaacaaaaccccaactagtggacactctactcatggtaccactagtatgattttaggtagatgcttcgctggttaattaggcaacattaggtggttttacaactctagactttgggaatattctcatcacctggacaccatggaatggatggattattgtggaattggattcacaccttcccctctattcaaaaccctcaaaatggttttaggctgggctcggggtgcatggttttgatagtagcacctcggccatataaggaccggtcttcgggcctctgttgcaaagcactaccatacttccacatgtctagtgggtaaggcttagtttgtggctcagtctggttataaacaaaagtacacggatggagatggacgaagtcggggtcgatggacatctctaggacaaatgaaggctacacgagctgcggcccggtagtcgagatgtcatggcacagggccggtgtcctgctgctaggggctcaatcctgcctacctgtcccgggggttccggccgtaggtggggttgggtcggtactcttgtctatggctaggatgggttggaaactatgtcacgtcttccgtccgtataccgtggtggtatgtggcacatggttacatgtgaggaagatgtgtcttgtgggtaaagatgtacacctctgatcagagtataatctattcgaatagccgcgccatcggttatgggcaagccgagcaatgtacccaagttagtgtttttaattcttaaaacctgcttaacaactaaaatgtggaatggttggcctgggttagcttgggacgagctgggacccagggtcgggttgccagttcgatctgaatcatcgtaggccttgggttaaggcaggttcatgtgggttcacggccttgattaataatattatttagctctagaatcgtgtttacaaaatagctttgagcaactaagtgtcttttaatgctgtttactgcaaaccctaaccctttatattttaacccccttgtactcccttgcatttattctacacttgtgggtgtgtcttgttgagtacggtggttgtactcagtcttgctcaattttgcccaaacccagaagaggagcccctggaagatgaaggctttggtgtctagctcgtgcctgccgtcaagcgcctgtggtcgtcgtcctagtcttccgctgtttttcgttatcttcttgtgtgctgggtcttcgccgcccatgtaataaattaattaattacgcttccgcttgttaaactctgaattgtatcaacttttggtgtaccttgcctcctgggacaaggaataatgcacgcacgtaaggaacgcccgttgggttatttccggtcgtgacacctcgcccaaccgccatgtggcgggggagcgaccgggaagaagaccaagccgaaccgccatcaatgcgcgcggcgcccgaattgtccctcaccgcgtttaatgcggtaagggcagacgtgcggtgccgcccgactgacccacgtcaatcgggtgtgaccagtctgtgaccggcctgttgccggtcacgtccaattggacgggcaggcgtgcccccacgttgcctctgtatccggcagagtggaggtaggtatgtcccgtcccattggagcgttatccggagttccctccacgtgaggaggaccgctacaagtcttcactcatttaagagggaatgacagggctgtcccccgtgtcaggcggggggcggcgccgggtcccactcaaggacggactgcttgtttagattccgggcgaaggcacggatcgtggtccggtcaaagtaaagtgggtccctctcccgtgaaagagtaggtagaagcggcgcatgtggtatccccttgaactataaaaggaggaccttgcccgccgaaaaaggagaacgacactgagtaggcctgaactctaggaagcgaagagcaagagcgctctccggagtttaggaacccttgtaacattcaaccactaatcccacacacaggagtagggtattacgcttcatagcggcccgaacctatataatcttgttgcccatacgcgatttagaaaccctgagggcggatacacgatctcgagaggcgaaccctttcccccggccgaactcacaaaagggggatctcacgatctcccgctagagaggatcactcctcgacaattggacttacgaagaaattaacgctgaccaaacttattaagattgaattatatttttatcctatgaactgaagcaaattttcttaggtaatcatatagattgattacctgcctaagatctttaggtacctgaatgctatcagatgaggttcactccacctgaaccaatctatatacaattagccaaaattcagtattcagagtaggtttcacacttctggaatatttgcattaaatatttgacttacctaaattatttatgattagcaaaacttattctgagccgcttaaacatcaaatgttcaactgatgttattgttgctttatcttgattcaaattgttctatctaatgccttgtgccctttgactaaattgctctggtctttaccatttgttgatccatccaagcatgtcattagactgcgaaatagaacagtcaacctcttgattgaacaagtattatatttttctctctgatgggatgtatttaccaagttgatgataccaattttccagtagtcatttacgattttttttggctcatttgattattatttttcgatgctatatcacagaaagcactgtggaaaatacaagttctgaacatgctgacaaagcttcacctgctgatctgttgtgcatatggtattcctaccccactaataagaatcggtaaattcaatcatatcacagcataataggtgttaaaaagttaattggaagtctttctaactgcaatctggatgcttttgttactatagtctatttatatttgtcaactgatgctctactatcggtgcttcagagtataaggtgggagtgctgatataatgataagctgaaattgattgtatattgtatgttgcagactatatatcaagaaaatagtatggacatatggttaacctgccccaatttacttgccaaatttataatttgttcagcccaatcaatattttgtaagctagcctatgccatatcatggcttatagagaaggttcttaaaccggcatcaaagtcgtgcaaagcacgactgtatgtggctagttatatatggggtagattagattttgcacctataaatgtccggtgcttcttatgacgtcagaacacgcaaacgtccatgcgagacatttaaaaaaggaggtaaaacaagtatttttcgctttgttgtttgttctctcaaaaaaaaaatcttcgttgttttgcctttattctttttatccaccgacacccccaaacacctcccggagcatccggcggagcgctgggccctcaaggtcgggcacaagttagcagcagcatggtaaacaagcccttgtgagctggcgcgaaacatgcgggatatggagcctttcataacgccaagcacaagcacgccctccacatgtgcctgcccgtacatctcattctgctgttttaagcccaagtgtcatctcgattttagtattgctggccgctgctctgctcctggatccgatcgcattttgcatcgtgctcatgttttcgtcaatagcaaggaattgctgcttgtgtctgggctaggaggttactaggagatagtagatgggaaaggcaccaccattgcatgtgcggcaagtgattgtctctcaagtcttaattgagggagttttttttttttttctttagagcgcaattgagtgaggcatgctgttacagcatggattaccccaaccattgatgacgatagcatattccctatattaaaaaaaaactactagtaacatattccctatattagaaaacaaccaacttccggttatgaatgtgaaaataaactttgttcagatttacgattcatagtttaaagttcattttttagggacgaagcgggtacttgcgtgtctacatgtagaacaaaatagatgggcgaaaataaactgacaaaaaaataatgtggtacaggtacatcagacctaagattaattcccgaatgccaaactatactgatttcttggggttttttattttttgaactttttaattttaaaataatccatcctaaaacttatttcaaatttaaaacttttgcccgcatcacccagtttaacatgacaaaacaatactgtcactctacctcacagcaggtgtgccattgttactaatagttggcgtggccaaaaagattatttagaaataagttttgaagtgtttgtgtttaaaaataaaaatttaaaacgtttaagaaacagtaaaaatttgatttcttgctcctgctatcctactgcgacttattttgccacctactcctacctatatagttttatttactttatacaatgtatttagaaggaccaaaaatatgtcttctaatgtgcaggttcaagaggttggtcagcttagcttctaccataccacctgacacctaattacaccaaccttaccccttccagcttgcgcacgtactactcattagaggaggtacaaacatattttaagaagataaatgaggagagagaaaagcagcgagctatagatttatagccagctgtagcacgaactccaagacctagtgtgtatgataggtgggaccaagtattaatagtgtaatatataactattatattaataagctattagattggctatatataaattggaggtagtagttggctatactattaaacttgctcttagaagtggagaatcataatgaatcacacagcacaaaaaaatgatggtctctacttactcatttccaatttcttcagctatccttgctgtcaggcctggaacattcattatactttcctcaaatcatgctgtcggtagcagcttatcgatcactaatgttcatgtggatgatatttttgatagttaatacagcaatgcagaagccagatggacaaaaatttacaagtaaaaaataaattattttctatttccaatcgagaaatatgatctagatgacacatcatggatatctgagtttaaatccatgtggcagcataattttctacacattagacaaataaattaattcctgccttgctcatgtaatcagaagatggccaacaaattttactaaataaagaacggtgaaaccaaaaatttgtggacaaaaacagtgccccagcttgcaatatattagtggtttctattgattcaattgatcaagaacctccaagagtacaggcttgaatcggttgcaatcaagcttgacgttttgcttatccatgaaggtctgcctgatgaattcaaatccatgtttgtggaacgaaagaggatttgtgaagatctcatgatctaggggatattgatcagtaaggctgctttcatgtacaccaatgctatactgcttgtaacgcaggcccatttgttccgctgggttgccgaaatcaattcttgatatccagtctagtccaccccatggcacaatctgaatcaatgtagcgttttgtggcaagaacacacagttggtgagtccagcaccatggacacccatcatcacatcaacagagttgacaaccttgccaaaatgggagagatcagagctcacattggcctcttcaaccaccacctcgtaacctatctcctcagccatcgccactatctcgttaagattgagaaacattcttgtcctctgcctggatataatgagcagtcttggcttggctttgggaatctcaccaagcgcagttacaaaatccctaggcagtgagtaggtcctgcgcatgaacctattaaaatccaccattgagtagttatgtggagcttttgatgagtcaattgtgaactccatgtaagcatgaaggccaacaattgcatgcttgaagcaatgcacttgatcgtcattgttgaagtcaatcaaggggtacttggatagcttatcaaacaccaccttatacttccttgtccaccaaatagccatgtctgtgattaggaattgaacttcgccattgaattcgcttgcggttgtgaaaagagggacaagcacgtcggtgaagtcatggaatagatttccagtgtatccagtcagagcaaagaccactgcaggcacattgtgatacttgctacactcaggtgccactttgcttgatttcacggttatctctgtaatatggccgaggcagagctcgtcacctttacgagggtaaggcttaactttccatatctcctctctctttgaactggcaggttccatgtacatgacagaacttgcattgggatgaatcctaatgttgccccgcatctcacagacatttgctctgaagtttgagaaatcacatagtggtttcttgttccactcctcattatcagtttctgcaatagagtatcatcaatgaaagagcagaaacaaaagactgaatgaagcataatcagtctaatttaaggttcaatctagtagttaggaatctgaagtgtatgatgccattggtctaggataccaaaatagggttttgcatctatggccaaaatcactaaattcagatggtccattttcctgtcggcatttattgaaatctaaaatcctaacctggttccacattgtctcccttgtccgcgtccatctcaaattcatatttttcattcggtttgccatctgcagacaaagtagggccatcatacccaccaagaacttgtaagcaccagcttaacaagtaccaaaacagctagtactacaagtaaagtccaagaaacacaagaagaaacagcatctactaccttcttgcttgccattgtcagtgtcttcagcatcacggatggtataattggaaacagtcgggagggtcaccttgctatgctgtgtgtgcccctcttcctcgccgttcttattatcctcttcgcctccaccacctgcacatcccaccaccaaagtactcatacataaagcaagcatcaattgatggcgcccaaatctctcttgacctctcaagaccccgtgaatcaaagcatccagagacagagctagacaaggaaattattgacggattggaaggtgacggctcacctaacacctcagatgcagtggccgcctcctcgttcttgccttgctcgggctcactactgagtagcctcttctcctcctcactagtccctatcatcatatataacgaaaaggtcagtacgctaggcccaagatttgctgactgcagcaaggcggcaattagctctggagcttttcacctttggcggtggcgtcctcggcgccttcgtcttcgtccaccaccttgggatcctcggcggcggggaaggtatcggcggatctcctggagtcggcgtggatccgctggcggatcaggagcgagcgcggcgcatgatccaccgacagccggccgttcactgcgaactcaaagaaacgagtgaggcgcttggtgttaccatcgatccaaggatccaagaagaaaaagaagaagaagatgatgaagaagcggcgacggcatggcgtacggttgaagaggagggcgtcgggcttggagatgacgacgaaggtgagtgtgacgaggaagaagccgatgacgaggacgagcaggcgcagccgccgcgactcctgccggaggctccgcaccagcttggcgcgctcgacgggcttcatctccccctcctaaatctcctcgctcttcttgccggccgctccactcgaccgacctcgcgcccgccgctgactttctcctatcccgcgaggagagaccggccgagagaggcggaatggggtttgggatcagcgtggttgcgagaataagagggatagcaatctgcaatcctgggctggctggatatgtgcgtgctagcttccttcctttccttgcctctttcgtcagctttccagtattcctcttcctctgcgctctcctcccagtcccagcactagcggtctctcagtatgtgtttggcactttgggttaaaacagtgatgatgggaggtggggttttattcttgcatagtttacccgttccaaacaaacggcggcttaggctcagttttacataacttttttccaactcacctcttgcatttttagcgcacacttcccaagctatttttctaaaataaattcctataaaaaattgcttaaaaattatattaatatatttttaagttttgttagctaatacttaatttatcacatgttaatccatccgtatataggggagctccaaaataatagccttaatcagtgtgaacactctcgttgcaggagaccggaaagcagctgagaggacatccattgataaggcaagacattactacaggagtatcatgatatcatgtatgataaagtcataggtctcaaatcagtttttttcatagtgttcagtagttctaaagctgtttcagtttttgcatgtcaacccatattatttcctattttagtcctcatattttacatcaaacatcccgaaaattagaaaaagaaatataaatacaccctcccatcctcgtccggtcatccccgtcacgctttctccaaatgtcggcacgtagctctctctctccccctccgccgctctcctcctaccaccagcacaactctccctttcctcctccgccgttctcctcccaccgttggtgcaaccctccctcttcccttccaccgctctccctccaccttcctcgtcggaatgctagcgccgcctcatccttgccagatctagcccgtggttcgtcgagtctggcctcggacggcggcgatggctgcgactccactccactaagctcgccagatccaacctggggctcgccggatctggccttgggaggcagcgacgacggctcgacgacatcggtgcagcaacttgactacggcggcagaggcaatgggacctcccttcacccgcttcctctacctcgccgaattcggctgaatctcgacagtgaaggcgaggatgttataaaactggcctgaaatcaccatcaacaaccaaacgcggaagaaacgccataggagatccaaacacgatgatgacacgaggcacgatatttgttaacgaggttcagctgaagcctacatacccgggacactgattgtgggtgctcatctgcgatccagcatactacaatgtatcagagttacaatgactcacgcccggacgtcgccggcagccacaccatctcgctgtgctaagtcaccatatgcggttacaacaggttcgtccctctatttaagagagatcctatgataaagtccgactctcactctatttctaatacctattacaactccaattcctaaactgtaatcgacattgtacacatattcaacataaactctaacaaactccacgttgccctccatgctgcttgcctgaccccaaccccgatgcaccccatctccgggagccacatcgtagtgcctggtaacacctctaaccgccaagagctcgaaatctctgctacgactcctgaagaaatcctactcgatctcctccctagccgcacgccaacgagtgtcaacgtggaaaacacgcgctggcctgagagacttgctttactctagtgtaggtccaaagagatcgctttcgggttcagggtgtgccagttggtttgatcctgcaaccaacaagaaacaaagaaaacaaccaacaagaaacaaagaaaacaaagttaaatccgtaaacgataaccgatcggctgggttgccgatggcgtgtcgtttataccgggctgatgcgatacagatcataccggccatgtagtatatggagaagggataattggacgtgctctgtcggctgtagatgtcaataatatataatctatgctttgaagtactcttgaaccaagtgattaggatagatcggtcagcgcgccgagatagtataaaccacttgagtccatgaacactttaaggcagggattatatacgctcacagcatagctgacaggcaaacccaacgtgtatcggctagtaatccgataccactttataccaagatttcggtatagatcaaatatgctaaacaggaatcaatctagtgtcagggtaacctgacagactgatggcaagcttagtatatttggtccaaacgagatcttaaagtaaagggcaggcttagcatatcaagtaaacatatatgaaacgagataactaagtcaggtaagaccggctaaaaccccgatgctatctctattaacaaccatagaacatgctacttaacagatcaaactaaactgatgcaacattaagcacatggagaaacataggatctaaacaagtctaagaaagccttttcgagatggtagatatgctatataatctaatccgacacagctatctagccctatcggctattttcgatgatagagactagccgacacggtaatatagcaagatcgatctagattatatagcatatatgataactcagcggtttgtatagacagggctagagtgtcatgaagatataagcactagccccgagaacgcaagccgccgtaacaagctttacctcttcatcgaagatcaaaaccgatgcagcccaactcgaaagcaagaactcgttgaaaacaaagaaaaggaaaaaagggtggcgatgcgccgagagtgtattgaacttgatgttgtttgtttacatggtctcgggtcatatttatacccaaaatacatgatatgtctttgccagacacgactctatctctattacaactcaaaaatatgaacaagtcccttaggtggactcttaccgaaaatatctataaggaaactatgaaaatatcctaattaatagatacaattgtcttctccgagctccatccacatttggcaatacttgtgtagcacctcaacagatcctgacaacgatcccatgattgtcttgccgggattggctacattggcttctccctatcaggttcagtaccagccgatgcagacgacagccgatgcaacccatagctgatgcgggttctgtttccatgattattgatttcctccaaatccgcctcggttctgacttcggatccaatatacgatttaccaattttagccgttaacacatgctccccaagtccgcgatatttgggatgttgcggatttgatcgatcctgtttccactggtatctagggttcattttccatttcggccattaccgcacccttttaaaatagtgatcaccatcctcggatcccacttacaccgtatcgcttccgtttttaccactttcgctcattattccccacgcagcctctactgtagcaatccctaatctcttggcgatctttccagcgatcgcccctcaatcggcaaactcctccgctccgtcaactttgttcggacctatggcgatagtgcacgtggctgagatccccgaggtaagctccttgttactttttagcaattccctcagtcatctttggctctttggtgatccgattccttcttcccttctgccagcattctagggatcatcttttgattcccacctcccagaactccacatgctttttccttgggccgatgggtgatccggatcccaccgagtttatcaatgtgaaacagagaggatccctttcaagtagatcaaactagacttagctcaatggaaatcgactttcaggtcttggctgtctaggttgaaagggtacaagtcatggtacaagaggatggtggctgctaagcgatctcattgggaggaagtaggaatagcgcaatgcctggctttatctatagcaaacctgaaaaaggatgagcccctactttctgctatcggctacttctggtctgatacactgaatgctttcatcttgaggcagggacctatggctcccactttgcttgatgtgaagatgttaataggcctagacatcctttcatccattaatccttttgacgtggacattaaatgctcttatcaactgaacacgaagaagaagaacaatggctggtgaggcttcatcgtcgaccatcggaaaactggtccaatttcggatgaggaacatgctgccttcctctccctatggctcgagaggtttgctttctgtgggtctacttgagcactgactgcgaacttccttcattttgctgaagccctggtgagaaaggaaaaagttcctcttggccgatacctcctaggggcagcttattggatgttacatgtttccttagccaatattcttatagacaagccggtcagttacgggggcccttggtggttggttcattcagctgtggttgacaattcacaccaacaccgtggccaacagaccttctctgcttgaatcggccttccccacatatgactccattgatgatcaatcagattcccagccgtgcaagtcttatggggaagcagctttagtttaccctggtgtcaagccatctattgaaggctttaagacatggttcgacatattttacaacaacgatgctgccgatgttctctttgcctatgacgcctacaccgagtttgatcttccaatggatttagatctgagcaagctaaatgatgaagaagacctgttattgaggggcaattacttggcagcaatctctccttgcgttcttcctacagatgtgtctcagggaagaaaatctttctcttatgagttttatcacccaacatcggctgcaagacaactggggcttggccagcttcccatcaatcttcccttactaaaagttgtagactcaagatgtgaagtatcatcagtcgataccatgaagaaattgttagaatgcaaattcccagtctcagccgatatcggcgacttcaccctttatcagtttaagcatgtcaccttctacagttgatagtcggattggtcaaaacatctcttctctgctccatccgactattgtcttaccaagattgataaccgcatcaaggtaggccgcaatttacttctaactagattatgcccccctccccacgacctaacttgttttgctcccttttttctctctgcagatcttaaaaccactggcaccgaaacacagcctgagtgatcggccaatttgctatgcccaggttctcaagcattccagagggactaccaagatattgccctccccgatcatttcttctgctccgtcaattgaaacattcatgaagactcctactggggttttggctaccgatcgcctagattttggcaaacacaaggatccctcttcaggaattaccgggtcatcacccaagagggccaaggctgatggttttgctgggataagtgccgaagcgttagttgacaatattccgccttctctctcgttgtctccaccaaccagagttcattacgccattcgcaaggttgcattgcatattcgcaaaaaaacgtttatctccctcatggcctttttgtaatccgtctctttcccttttgtaggtgaaagcgtcatcgttgatagacctatcggcctcagcagcgcaagagctgtccccatcggctcgagctgctccgtctgtcgaagccgttaccgaggaaattgcgtctacttcctctaaggctaaggctaagctgcttccccacttctaagcttgatcatcggctaatctttatccgtgcctaatccatcccttcctacaggacctgtccaacatgttttcctttgacgtcaaataatttttgaatgaagatgaaggaaatagccccggggcaggatgaagttagggccctatcagtggagatcgccgatccgcttaatgcctcttaggacacccttgtaaccaactgtgggccaatcaaacaagcgggctttaggggggaaagcagtttcattcttctctctcaccctcttcccctcaatcccaaaggggtggccagagttgagatcaatgatcgactgtcagggcttggttttgggcggtttcggttgtaacttcctttgttggtctagtagtagccagtcatatttagcggtgaccgtagaggtggcaatttccccattagggccgggatttggggaaaattctcatgcgtgggtgagcggggtgagggcagggatgggagttgaccgcgggtgacccatggggccctgaaggtattagttataagttaaaagacccatttgacccattaagtgaaggactatataagcgaaaccttaatttttcccaaatccatacctagccgccctctctcctgtctgagtcccacgtctctccaacctagcaccccccagccaacctacctctttgtgcgctatccccagctgtcaccaccccgagccggcgctgctagacggtggtgcatctttgctgccatgcccagctggcgtctcgttttcgccgccgccctcaagcgatgccgcctcactgcagcgcgtcgcccccaaccgccaccgcttcctcacagtccaccgcccctagctggtctcgcctcctcacagcgcgctagccctacccgatgtagcctcttcgttgccacccctggacggtgctgcctcatcaccaccgtcctcagccgtagacaccttgtcgccgcccccaaccgtcaccacgttgcggtgcgccgcctcttgctgccacaataggtgccctgcagttgctatccattcgggtagtggaggaccccgctcacccgttgggtcctctgtgggggtgagggcaagtgaggttttccacccggtggccaatgcggggccgtggacagggaaaaagggaaaaagcaaggagcggtggctggccgggggcattcttgtccaacccaaccccgccccgctgccacccctatgtggtggatttggtgctggcctcttcttggctctgtgtaggtggtgttgttgtgtggtggtggtgccacccctatatgaccgattcggtgctagccttttttttcttggctttgtgtaagtgttgttgttgtgtggcggtggtttttttttctggctattgactttcggggttttagcgttgtagtttttttctgttatattaaataaattatcgcgttgtctggtgctgatggttcagaaggaatcattaaaattgtagtggtcgtgtgacagtataaaataaataagctataccactgcattggcgtaattttattgttgggttggggggttgaggacactgtatttgcgtcaaagctgagctacttcctccgtttcataatgtaggtcattttagtattttctacattcattaacatcaatataaaatgtgagaaatgttagaatgatttgtgaaacggagggagtagatgttaccgacgcaaaggtttgccggaagagacggttgccagcgctacaagaaattaatcggagatgaaacagacaaaaatgtcagcgtgtgttttgtcggtgtgttccgatctgggcaacgggcctacacggtcccatgtttgacgggaggaggatgatagaaaaaggcactgcatgcaaacctgattttgtttgactcttttcttggcttttgctctctttgtttacgtatacgttgcttcacaaatcaagtaggcagactggtcatatttcagttctcatcacaggatcgtttggtaatataaatatatataaataaataaataaataaatatatatatatatatatatatatatatatatatatatatatatatatatatatatatacgtcctgcctaactttagtagatctgtaatacataaatgtaatttgttaggctggttatttagctgatgatcaatgtggcatggactcatgtctaagatcgaagtcacaatgctgatgttagggcatgtacaatggtctttattagcggttactttttattgtcatgcaagaatatttggtgacgtgaaagagagaaaaagaaagaaagagaaatatggttgctacgcatgacaacagcatagagttgactcttagcatttattaggaaattttttgttgcattgagtctagtaaaggaaagatgactagtaagaaagtggagtattttggtatattaatggttagagaccgtattgtcttaactattataacgtgatagcctttaattaatgtagaaaccataccgatctctacctttgtacttgcacttactagctggcgaacagcgcggaagaaggaaggaaagttgctttgcctcctagccaagatggaaaaggttggcacatgggaacatcgggacagcgtgaaccgggcggtgcggcggtggttgggtcctctgtcgatcgaggtggtgctgttctcatcatgcgttcttgcatgcatccaagggattagcaggattaggcctgtgggataactaattaacatttctccgtgaattaaatttgcaccctcgatttcgtctctcggggcagacgattgaggagccgtatagccggtccatatgcgttgcaatgtcacctcaggtaatgtttgtccgcgtcgaacttcgctggtgtggacgtgtggtgccatgcggctgaactcgttcaattcggttgcactttagagttggaacaggtagattggatgtttctcaaatctcaacgttgtcccaatgccacaggtgcaagcacagtattacctctatcccattaatctagtacgggatatatataacatataactagtactagattaacttattttaggcagaattagtatgtaaggaatgtattttcattccctgattggcaatcaacggctcaccttatttcttatatattatgtaaataattataaaaatgttaaaaaataaaacggtactactccatgaaaatgcaaattcaaatttgactctataaattataaaagataataaatataagcatgaatgcacatgctagtttgagtataatttgtttttttaattaacttatagaaggtgaatttgactttgcatattctttttaagttactcgtcattttagctttgttttagtcaaacatttttaacttggaccctcaatttcttaaattttatatattttcacatcataatatttgtgtttttaaattcaccatgagaaaaactttcataatatgtaattcacatgtaattaaactatatgtataaagttaataatgtttgagttcaaacaaaactaaaacgataaagtaatttgaaacggatgatgtacactctttgtcactacataactactgtagcatcgatggcaaagggcaccctttcctttcctttctttctttctctttttttcttcctttctataaaggaaaaagtacgaattacccttcgaactatgacgatagtatgaattacccctctgaaccataaaaccggacattttataccctgaactatctataccggacgaataaccccctcgacccaatccaaagcggtattgtcctacgtggcaatgtagtcagcattttttttaaaaatggtggggcccacctttcatactctcccacctctctctctcttcctctcaatctctctgtctcatatgtggagccgcgagttggtggccggcgatgggcgtggcgggggcgcagtgggcgtggtggagagtcgggcggcgtccggcggccggcggccagaaagccactgcgggcggcgggcgccatcgccctcgctcaccactgggagcagctccagctccacgcgccgtcgtgctccagctctacgcgtgccacgggcaccatgggcacggcggggcgcgaggcagcgttggcagcgtcgtcgtccacctccttgcgtggtcgagctccagctccatgcgcgccctcgcggacaccgtctcgaccacctccagcgcgctctccagctccgccacgtcgcccagccgcgcccgccgccgccgctgcagccgcctccgattctcagtccacattatgaagaaagtctgttcactactagaattacattatccattaacttcttcagaatacgaaacacaggtgatttgaagaagtaaatcagtgcaaatctgaagccaataaaatggaaaaacattcagcaaacagtgcaacttttggattcaaatgtgcttttgtttgcacctccactattctactgttctacagcgtttttggctccttgcagggtgaagctgtgtatcagctgcgtcaggctttcatacgaggagcctcctttctccatggctctgcaagctttctccccgtactccttcgccttcctcctcctctcgccgccgtccatcagttgtatcaccacccacgcgacgtcaccccgggtgaccgccatggcctcgtcgccgaacaacagcacaggcgtcatcacgccgacgccgagcacgtcgacggcgaaccgctcgttcaggaactggtcggagaagtgtggccacgtcacgaccagcacgccatgggcgatggactccagcatcgagttccagctgcagtgggtgacgaagcctagccgcgcccgcctccgctcgcctagccacgcccgcagccgcctccactcgcttgagtgagagagagaggaggaagaggagaaataggaggggagagagtaagtgggccccaccattaaaaaaatgctaactagagtgccacgcatacgccgccacgtaggataaaactgccatgtattgagttgagggggggtaattcgtccggtattgaaagtttaggtgagcgatgtctggttttcaggtttagggataattcggtcgaccgcgataatttgaagggtaattcgtactttttccaactttaaaggtggggaagtgcactcaatgttgaacgctcccatggcaattacagaacactagtggttgggctattttattttcaggggcagaaccagacctgattgggctatagcccagaggactataatttctatagtacatggtttatccagcacagcagacttgagctgtttcctggcccatagtaggccgtagctcaagttccccgcgaccagcgtatatgttaggcccaagggcaaggagtcatctactccttctatttcaggatataaaacgttttgactttattcaaggtcaagctattctaagtttgactaattttatagaaaaaaatagtaatatttttaaccaagattattatattataaaaatttattcaattatagatttaatgaaactatgctggtgttgtgaatattaatatttttttctatagagttagtcaaacatagagtagtttgactttggcgaaagtcaaaacgtcttgtaacctgaaacggagagagtagacaaaaggaccctgtcaagccgcaggtaccagataagacaaccgcagcacaagactaaggccctgtttgttgcaagtaaggattattgatttagattacttaaactggattataataagctatagtagaataagctattagttgtttttttctctcgattattagagtatggattattcggtttgaaaagctaatgtttataatggcccagttattgtagaatgggaggaggataagacggcggtggcggcttggggaaggatccggggtatagggtgtgggcttggggaagggtttgcgtgcggctagggagagaggaagcgaatgcacgcgctgccgggggaggcgctggattcacgtacgacctgggagagaggaagcggatgcacgcgcgatcaggggaggcgccggattcacgcgcggctagggagtgaggaaggagatgcgctggatctgttgggtttgatggcagtggtaggtaatttacatacaatttataaaagtagtgggtctttagccacccaataatccttaaaaaacaagtttagaggatattaccagattatattattcttacttatagattataataatatatcataataatctgtctgtttgtttcagattagtaattaaccaaattaaaataattctaagctaaaacaaacatgacctaaatcatctcactagttgcaacaaggtaataaataacgggaaatgaaaatcgagagcgctcccggttttgtgttatcatacgacgtgttcgacagccatccatccatgtcttcgttctatgggagcaacaggcttgactctacagcaatggcattaaagcgagaaacctgcacaccaccaaccatcaaaactaaagattttggtttcactggcctattctttttttaagcaatagaattgatgacttatatattttaaaccactagaaaaaatacccgtgcgttacaacgggtgaagtttattttaatcttattatttttatatggtttagttaagatgaaattcatcgtgggaggtcgcttggatatatatatttttagaaaatcatgagatgcagttaggagtccgatcatcttaagttagcatgcgagcttttttaaataaatttcttatatggttccttctgtattaccaaatgtgaacgatcttaaaaccgactcaaatatggatatgcattttcaaaagtaaacgaacttaaaaaccgactcatacacagataacgtaccaaaataccggtaaaaatattttcaatttttataatagtagagatacgaaatttattgtgagaattcgcttggatatatatttttttgaaaaatcatttaggaatccgatcatctcaagttagcaggcgagtttttttaaaagagatttcttatacgactcatgtatttttaaaagcagacgaacttaaaacctatctcaaatacggatatgtatttccaaaagcaaacgaacttaaaaactgaatcatacactgatgacgtaccaaaataccagcaaaaacatctttaatttttataatagtagagatatattatttctcactttcctttttaccatcaagctgtactcaaaatacacgataaaacgagtccaatattgaatatattcaaacatttaaagtaattaacttaatctaaaagtaatttgcttaaatcgtagaagtaacttagctctgcaatagaagtaactacctatgtagcattggaagtagttatcctatgtagcattggaagtagttatcctgaccaatcagttgatgatgactgagatacgaaaacgtggatattgtacttaccaagatacagagaaacgataccacttgcccttgcccaggaaaagaggaccacatgatttgctagttgtcatctcgattcatgtgcatgttactgaggctaacaacactagtatattttcttttctatagaatctttgatgacctatatattttagacgtatattatttttaagatccatttgaaccgtcagactctacttaaaatatgtgacaaaatgagtcaaatattgaatatattcaaattatattttttctcaactcctccagaagtgtagttacttatagaagtgtagttactactaatgccgtgacgagttaattctccttagctgtacagtcacttctaatacctttaagagttatttctatttttttcatagttacttgtctataggattttatttacttctaatattacgaagagttacttatatttctttaaaagttactttgctccagtaatggagttacttttaatatcgcaaagagttactttctatatgacgcaatattttatttaaaaaacatagtgattactttaaataaagaatatatgtatttacttgaaaatcttctctacactttgcttttcctgtcgatttactccacatagctttcttatttcaattcactcataatgtaactacttctaatgctataaagagttacatctattgcatagctacttttgcaatttaaataaattacttttagattaataaaaattttaaatatattcaacaatgaattcgtttcatcacatattttgagcggagtacaatggtgcaaaaagatcttaaaaataatatacggtttaaaagatataagtcatcgaagaggtttaaaagaaagatacgctagtgaccaatctatataaatggttgttgccatttttagatggtaaaggaggatttatatgtcacatgggataaactggtcgctggtttggataaaccagcgaccgtgcattgtgtagtcatgtccaataaataagtaaattatccttataccttgaaagctcacacaatatctctcatacctttaaaatttacccgattccttctatactcatgaaatttcaacttatccattccatactccatccatcagttaactgtctaatttgtataaaaatgaccattctacccttacacttgggtgaacaaagaaatttatgaattacattattgaaaatataaaattttttcgcatgagactattatatttatgatttcctgtgcaacacattattttaatttattgcatttggtttatttaaaaaaattatgttaaatttttttattaattatttaatcttattagtttcataaaatgcacatactgtgcacccaaagaattttttttagttttccaagcctatattgaaatttacatcatcaagggcattaaagacatttgtaatcaaatagtgaaatgaaggaaaatgtaacggcaggggcatggaatggatcaaattgaaatttcgggggtatagaagggatcggttaaatttcacgggtatgagacggattgagtgagttttcaaggatatagaaggaatttacttggggtgattatacctgttagtaccagattctaaaaatttgtgcaccaaatgtttttttaagatgattagtaaatagtaagatgaagaaaaaatcgatatactaggtgcaatagtacctaagagtcccgaatgataaccagattcagtattcttcaatgaaacattctatgattgtgattgattgtggttatggtacaaagatactggatatttgcttgaaatacaaggatgagtcttcttacgagatgagtatctggtaccgttcctataaaagtgccagtactaactgacctacatgttttatgattcaagttgtagaaaaccatacatattttcacacttgacacttaagtacatatatattttggtagtttagtttcacaaaaccacactatcgaataatggatttacccgtgtgatgacgtgattgttccatctaggatgatgacgtggcatatcctattaatttcgtgcgatggctgataataggatcacacgtcctcgtcctatgtgaaacagccacgtcatcccgcgggtgaatccattcattgatagtgtggttttgtgaaactacactaccaaaatatatgtacttaagtgctaagtgttaaagtgtatgtggttttctacaacttggatcataaaatgtgtagttttatgaaatttactcttttattaactgaacacttggtttttttcttcttaaagaaatcactcgcctcgagctagttgattttattcatcacgtaagtccttccacgagcgagttggctagttgtagttgttaacgtgcctttcctttcatcttgaatattaatactccctctgtcacttaatataagagattttgatattttgcttacattatttgaccactcgtcttattcaaaaaatttatgcaaatataaaaaacaaaaatttgtgcttaaagaactttagataataaagtaagttataaataaaataaataataattttaaattttttttgaataagacgaatggtcaaacagtgcaagcaaaatatcaaaatcccttatattaggggacggagggagtaaatatttggatgtaataaatagtgtttatagcatgtgctagagctgtaccaagtgatagagctgtaccgctacaagatagcagcctggatgtagacttaggctgtgtttaagaagaggagatagagaagattgggaagatacgcaaaacgaggtgagccattagcacatgattaattgactattaagtattttaaacttcaaaaatagattaatatgatttttttaaagcatcttttctatagaatttttttgcaaaaaatacaccgtttagtatttcgggaagcgtgcgcgcggaaaacgaagcaaaactcactaacaatcacccagatcacctaggaaagaacacagccttagcgactgctattttaacttagccggttgctatcgcatctgcagttcaatttagcaggctgttatagcatgagcctattttgttagttgattttctgccaaaacattatatgatgtaacatccaatgactagaacatcatgtctgcttttaatttaagttggaacaagacatcaactcttcgagtgctactaaatctcaacttatcttcataggttatacatatattgatctatcattaatttatttctcagttgctttgttaatattttataaagtcattactcataattagggctagacaaaaagctcgtgactcattagctcgctcatctcgtcactagcttggcatgactctgttaacagtgaaatttggtaagcccggactagtcattggcttagagccagcatcggctttgaagtcctgagattagccgatgagagttatcaagtcgtcagttgtcggattcttgctatattcggttaaggaaattgatctactaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13558 - DNA, 7311 bp, Oryza sativa
attcgaatagccgtgcccgcggttatgggcggtcaaccagattcaccgtgattagtctcaccctagtgtaatcttttgaatttggatagtttaggtggatggttgggcctgttgcaacgtgggataacgttggacagtggatagttaatactaattaaatattacaactgtttaatctttcaacttctgtttataaatgctcgctttatgcaaatgaaccactccagctcttctttgataattccctgcatcatacccctattccggtatgacttgctgagtacagtgggtagtactcagtcttgctctatttttttcccaaccccagagctcgagtatgtgtcagatgaaggtttctccgaggagtaggctttgtccgtgccgtcgaggatgcctgtggagtggtggtcccgctgcagttctagtcaaggcttagctcctgttgtctttcttttcttccgctgcatttgtgtaagacttttatgatgtttgtaagacgtggatctgaatgtcaacattgtcgtttgtgtaccccggccggtcctggacggggattttaatgcacattctgcttggaattctactcaggaatttctgggcgtgacaagttggtatcagagccgaacttgaccgtaggacaagccaaatggaaaaacctaagagccctccgaatccttttcattgcatatgttctttgcaattggatttgttccgggaaaattgggatctgttcttgtggttcaaggggaaaaatcttgatcgctcgtttaagtgagatttgtcaaaacgagtcagtctagggttttagtaaaactattgagatttattcgtcagtcagttgggatttgatgggtgaaatgcattaggtcctagctcaggaacatgggttgcaaggtatttatgttattagtgttattatagtatgtatgtaatttccccactattttatcgttatgtgagtctgtcttctttattcgctctcatgcaaaatgatctatgcataaaatttcgctcttattcgattctcttattgagtcttttattgctttatttaaatttggatttgagcatgcattgatcctactcctttgtcttctctagatggccggccaccccccccaaccaccgtggagaaggcatgatcgactttgtggcagagttggcacgcatgacgctggtggtgggctaccccaacgcgccagagtacacgactgttccaccactcagtggcgagcttcctcaccgtgttcgcctggaggtccacggctacgtgggtacctgtctagctaatatggtggttgaggcatccggaggcacagcagatcacgcctgtcaggaggcaccatacctgatgatggccagactacgggagcgccacaactacatcttccacgacacggcgtaccgatttcacccttgtcgagccagcggtggtgatgtcagtactttccgtccgacagccggcgagaacgacaccacctttggtcacatgtgtgctgtgatgaggggattggataggatgcactcggacctgcacaaggcgaccaaggccttgaatgatgggaagctcatgaggatcgtcgctctgaaggacgagatagcgcgcctgaagagggagaatgctcagttaaagagtcttcccgcgccaggaggagtccggatccgcactacaccccgcaagacgacgacggcacctgtgcgcatccagcctgcgcccaggaacccacctccgcccgcagttcccgcacctccagttccgcccgcagctccgacagttcctgcagctccagcaccagctccagctcctgttcacgtgtcagctcccacgtccgctctctccttcgctccagcatcagctgccaggggtccagccagtggcaacggaggttggttgtctgctactcccagtggcagccgcgatctcagcagcaacagctccagtagctcagagtcgggcagcggcgagacttatctgccaggctccaggagtcgctcagagggacctggtgacgagcaggaggacgccttcgactccaccgaccgcaggagctgttccgagcattaggctcgttttccattagtttatcgactgtctagcttctgcttgttagtttgtgtgtttaggttgcttgtttgggatcagttgacggtcgatatcatgtgcctctgatatggctgtctaaataaggatttttgcttgctctttaagtgttttaattcagatcagaacaattgcagtttaaattcctatgtaataaagcttagttcctgagcatctgtttttcttctttcccccgtctgcttttccctccagatggtctacaccaggaatggtagccgcgcaacaggcgagggcagcaacggcgaagagcgcactgatggggcgcatccccacagcgattccggcaatggtccgccaccacttcccgagaatccgacgctagcccatgtaatggcacatcagacccagatgatggcagccatgatgcaacagatgcagcagcaccagcagatgcaccagcggatgctgcagcacgccgaacagcagcatcagcagtttggtccccctccccctcagtccaagttgccagagtttctacgtgtcaggccacccaccttctccagcaccaccaaccatatggaggcgaatgactggctccatgccatagagaagaaactgaatctcctgcagtgcaatgaccaggagaaggttgctttcgccacacaccagcttcaaggtcctgcgtcagcttggtgggacaatcacatggccacccgcccaccaggtactgaagtcacttgggcagagttctgccgtagcttcaggaaggcgcaggtgccagacggggtcgtggcacaaaagaagagggaatttcgggcactccatcagggcaacgggactgtgacggagtacctccatgagttcaatcgtctcgcgcgatatgcacccgaggatgtccataccgacgccgagaagcaggaaaagttcatggcaggtctggatgatgagctgaccaaccaactgatatctggagactacgccgactttgagaggctagttgacaaggcaatccgtcaggaggatcaacgcaacaagatggacaggaagaggaaggccgctcagttcagggcacctcaggggagtcaccagaggccgcgcttcgcttccgggcagcagggtggacctaccaccatgatcgtccgccagtaccgcccgttcaaccctagcaactttccccagggcgccagaggcagtcagaaccaccatggaggtcagcccagccgcggtgcagctccacgcccaccaacggcaccggcacagtcaggcccgtccgcgcaagccaagaaggagactggaacaaaaccagggtcttgcttcaactgtggcgagcttggccacttcgctgacaaatgcccaaagcctaggcgtgccgggacaaggtttatccaggctcgtgtcaaccacgcgtccgcggaggaggctcaagcagcaccagaggttgtactgggtacgtttcctgttaactcaatccctgcaacagtactttttgattctggtgcaacgcattcgttcatttcaaagaagtttgtcgagatgcatgggttaataagagaggaacttagcacaccgatgcgggttcataccccagggaatagctccacttcggttcaattcagcccttctataacaatagaaattcaaggatcaccatttctagccaacctcattcttctcgaatccaaagacctagatgtcattcttgggatggattggctgaccaagtttaagggagtcatcgattgtgcgaatcgtaccgtcaccttgaccaacgagaagggagaaacggtagtgtacgaatcaccagacgcaccaaagcgaggggtctctttgaatcagattgaagcggaaatcccagtggacactgtggagaagaacttgaggaaattggaagatatacccatagtctgcgagtatccagaagtattccccgaagacctcactaccattgcacccaagagagagattgaattccggattgacttggcaccgggaaccgctccaatttataagagaccgtacagaatggcggctaacgaattagccgaggtcaagaagcaggttgatgagcagctgtagaaagggtacattcgaccaagtacttcaccttggggtgctccggtcatttttgtggagaaaaaggataagacgaagaggatgtgcgttgattatcgtgcactcaacgaggtcacaatcaagaacaaatatcctttgccgcgaatcgatgatttgtttgatcaactgaaaggagctaaagtgttttctaagatagacctgcgatcaagctaccaccagttgagaattcgggaggaggatattccaaagacggccttcaccactcggtacggattatatgagtgcacggttatgtcgttcggacttaccaacgcacccgcattcttcatgaatctgatgaacaaagtgttcatgaaatttctggacaagtttgttgtggtattcatcgacgacatacttatctattcaaagtccaaagaagaacatgagcaacatctccgcctggtactcgagaagttgaaggagcaccagctatacgccaagttcagcaagtgtgacttctggttgacggaagtcaaatttttgggccatgtcattacagctcagggtgtggcagttgacccatcaaacgtagagtcagttaccaaatggaccccaccgaagaccgtgtcgcagattcgaagttttctaggactggcaggttattaccgccgattcatcgaaaacttctccagaatcgcccgacccatgactcagttgcttaagaaagatgagaagtttaaatggacagttgagtgcgataagagttttgaggagctcaagaagaaattagtatccgcaccagttttaattctgcccgaccagatgaaagacttccaagtctattgcgatgcatcccgtcacggacttggatgtgtcctaatgcaagagggcaaagtggttgcgtatgcctcgcggcagttgcgtccacatgaagggaattatccaactcatgacctggaattggcagcagtggttcatgctttgaagatctggaggcactatctgattggcaaccgctgcaaagtatatacggaccataagagtctgaaatacatcttcacccaaccggacctaaatctccgacaacgaagatggttggaactaatcaaagactatgacatgagcattcactaccacccgggtaaagccaatgtggtggcagacgcgttaagcaggaaaagttactgcactgccctatgcatcgagagcatgtgtgaagaattgcggcaggagtttgagcatctcaacgtgggaattgttgaacacgggttcgtagccgctctggaggcacggcctatgctcgtggatcaagtcagagcagctcaagtaaatgattctgaaatagcagagctgaaaaagaacatgagggtcggaaaagcccgagatttccacgaagatgagcatggcacaatctggttgggagaaagattgtgtgtacctgacgacaaggaactgaaggatctaatactcaccgaggctcatcaggcccagtactccattcatccaggcagcaccaaaatgtatcaagacctcaaagaaaagttttggtgggtcagcatgagcaaagaaatagctgaattcgtcgcactctgcgatgtttgccaacgagtgaaggcagagcaccaaagaccagcaggtttactccaacctcttcaaatcccggaatggaaatgggaggagattggaatggactttataacaggactgccccggacatcatcgggtcacgattcaatctgggtagtcgtggatcgactcactaaggttgctcacttcataccagtacataccacgtatacgggcaaaaggttggcggagctctatctctcgagaatcatgtgtctacatggagtacccaaaaagattgtatctgaccgagggagtcagttcacctcaaaattctggcagaagctgcaggaagaattggggacccgtttaaatttcagcacggcctatcacccgcaaactgatggtcagaccgagcgagtcaatcaaatcttggaagatatgttgagagcttgcgctcttgattttggtggagcttgggacaaaagcttgccatatacggaattctcgtacaacaacagctaccaggccagtctacaggtggcaccgtttgaagctttatacggccggaagtgccgcacacctctcttctgggagcagacaggcgagcgtcaactgttcgggacagaggtattagcggaagcagaagagaaagtcagaacaatcagggaaaggttgaggattgcccagtctcgacagaaaagttacgcggataaccgccgaagggagctcatttttgaagcaggggattacgtgtatcttcgtgtcactccgctctggggagtacaccgttttcagacgaaaggcaagttggtaccacgcttcgtgggaccatacaaaatcctggaacgaaggggggaagttgcttatcagctagaacttccatccaatatgatcggcatccatgacgtgttccacgtgtcccaattaaagaagtgcttaagggtacctgaagaacaggctgattcggaacacattgatatccaggaggacctaacatacgtggagaagccggttcgtatacttgataccagcgaaagaagaaccagaaacaaggtcaccaagttttgccgaattcagtggagtcatcactcaaaagaggaagcaacctgggaaagggaggatgagttgaaagccgcccatctgcacctcttcaccagctcctccgaatctcggggccgagattccgtttaaagggggtaggtttgtcacaccccgaagttctcctcccaagcctaaatttaatttacaaatgaccctaagaaaataccggtgcaaagcaagagtaaacccttttaaatcaatgcaaataataatcgaaattggcatgtggaatttttcttgagttctacatgtcgaaattctctaacaggatttttagtggaattttcagagccctagaaataattttaaccaattaaaattgagcaagcaatattttaattccagggaaaatcctttttcctttttctttttctttttcctccctttttcgaatgggccggtggcccattctttccttttcttcccctcctccctgctgggccggccgcaggccgaggcccagacaggcccgcccggcgccttcttttcctgggtcgccgacaggtggggcccacctgtcgggt

SEQ ID NO: 13559 - DNA, 10154 bp, Oryza sativa
gcgttcccggcgcccactcccctctctcacccgctagcgcccgcgccagagatggccgggattcgatattcgaatcccgcctctctctcctcccccacttcccacgttggccggcgaagtcccgcctttcccggccacgtccgaccctcccctcccctatttaagcttctccgtcgctccctctcgctttttccccctctcgccgaactctcccgagcctcccatcgctcccgcgccgtgcaacctcttgccgccgccgtctccgctactccggccgctgctagccgccgctggggtcgccgccgcaccgcgccgtcgccgccgttgggttcgcgtggccgagatccaccccgtccacccctccttcgtcgaggttcgtcgccggagcgccattcccatcatgcgacgatgagggtcgccatgtctgccgctttcggccggcattcccgtctcctatggcccctctcttcctctctaacctctttcttttcgttctttaggtcgtcctggtcgccgtccgccgcgtgtcgacctctctccgtcgctcctcgtcgccggacgccgccgtcccctccggtgagggctccctcccctttcattttcttccccaattccccgtgcgtcgccgccgctcgcgctcgccgtcgccttcggtcgttgccgccgtccgctgccgccgcttttgcgtcgtttttgcgccgtcgcctccgccgctggatgccgtcaccggcaacgcgacgcgcgcgtgccgccgccgctagccctggccggccggtcggctttgatgccgagccgagcccggcggccgcctctatcgccgcccgtccgatcggcccgagggcgatctaggctgtcggtcccgtggaccggcggtggaccacctgcgtggtcccggtccacggtgaaccgctgtcccctgagccgttgaccagtgggccccgcttgccggcgccgcaccccctccgtgctgacgtcagccctggaaaatattgcgcaataaaatatttaaggatttttgttatagtaataaacacactgaatcttctaaaattcataactaattcatccgagctccttttaagcccattcaagtctcagtaaatcaagaaaaatgtgtagaatccattaaaaatggttttgtcccctgtttcagtagtcttatagcctgtttgcaatgtttgccttgtatgtcgctagattccggttcctccgacgctccggtgtacttcgaaatagtcgccgagattcctccagcagcagagcaaggcaagtcatgcttgtcacttgaacatgttgatcctatattgcaaatgctctattgttttctttcaaatattgcattgttttataatgttactatgggatggttacctattgtcatagccatgctactgtcgtaccatgtccctttgtcagcttggggttataacatgactagagattggactagggattgcttagccatgcttagttcaactagtgcacaatggggaaaatcctattaatgtttagactgttggttctaatggttttgttggtttagtgacaccgctttggtgttggttaattaaaataaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctctcctctagccgacgcatccaggcaagggtgggcgtgatggagcggggcgggccctgcgacggcctctgtcgctttcggattcacctaggcacgagaggggactgcccgttgcccgctggggacgggggtgaaacctgaggtgtggtgtgcttggctagagggggttaggcgaagggccctgtcacggcctctttccgatatgtcgtggtggcatgtcggcgcacggaaacgtgttgtggggctgtgtcttgtgggtacagttgtacacctctgatcagagtaaaactattcgaatagccgtgcccgcggttatgggcggtcaaccagattcaccgtgattagtctcaccctagtgtaatcttttgaatttggatagtttaggtggatggttgggcctgttgcaacgtgggataacgttggacagtggatagttaatactaattaaatattacaattgtttaatctttcaacttctgtttataaatgctcgctttatgcaaatgaaccactccagctcttctttgataattccctgcatcatacccctattccggtatgacttgctgagtacagtgggtagtactcagtcttgctctatttttttcccaaccccagagctcgagtatgtgtcagatgaaggtttctccgaggagtaggcttcgtccgtgccgtcgaggatgcctgtggagtggtgttcccgctgcagttctagtcaaggcttagctcctgctgtctttcttttcttccgctgcatttgtgtaagacttttatgatgtttgtaagacgtggatctgaatgtcaacattgtcgtttgtgtaccccggccggtcctggacggggattttaatgcacattctgcttggaattctactcgggaatttctgggcatgacagttccggccgtaggtggggttgggtcggtactcttgtctatggctaggatgggttggaaactatgtcacgtcttccgtccgtataccgtgatggtatgtggcacatggttacatgtgaggaagatgtgtcttgtgggtaaagatgtacacctctgatcagagtataatctattcgaatagccgcgccctcggttatgggaaagccgagcaatgtacccaagttagtgtttttaattcttaaaacctgcttaacaactaaaatgtggaatggttggcctgggttggcttgggacgagctgggacccagggtcgggttgccagttcggtttgaatcatcgtaggccttgggttaaggcaggttcgtgtgggttcacggccttgattaataatattatttagctctagaatcgtgtttacaaaatagctttgagcaactaagtgtcttttaatgctgtttactgcaaaccctaaccctttatattttaacccccttgtactcccttgcatttattctgcacttgtgggtgtgtattgttgagtacggtggttgtactcagtcttgctcaattttgcccaaacccagaagaggagcccctggaagataaaggctttggtgtctagctcgtgcctgccgtcaagcgcctgtggtcgtcgccctagtctttcgctgcttttcgtttatcttcttgtgtgctgggtcttcgccgcccatgtaataaattaattaattacgcttccgcttgttaaactctgaattgtatcaacttttggtgtaccttgcctcctaggacaaggaataatgcacgcacgtaaggaacgcccgttgggttatttccggtcgtaacaagttggtatcagagcccccttgaccctaggacgagccttagatcccaagccttagcaatatttttgaaataaaaatcctttcttatttgtgaaaatcctctagtctctctctgtcctgctgcttcatttatcgccaaaatctaatctttaaaatgttgcttttctcttttgttttttttgtttgtagacggccggcagcatcaaccgtcgtggtctggacctgactggtttcgttttggagctgcgcggcatgtgcgttgtcttggggtattcgcatggagtggactaccagggcaagcaactcccggagcaggagggtgacgatgcagagccccacgctacttgggaggtcactgcagtgatcctcactggctcacccgagaggacttcgttggcagtcaccgcgggtggagattctttctccgccgcttgccagaacgccgctctcctcgccatcggcactctgcaccagcgctacccggacgagttgcagcactcgccctaccgctaccaccctcgtcgcggaggagcccgtgactacgccaccttccgggatgctagctcggaggatgacgccaccatcatgcacctggcgcacatggtggaggcgtacgacgcggctcgtttcgacttccatcatatggtgcgtcgtgggttggtcgagaacaacatgaagatcctggagctgcgtcaggagaatctgcagctgaagaaggacctagacgcagtggaggcgcagctgtgtcagctcaagatcgcccagggagaggtatgtcgccccaagcaccgtcgcgtctgccgcagcctgaagatcaccgcccgcaagagtacctccaggcccgagcttgttcgtcagtccccggcgtggacctgcttcgtcgagacccctcgtgccgagcccgcgcccgtggttcctcaggaggagggagcctccggcgttggcagcacggaggatgcgctgctgctcaccttccgccctggcccgtcgcagaagtagacgagcagttagtagtcttgcgcgtgtgttcttctcgtttgtttttctgctagagtcgtgtggggcatggttataccggtgtgtggtataactgtgtcggagcctgtctttattttatttgtttaagcaacttgaaccttaatgaaccaatttaatagcagtaataaattcaagaattatggtagtcgtgggtggttagttttaatagtcagctttctctgtttgccgattctgtgtgggattttcagatggtgacaaccaggagaagtgctactaccggtgatggcaaccaacccgaagggtagcaaccacaacaaccatggcagcccacctccgcctcctcccccgcctccaccaccaccaccagacaccaactccatcctcacccaaatcctcgcccagcaggccaacatgatggctgctttcctccaccacatccaaaatccgccacagcataatgctccacctccaccaccacccccgcaacactctaaactcgccgagttcctccgcatccgtccgcctaccttctctagctccaataaccccgtggatgctttggattggttgcataccgtggggaaaaagttatacaccgtgcagtgcaacgatgaggagaaagtcatctttgccgctcaccaactgcaagggcccgcatctctatggtgggaccacttccaggctacgcagccagaaggacaacctattacttgggcccgcttcaccgccgctttccggaggacccatgtacccaccggagtcatggcccttaagaaaagggaattccgagagttgaagcaaggcaaccgctctatgatggagtatttgcatgagtttaacaacctggcccggtatgccccggaggatgttcgtgaagatgaggagaagcaagagaagttcttggcagggatggaccctgagctgtccgtgcgtctggtctccggggattatccggatttccagcgtttggtggacaagagcatccgcttggaagccaagcacaaggaactggagtcgcacaagcgtcgcttggcaaatttccgcaaccaacagggggctaaccaaagggtccactacaccaatccctatccagggggatcctcctcacagcagcaacaacagcagcaacctcgctccgcgccccgacctcaattcgtggtgcgcgtcccacagccgcagcagcagcagagtcagcaagggacccgtgcgtcccgtcctcctacgccagccgtgcagcctggacaaggccgcagagacgttcaaggtcagcagcgtctgtgtttcgactgcttcgagcccgggcactttgcggataaatgcccaaagccgaggcgccagcaaggccaagcgcctccccgccccaacaacggtggtaaggatgtcattcggggtcgtgtgaaccacgtgactgccgaggatgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagccctgccgttcctatagaaatccatggaattccttttccctcggatctaattcttctagacaccaagaacttggatatgatccttgggatgaattggttggctcaattccaaggagtagtggattgcgcaagacgcactgtcactctgtaccgagggccggaacaaccggtagttttctttgcacccccaacctctgtcggcagttcagaacttcatcagataggactgtcggaaacccccatcgtcagtgagttcagagatgtgtttccggaagaactacccggtatgccgcccaagcgagagattgagttccggatagatcttgctccaggaaccactcctctgtacaagcgaccctaccgtatggcagcaaatgaactggccgaagtcaagaaacagttggaagagttgaaagaaaaggggtatatacggccgagcacttccccctggggtgctcccgtgatttttgtggaaaagaaggacaagacaaagaggatgtgtgttgactacagagctctcaatgaagttactatcaaaaacaagtaccctcttccccggatcgatgatctgttcgatcagcttaaaggtgccactgtcttttcaaaaatcgatcttcgctccggatatcaccaattgcgtattcgtgaaaaagatatcccgaagatcgtgttcaccacgcgatatgggctgtatgaattcacggtgatgtcgttcggtctgactaatgctcctgccttcttcatgaacttaatgaacaaagtgttcatggaatacttggataagtttgttgtggtcttcatcgacgacatcctggtgtactcgcaatcagaggaagaccatcagcagcatctccgtcgggtgttgggaaagttgcgggaacatcaattgtatgccaagcttagcaagtgtgagttctggttgtccgaagtcaaattcttagggcatgtgatatctgctaaaggagttgctgtggaccccgaaacagtgatcgccgtcactgattggaagcaacccaagacagtcactcaaattcgcagctttttgggtttggccgggtactaccgaagattcatcgagaatttctccaaaattgccagacccatgacgcagttgctgaagaaggaagaaaaatttgtgtggagcccgcaatgcgagaaagcattccaaactctcaaagaaaagctggtttcctcgccagtgttaatcttaccggatactcgcaaggacttcctggtgtactgtgacgcttcgcgccaaggattggggtgcgtgctcatgcaggatggtcatgtggtagcctatgcctcccggcagcttcggcctcatgaaggcaactaccctacccatgatttggagttagccgctgtggttcatgctctaaagatctggcggcactatctcattgggaatcgctgtgaaatatatactgatcataagagtttgaaatacatcttcactcagtcggatctgaatcttcggcagaggagatggttagaactcatcaaggattatgatgtgggaattcactatcatcctggtaaggccaacgtggtcgccgacgctctaagtcgaaaaagccgttgcaacactcttggcgtctgtgacattccaccggaacttaatcaacagatggaagccctgaatctaagcatagttagtcgtggattcttggctacgctggaagccaagcctaccttgctcgatcaaatcagcgaggctcagaagaatgatccagatatgcatgggatcctcaagaatatgaaacaaggtaaagccgctggtttcacagaagatgaacatggaaccctatggaacggaaatcgtgtatgcgttccggacgacaaggaacttagacagctgatacttcaggaagctcacgaaagtccttattccatccaccctggcagtacgaagatgtacttagacttgaaagagaaatactggtgggttagtatgaagcgggaaattgcaaagtttgtggccctttgtgatgtgtgccagcgtgtcaaggcagagcaccaacgaccggccggacttctccaacctctccaagtaccaaaatggaaatgggatgaaattgggatggatttcatcaccggacttccaaaaacccagggcgaatatgattctatatgggtagtcgtggatcgactaaccaaggtagcccggtttattcctgtgaagaccacctatggagggaacaaactagctgaactctacttcgctaggatcgttagtctccatggcgttcctaagaaaattgtatctgataggggaagccaattcacctctcacttctggaagaagctccaagaagagttgggtacccgattaaatttcagcactgcgtatcacccacagacagatgggcagaccgagcatctgaaccagatcctcgaagatatgctgcgcgcatgcgttctagatctcgggaagacctaggataagagtctcccctatgccgagttctcctacaataacagctaccaagccagcatacaaatggcaccctacgaagcgttgtatggacgcaaatgccggacaccgctattgtgggaccaagttggggaaagccaagtgttcgggactgatatcctgagagaagttaaagcgaaaatcagaaccattcgggagaatctaaaggtggcccagtctcggcagaagagttatgcagacaaccgacgccgtgacctggaattcgcagtggatgactttgtgtaccttcgggtcacgccattgcggggcgtacacaggtttcagacgaaagggaagctcgcacctcggttcgtgggtcctttccgtatcattgctcgacgcggagaagtcgcttaccagttggagctgcccgcatcattgggcaacgtgcatgatgtgttccatgtgtcgcaactcaagaaatgccttcgagtgccgtccgagtaggccgactcagagcaaattgaagttcgcgaagacttgacctacgtggagagaccggtgaaaatcctggacgccatggagcgcaggaccaggaaccgggtaatccgtttttgcaaagtccaatggagcaaccacgctgaggaagaagctacttgggagcgtgaagacgagctgaaggcagcccatcccgatctcttcgccagttcttccgaatctcggggtcgagattccgtttaaggggggtaggtttgtcacgtcccaaaacgaccgtaaaatatatcctctaaattatgcctagaataattaaaatccgtgtgaaagcctccaacaattaaaatgtgcaaagttaaaagtcaaataatgcttagaggatttttgaatatttcctaaaagcctaaaatacgtaaataaattttagtggaattttcagagcacaaataataattgttaagaaataaacaaagttaaaaaggttttataaaaagaaaaaaccctaaaaagtccccctttcctcccttgggccgggccggcccatctttccccccctttctctctctcctcttcccgcggcccattcggcctctccccgcgcgcgcgccgctgacgggcgggcctggccgccaccctcgctgacaattggggcccaccggtcatccccttcctcccgccgctttcgccgcctcccccgagccctagcgcggccgccgccgcgaatcccgccgcctccagccgtccccgtgtgcaataaagtggggggaattactccccgtgatcccctctctctttccccccatttttccctctctctctcgcgttcaaacgggcggatttgcccccgcaaatctcgccggcgccattgatgatggccgaacctcccgcgccggtttccttcccctccggccgctctctcccccttaaaaccctatttaaaccctccccgcacctcctccgtccgtttccgcctctcgtcgcccttcctcctcgccggattcgagcccgcaacgtcgctctctctctccgcagtcgccgcgaagctccggtccgccgccgtcgtcgccccggaccgcctcccacctcggtgccgcctccttcgacttcgcggcatcctcgccgatctcgtccacctgtccgtttcggtcgccgatcgccggaacgccgtcgacccc

SEQ ID NO: 13560 - DNA, 684 bp, Oryza sativa
aattattgttagtaaacattttttaagtgttcctctgctttgtccagtaccatggtatattgtcacattgctattaactctaagagcaagataagggctaaagatcaaataggttccagcaatgccaaatatttcaccatgttacaaacaccaagatcgattaaagtttctaagtattttggtttgttccatttgttttttggcagcttcagtatggtttttgtgaggtaactttttattgaatttttttctttacattgccagatgtctaatctatcagagccctcaaaagaagctgcatcagctgatgattcaagtgctgtccagaaaactggagcatggagtaacacgttgaacattcttctgcaacaagcttcagtctatggtgtggctgctggttattgcctgtcagcatccctgctctccattatcaacaaatgggcagtcatgaaatttccataccctggagcattgacagctttacagtacttcactagtgttgttggagttctcttatgtggacaactaaagcttattgagcatgatggccttaatttgaggaccatgtggaagttcttgcctgctgcggtgatgttctacatctccatcttcacaaaacagtgaacttctactccatgccaatgtggacactttcatcgtgtttcgctcagctgtgccaatttt

SEQ ID NO: 13561 - DNA, 9372 bp, Oryza sativa
tatgccaaacttgcagttttaaaagttaagctaaagaaatgcctggcatacatcaatgcagaaggtcatagaagccaaaagatgttaccttgaacattatcacactagccaaaatggttagtgatgtaaacattgtataatatataggcgaaacaactgcagtattgaatgtgtcaagagcctgtaaaaggaaacagagtaagcttagggcatttaacaagctatattgaactgtaaagtgatggacattgtacagtcatgcatgtatatcaagcctgagttctaaacaggcagaatcaggtgttgtgatactaattttaatagctagctagtgtccattatggcatgttatattccagtacaatttcgttcatgttccaatttcgttcatgttccttggaccttggatgacatgaaaacatattatgatataatgatagttcacttttaggccagaaatcatggttaccttgtttagatagttcatctgagttagtatacatgcaacaacaacaatggtgaacatccatgtctgtggatagattagctggttcattcctgaaaaagtcagtttcaaggctattccaagtgctttcacactcatgacctgccaaaagcagcaatatacacaattttatgaatagaggatactagaacagcttaactactcaacagtattttatgaatatcaattgaaaagagttattaacacatggaacacataccgagagagaccctacaagagaacaaacaccaatatacaccataatgtgtgtctgaccatattgggggataaagcggaatatgagcacaaaagtcgcagcaagcacagtgactgcataaaatagaaaggctgcaaggcaaaagctaaaaccttagtacgagataaaaatgtggccagtaatgtttttgagattcaattgtcagcaacacagtacctggttcagtagcaagagcccacacttcagctacagaatcaatttcacgctcctgcggcgcatgaagcacaatggttgttgaacccacaacacagaggacacaaccaagtataccaaatatgtgaagcttctccttcaacataatatctgcaagaacagcactgtagaagaaatatgctaagatgaagaatgaacagactgatgaaaatataaacagcaggagatctcaagattagggaagtgtaggtgctagctgttacctgatgatgatgcttagcgcaccaagtggggttactaagatagcaggagcaaaggcatatgctgcaaagttagctacttctccaacaatcactggaaaacagcactgaatactgtcaatatcacactgataagtattagcatgaataattacttatatttagaaattttgacttacttgtaatcattccagcccaccacaatggttcatacaagtaggagtaacctccaacgcctgcaacccaaccaatgtaaacatagtcagcgaaaaagaactattgcccatccaaactaacaaggcacatatgttataactatattgtacacccaaactaacaaggcaaatatgtttataactatattgtacatccaaactaacaaggtatgcatcttgcagccaagccaacaataaccccttaaaaagttcaaacaatagagttatggtttcttcccaatcttatcaggaaaatttaggccattcccactcttagctggactaggtcatctaaaaattttacacgctcaaatgttcggacaattattataaactacaattcaattatagaacatgaagcataaactcaagagtaagaaatagtaatgcatcattattgcgccaacatatgccaactcctcaccatctaattccatgccgttgccaatcaatttagtatccaatccactctcgctatgcctaaaatgcctcatcatggtgtacccataggctcaccactctcctaaccctaatacagatccgcagtacttccccggagagatcgcatgtatagaagtataaaagaagaccaaacattgtggttcggatcagaaaaccaaaaaaaggagcataaactacacacaggtccggcaccgagtaaaatggtgatgttaggacgagattaggtcacctgcgcggacgccggaggcgccggccttcttgagccccttcttcttgacgatgaagctggcgccgatgaagaagctggaggagagcgctagcaccagccccttgatgttgtcggccgacatcccctccacccagctcccgcccccggcaccggcggccgccgaagtggacgcctcagtcgccataccccccggcgcccccaaatcccggaaacccttctacaacctccggggggtgcgacgccgctagatcccgccgcggacgtggcgcatgcggagatccggatgcggcgaggagggactggctgcgctcgccgttccgggccggggtaggctacgggcggcgagggccacgcattcgatccgctctggactgcgtggggggcggggagaaatcgagcggcggagacggcggcgacggcgacggcgacggcgaggttgggtgggaggggagaggggaattggggttcgcgagtccacgcgacggggatgtttgtgtgatgtctcggtgtggacttggccgctactactactttggctgcctcacctcaccggctcaccggactcgtcttgcttagcatcgaggcaacttgggtgtacgcgtgtgcggcgtgtgtgctggaagtgaaaatttggacagagtgagatggattttgtggatgtgctttacctgctattttcgggtgttactagtacactcgagtagtccagtgtgtgctttggatgacttcttttttaccaattacaggaaatatgctcatgaacatcatgcgaacattatgctcacgtatttaaagaccagtggtaaattcactaattttttactgaaagtttactcacatttgtaagacggatcgcaagcaagctgaagtgctgaaggcacttttatcttcacgtgatattagcgtaacaaatgaagcattctctcgaaaaaaaataaagcgtattattaagccaaatcaaacatgcttttcagatagctgaacaagtcagataaagagccttttagcggaactctagctctacctcttttgcagctagagcacaaacaacggtttcagctccaatgttccaccaaaaaaggaattagagtgggttggagtactctcacaaaataaagacatggagcgtggtttcagactgctccacaacttcactctagatacatctcttaaagttaaatttagaagttgaatctctaccaaacaagcctaaagtggcagaagaaatgaagcatttataactggttatgttaagtggtcatcttaaagagatatatattgtatctgcctcaaaaatataataatttctagagttcagatgctgtttcaaatataactatcgaatatgtaatgctccgcttttcgtgaggcgttaaaaaaactaattcggcaaaatcttatatgcgaaatttttcgttctttgtgtgcgagtctaagtcgtgccgtggatctcaatttaatctccttgtccttctcgtcgccatcaaaatcgtccacctcaagattccaattccgattcgagtctccgaaatcaaattccgaaagtcaatcccttcctttgaatcctctccaaataattgttcccattcccgaaagtatcaaacacccgctttgtttccttcctcgtctccttgaacccttgtgtacaagtttcaaatttagattcaaatccaagctccaattctctccaattcaaattctaagaagaagtctattttgcctccctctgttttggatggaccagtttccttccccttggcccatctcccctctgccgctccccttctcgcgtgcgtcgcacgtgcccagagcgagagcgtcgtctctcttcctctctctctctgtctcgatgcctacgctctctctgtttcctttctctctctcctctcgccacgctatgcgccgtcgccgcgaatcgattttcgccaccgcctttgaaatcccgccgctgcctttcgaattcccgccgcgcccttgcgtccacgcgcgcgctcccgcgtcgtggccgaccgcccgggcgctcgccttttgccgtcatccatggctccaccgctaacttccaaagcagagaggcagtgccaccctcctctctctctcacacaccaaaatggcaagggaccgagcctctttcctccctccccttttcctttttctcttcccagaccggcaccctgctccgccaatggcgcctagcaccgaggacccgcgagcccgcgactgcctcgtccccttgaccgccccaatgtcggttccttcccttcaaagccccatccgcgcctataaagcccacagccgagcccctcctctcaatccctcccgcttcactctccaccgctgcagcgccattgttgctgccaaaccaccatcgccgccttgctgccgccatcctcgccttcctccgccgtcgcgtgtgccgggaagctggcttgcgcgcggagccgaagaggactccggtcgccctctctccctccccttccccggcccgaggccgaggcaatcccttctgtgccgtcggacgctcttcccggcgacctcccgacgcggtagccccgttctccctccccgctcttcctctccctcctaacttgcgcgattgctagcctagaccttcccgaacgtgcctagtcaccgcccaagcgtcgccgctgctcgctgtgagctcgccgccgtcgacagccgctcccggaggccgcctctcgtcgccggacctccacggcgctgctctgctccatccgaccaccatggcgagttcccttggtcccggagatgctcccgacgccgcgaattgaccccattccctcccggcgcgatttccccttcttctccccgccggcgtgcgccgccgcaatccgtcgcctccgtccagccccggccgcatctgagccgaggaatggaatccatgcctcctttcctcccctccggtggtctccctttctcccttcgcgcctcgcgccgctccgtcgacgcgcgccgccgtccgccgttaatccccgccgcaggccgtcttcctcctctcgctcgccagcgtggccgccacctcggcgccacatgggcttgtcccggtcagctgctccctccgtcccccgctcgcgcgcgcggtccaccgcgagccgtgaggctgcgcgtgggcccgtcgcctcctagtcctccgagcaccgcgccgtgcaccgctccccctcccgaaccccagcgccgcccttgcgtgcgcccacctcttcgtgaaccgtgtcgccgacatgcgagccccaccagggacccgcgtggtggaccgcgtccacccgaaccgccctccctctctccccgcgcgccctaatgggccgcctccccatggccgcgctcggcccaatggccggccaagccttgtgaatccctcgggccgcgcctaagccgcccgaggaagtctaaatccgatccctccttccttttcttttccaagggaattaataattccttttcctttagacagaaaatcaaataatccttagaaaatccatatcttcccaaccgctcatccgattgatttcgttcaacttccagtaaatccataaaattgagatctattcaatggcactattaattagtctaaatagatctttcttttggtcttttgtttaggttttcgattgtttgcgtatagttgcggttaccggattttcgtcaatcgtgggatttctcgaagatacgtgaagattcgtgaagaccttgagcaaggcaagtcaccctttgaccaattgctcctataattgaaaaatcattattattttgtttgcaacttgcattattagaatcacccgtttaacttgcttggcctcggtttgcatgccaaaccgagggacctactagtagtcgcactaattcctgtaggttgtactaccctgactccttgtcactccacctttgtggtacctcggtattcgtgctatctaagcacgtataccaaatatcccacatacatcgttgtttgtcgaaaacttgggaaatgggtttgaaaagccttgaaaacccgacatgtggtgtcggtgtgtttgaaaataaaataaattgtgtaaactcacgatgcgggggttgtgcctgtgtggcactgtcccgtattcgcatataaggatcgattcctgtgggaaattcatccgagcatataacaagtgcgaccacacgggtgcaatgggacgcccctggctgagtaaatagcaaaccagggaagccttgatgccaagagacatgtggattcaatggggtggtgtcgggtggaatcctcaggcttcctggcacagtatggtctaggacctaacctgttgtcggtctgggacccctctcgttggcatatggcgaccctgtgtcggctttcgaaatgccttgtcatgaaagccttaaggtcaccagacgtagctgttctccacgggttggatgatccgggttagtaatgtcgtgtgggtaaagtgtaccccctctgcagaggttaactaactgttcgaacagccgtgcccacggtcatgggcggatgtaaggtgtttcctatagcgtagatgtgtttgcctgtgctttgtaaaaagttgttgtggtgtgggaatcgttaccagaatcagcctatgtggcagatggatgacctgagtggtcaagaaacgaatctgtgtgattcgggatgtctacgggcatcatagactaggcttcccgagtggaagcggattgttgtgctgctgggcagttggactctgggagtccgagaaaatgaaaaggctctgggagccgcttaatcaagtgaaatggctctgggagccgagaagtaatgatctgacccaggaggtcggtacattaccaaatgagctattgaaaaacatctcttaaaagtcgaatcgagacacaagtctcttttcggcacaaacttagaaagaagtagaccacttagtgatttcaaaatgatttcaaaacaatagatttgcaaaacaaccttgcctctcttccaagcttgcattaaacacctaaattcccgtgacttgctgagtacgaaagtactcacccttgctctataaaaaaatatatatatagttcctccatcttgaagagaagattaagtgaagcgaagattagggtttcgtcctggtttccagccgtcgcctgtggtgttgggtgttagtccgttgtttccgctgctgctgccgttgttggtgttgcctcgtccgtgtcgtcggttgtaatctcgggctatcctgagctgcaaccctagttaaggtaaataagtcatttatttatttcaaggattgcaatgatttatatttgtcaccgtgggtaccagcgctatgtcctgggattggtactgagatcgcggtctcgtaggaagcggttctcaccgtttttccgacaacacgcccctgttaggtaccgttgtacggcggtgccggattgggggtgacagaatacttgtaagggtaaatttttatcactaaactacccatactagagtatcactggccttttatatcatcccaagatcccaactagtcgacaattcacccatccctaaggagacaaataaagtatttttatctctctccttgatactcggccgagggctaaaactggctatattgtgggacagaaggagtgtactactttaaatgctattccatccgtctcattttaagcgcaatcatgagtttctttttccaaatttgattgttcatcttatttatttattttatgattagtattagtattattattattattattatattattattattattattattattattattattattattattattattattattattattattatatgataaaacatgaataatactttatgtgtgacttatatattttattttgttaaaaaaaataaataagacggacgattaaagttggacacgaaaactcatgggttgtgcttaaaatgggacggagggagtaaaaattaggctcatatggttttactagcatatgtcattattgtaatattcatgagctatcttatgttccattatctccctcatgtcttggccctggttgaatcatcttcctcaatcgtaaaaccaggtataacgcttctcgcatatttgaaaatcgatgcaaatcaacttttttagcggttgcgaagacggttttgtcctatgtgagactcataagactcacatgtcggtgagaaaaaagattaaaaaacggccccacatcttagtattgcggccgtgagtggggcactcgactggtgcgcgcgagagagagaatgggaaagaaagagagagaggaagaggaaaaagaaaaggaggttaattaggatgactaacacatggagctgttatttttttttaactttttatctcgcttacatgaagtcccatgaacgccatacaggacggaaactctttggaaaccatagtaggaatttgatttgcacgagtttttaaagatgtgggaggggttaccgagaatgctaatggacgggtgattgctcccccgtccgcccagcgatcacccgcccgccccctcccctatacgatgcactcctccctcctctccctccttcctcctccccttcttctcttcctattacagtacaccacacaaaatttttaaaaaaaccaaaaagttagaaaaaaatatgtatagaaatactatatataaaaaatttgaattcaaattcaaatttgaatcgggtatgtaaacttttgacttataaactttgggtctataaactttaggtgtataaacttttagatgtatagaaatactatatatatagaaaatatttgaattcaaatttgaatttgaatcgggtatgtaaacttttgacttataaactttggttctataaactttaggtgtataaactttagatgtatagaaatactatatatagaaaatatttgaattcaaattcaaatttgaatcggatataattcaaattcaaatttgaaacgggtatgtaaacttttgacttataaactttaggtctataaactttaggtgtataaactttagatgtatagaaatactatatataaaaaagtatttgaattcaaattcaaatttgaattggatatataaacttttgacttataaacttttggtctctaaactttagatgtgtaaacttgaggtgtataaactttagatgtataaatttactaaaatagaaaagtaatacggtgccaaaaaagcaaaccaggtggaggggtggagggagggaggggagaggggatcgatcgctacccccgtctccgggcgatcgatcgcccattaggatcccccagggttac

SEQ ID NO: 13562 - DNA, 721 bp, Oryza sativa
ccttcacaaaaggggcatactatattgggaagatggtgtggagtaaaggatacagggaacgtcttgacctgctgtccaaatatcagagcaagttggtgggtttggaagtagatttatatggtagcggagaagattccgacgaagttcgaaaatctgcagaacttctgagtttggccgtgaaggttcacccaggacgtgatcatgcagatcccctgttccatgagtgagttctcttattgttcaaaaacttccttccgtcttcttaattatttgaatgaacatgagcgtacaactagacaagtttaaccagctacttttttcattgttgttcaaaaatgagtttgagggttactatcattataattcattgcaacaatgcaaggttactgaactaaacaaaacgttgaacacaggctacataatgaggtaagacaagaaactgagagtgctaaatcacctaggaatgcaatataactcataatatattttgtcatctatattacattcagcatatggcaatggtttgtgtggatactgaaacacttcaatttcccaacagctataaagtattcatcaaccctagcacaacagatgtggtctgtacaacaactgccgaggcccttgcaatgggaaagattgtcatatgtgccaatcacccttcaaacgagttcttcaagcagttccctaattgccgcacctatgacagtggcgaggaatttgt

SEQ ID NO: 13563 - DNA, 744 bp, Oryza sativa
aacttgagcaaatactctgtttaataatttagtgaatagtttaaaaagaacatgacctctgcattttgggaattttttcaggcaagaaattaactgtaactggaagaaaagaagaatacccaatctgcagggaatggtcaccctgatctgggtgagggtggagaagaccctgatggtgatgaggctgatcagcaagaacagtgctagaaccgctgtgcccaccaccatcttgccaggacatatggagcacattctctgcactggtttcctgtaactgcacgaacaaacaaacgcttcagcggtatgagaagctgattaacttttaagccgtaccggggaaaaaggtttattccgtgcaaatactgtaactttcgtgaaacattttagcagccatgaaaagatcatggttgggactttagcaaggaaaaagatgtatgttgtccgaatactgatgcacgcaatgactttcagggtgatcgatggctgtgttacctttttcctcaagtctttgttgagatcttgcagctgttgctcctgcagaatcaattttagtgtttgtcatatgtgcacagatttaatttaggtgcagaggaaaaaagaaaagaaccagaatttattcagtaccttgctcttcagatcaaacagctgatcaagcagtgcttggttctgcagaaatattgagcctgtgttaaaagccatgcacataaacaaatccatacagttgaggggtaataagtaccgaat

SEQ ID NO: 13564 - DNA, 738 bp, Oryza sativa
ccttcaaaaagcaattgtaaggtggaagtcgataacagggtggtatcaagatttttccatcatcttttggaacctgtaaaactatgttgtcagtgacccaacaattttagaattgcagttctgaaaaaaagcactcatgggaaaaacattatgcggttttatttctagtattattggattgaaacaaacaggtaataggattttatctaaattcttttgtttcaaatttcaccagatgaatcatggattcatgagatagtttgctccgtgtcatgttgtttggtaatttcggttcctatgatgttgttatatactaacaaccgtatatcatatcctttatatttgatcctggaactcttgtcattaccaggctctggaatctggtgatcttctctgtggtggtacagtaacagaggggagtgctggaagcacagctattagcttggccattgttgctcctgcttatggctgcaaatgtcatgttgttattcctgatgatgctgccattgagaaggtagtaagtcacatactgttcataattcttataacatactccatggtgtagtatctgtgattgctacttgagttatccatttttttcatggctagctgaactaaactatgctagatgcttctgttaagattgttccaaagtacaaacagtatttcaacatcagaaagcctgtaattgcttatgctcctgtatgtttagttttactaaaactcttttcacagtct

SEQ ID NO: 13565 - DNA, 574 bp, Oryza sativa
gtgctttcgctgactcttaggagttacaatctgaaatttccatgcaagaactgttattgtttagtacaaatcatcataagcattaatcaaagttctgcacatttcgcttgtaataaacaagtactgaagcaaaaaggatgaaaagaatcagtcttctgtgtcatagttagcaggaagctcatagttgtttattctcttatcttaagataattcaagaaaagctaaaaatgtatttcaattatctaacctcaatctacttgtaaatattaacttaggttcttgttgaaaaatgatgggctgttcgttgggagttcttcagccatgaattgtgttggtgctgtaagagttgctcaagatttaggtccaggacatacaattgtgacaattctctgtgacagtgggatgaggcatctaagtaagttcttcaatgaccaatatttggctaaccatggcctgacaccaacagctaccggtctggaatttcttgattgatgagaaaatttcatggggaatatacagtctcagcaagtttttcatgatgtgatgtctgccctgatagctggtgaatactgac

SEQ ID NO: 13566 - DNA, 2110 bp, Oryza sativa
atgtttaccctttgatgctgtcttgtgtcaggatttggcatttgatctctcccttgcagccttgcttggtgataacatctacaactttggggaattgttagctcacccgattgtaagttggactttgcttacgcatgatttcttttgttgccactagttagtagtaccacctttgttttatccatacttttttgtgtttcttgattgcttgattaaaattaactctgcttgcctatataaacattacatgtggcttttcttggtactcacaactgccagttctgataattatttattagttgtttttatctgatgcttgctagaactgcaaggcgtccaaggtacctgtgtatgttatggtagttaagtttcggagttttgtacacagtaacttacatctattgccaaatcggtagcagaaatttcatgagttgaatgtatgcagttaacattgacacaataaaatgctaccgattgtgtaaagcatatcaaaatgatgaaatatcctatgcctgatccttttttgctgaatgttgaatgatgtaattgtgaaccactatattataattatgtaaacttcgtattttcttgaattgaaatagcataaacttaagtttgcatgaattaatggcaaaccatcttttttgtgcatggaaaaatcaatattgacttgtggataccaaacaaaaaaattccagacacaaggtagcctttatgggattgaaatattgaatggcccctaaatctatatatcggcatatatggttgtcatttggtacatctctgtctgaagttgtttatatttttatatccttagatcaacagtcttattggaaccaaggtggagtgggtctatcatatgttacaagcattcaacaccggcaacctagctctctaccaagaactatgtagggtccacaatgctgctctcagtgctcagccagctttggtgcagaatgaacggaaactgctagagaagatcaacattctatgtctgatggagataatctttaggtacaactttgctacttgcttttctatgccaccacaaatgtcttgccccttttcctttattccttctaagccctgtgttctttttcatgttgtagccgggcgtcagaagacagaactatcccattaagtgttatagccgagcgcactaagctttctatcagtgatgtggaatatcttcttatgaagagcctctcggtaattgcatttcttacattcgatctttcataagatattatttgcaatatgccaatatcatgttaattcattgttgggatagacaatgcatgaatgccattcataaacatctagttttgttgtgcataaattgttttttaagattagacattagaatgcttctaatgcttctgtcattttaatgtggcagctgtatatggatagtgattatttgataattactgccttcaattcctcccctttgtgaacttgtctttttttttaattgctgatggtttgttttgtgaatctttagttgtgagttatgggtgtgcgttgtcagttaaactagacatgtgattcatatatttgtgtttgttgatcacagcaaacctgtgtctctccttgttacatgctactattgcttttaccttatacggcttcagtgtttgcacaatgtatcaactagtattcctagttgatgttctcatctttttcttccattacagttcttttctacatcagttagtacattatagtatataataatgctgcccctgaaaggcagaatatataggtagccaagatagaatgccactgctatcagcttcttacaaaagctccatgctgatgttttctatttagttgctaatggagcctgggtgctgtatttccatgaggccatcaattgccatacaatttaaaagtaaattggaatatgagagaattattaatgattcccccattttgcaggttcatcttatagaggggataattgatgaggtggacagcacagttcacgtgtcatgggtccagcctagagtacttggaattccacaggtgaaggcgttgcgcgagcggttggacgcctgggttggaaaagtgcataccaccctgttgtccgttgaggcagagacgcctg

SEQ ID NO: 13567 - DNA, 986 bp, Oryza sativa
tattggtattggcatcctgctcaaccagtgtgacgagctttggttgcagacccttcaccattcgaaggagttggtccctttcattcataattgaaacgctctcgtcaggaaggtggtgcagctggaatgcaaaattgacaactagtgcttccccaggacaacaatctagcattgcaggtgtaacatccccaatgttagcaccaactgccctgaactcaaaagatatcccacagtcctctgcaagtttctctagacgttgaccaatgaccttcaaaccgccaacggtcctctgtaccgtttcaggatcatccacaccagttattctcaaatgacgtggcttatttgcattatttttcagaaactgtatcagtgtaatgtactggctgccctgattaatgtcaaagtctataatgtgcactctatcttcacctttgcaggcttcaagtatagcataattagcagccatgaaaccaaatcggaagcacgggcagatttcaaagaggatttgcattgccgaaagctgataaagagtcgggggctctttgcacgacaaggccttgtatatgcctttccctgaagctactattcttgctgcaagaccttccactagataggctgcaatcctctgagaagggtccccttggattgagaccatctgccggaggtccgttatgattgcctgtgcttcatctacattataatcagataatgccattgcacagtcaaagagcaactgctttggggtccgtggttctccattgttgctaccagcacaactgatgcttgattccgattcttttggtgagttagggagtatgacattcttcattggatcagcccattcatcgttaatgctacctgcctgggaaatctcatacaagatgtcatcactatcatcaagtaaagcatgctccagctcctgaagcttcatcctgatatcatcttcatcaaactctacttcaagttcaaaactctgattgtctgat

SEQ ID NO: 13568 - DNA, 10891 bp, Oryza sativa
ccgattgccatgcttctggaaccttaatcaagctgactagaacgcaaaaaccacattcaagaatacaaacaccagaaaataccgagataaagtacagctcatacgcgccacaaataaaatattggtgtaaaacctcaccagcacgacataccccgaaaaaagaaaaaaaaatctttacagggtcccgttcaagctatgatcatactaccgatatccgatcaaattgccgtggttcatgaacctgattttctggaggtataaacctccaatccacacagacagcatcagccaagaaacatgatgtaatcactaacactgcacaaaaaaaaagagaagatttccctttccccttctatgttgtaacatcccaaagcccccaaagccctgcgctcctctacatgcaaagcaacacaaacaccagagaagttgaccaggctcttcttgttccccagccaatttccgatcgcccaatctcaaagaacacataaacgacaccaccaacaccacccatcatgctatatactaacacaagaattaaagaaaaaaaaggcatccaaaatccaagaaaaacaagagcacgacgagcaagaaccaagaagacaaccagcaaaaaaggaacaaatctttgcagttgctgggagaaggaggccgaagaggaagcaaaatcacttacaggaggagggggtagcttgcttccggtagcacacacaggagagcggcaggagaggaggaggaggaggagcggagaaggcgaggtggggaagcggagaacggaaatgggaaggagagggagcaggagggaaggaaggaaaaggggaagaagagaagagaggagaagagatggttggttggtttggtttggttggttggggatagcgagtgggcagccaagtccgagatgtcatgcggtggagggacggacgcggtcagggcgaccggcggctggctgcggctgcctctgcctctgctcgcgtcgccactgccgccgggatcctctgcggctgcgccaccgcccacgggaaccaccaggccccgctcctccattttgcttctctcctttgatgacttcttgttgccgactgctatacgtatacgtatggagtatcgaatctatgacgtactaactccatcccatgaaatgtgtttatttttcagtttttaatacaacgtttgactttacatcttatttaagaacaattttaattgttttttttatttatattagattataaaacatttttattcatattaaataataaaacacttttattcatattagataataaaacatcaatagttatgtgtgactaattattttaaaaaaaattcataaatttttcaaataatacagacggttaaattttagacacacaaatataaaaattaatttattttgagacggatgtagtagaaagtaaggaacatttggtacttctagttacttttgacatgctgttatttttttattataaaaacattaactacttagtatccgtactaccgtataaataaaagtaaatttatttcaaggcaaagggagaatcttctatgggtctatgacgtgtattatttagcctcttgttttttgcttgatggcttatgaagggtagctaaaataggttatctataaattattcttttttattcattcattctattaaaacttattgggatagtagtaaaggagtatgttatttgtgcatgtggtaagtaatagatttatttgtggattgacattcaattgaaatttacataaaattttccaatattagaatttgtggtatgtttatttcaagttcgtaatatgagtaatatttggctagtgatattatggtcatttaaagagtggaatcaatatttcatctttcaaaaaaaaaggtataaatacagagatatgtaattaatgcatgtgactatgacctcatgaatgagcagaaagtaaaagagaaatagtatgcttgagatgaattttccaaatgtagtgtttagtagtttccatatgatggtgagattaataatattaatatccacaccaacaaaaatctagaacatgaggtctagtaccaaatagtcaaaagtcattatcggaatatgaaaaatgtgtaattatcatcgacttccttatccgttggaaaatgacgttgtctctcctacttgccagctttctttggatcagattatcctagaaggaaacaaaatatagaggcaatctatcatttattctgatgatgttctatgcatggaccaaacacgcatgcctaaatatttttgcaggtaataggaggaccattccacatgaggaacttgaggtaggagtgttcttttctatcaaagacgatgtggaccagtgaaagcgttgcaaactttaagctaaactagaattttctccaatgatatgttgtcaatttcacttactagtaatatcgtctctagtatctaattttgttcgctggcatcggttggatggagctttggtgaatgctgtaaacttactatttcttttctatctttgattttttttaaaaaaaaaacaaagcaaagctccttcttccatttcaaatatgtaattttgcaggtcaactcccccaagtgcttatttgcaatatatgtcaaattttctcaaatagtcttgatgatatttcacattgactattgagtactcagtcttacagatagccacaaaacgttgaatggagatgcttgcttacacaggatcctatccatttggtgtggagtacgttttggcattttcggcttcaccgcgtccctaccaaaccaaaccaaagcagctgatcatttcacagcttgaccgttgaaaactatggaaaagtttattttaagtgcgcataaaccatagtggagaaaataacctaatagaaatagacaagtagctgtacaaattagtgggtccatgaatgttaatttctacgaaattgccgtcgccttcttgttgaaggcttgatctaccgtattgtcttggtctaaaaggtttgatccaacagaaacttctacaggtatcagcttaccgtacttgatgttgcaaagctatcatccactttttccgtaatcctaaacccttaccttttctggtcatcttaagtgctaatccaaagtaatttttctggtcatctagtaatccgtaatataagctcatacaattctaacttaattaacgcatgcttcacatatcatcatctgaacatatcagcatatcattaccagttcatcaaagtcaccaccggcccatgcctgactttttgaccgggattaatttatcaccacgtttatttgtttgtgatccacagttccgaaatgctggaggtacatacttaggataagattgtttttacctgctttggataattattcatgtaaaaataaactctcagattaattaaggtccttaagctccaactaatccgtgttcattttctcaggtagtcactctctccccccagtgtaaaaggcggtttttttcttgggattcccgtgggctgaagaagccagcaaaaccatttctctgtcaatcctgcgtgcaatgctttccagcaaacttaaaaaagcttttttttaggcgattaaataagggtaaataaagtacgtgtgctgctaacaaatgtcatgcaagattggattagattaggcacgcctggaggtgtcgtttcgtgctgggccttttgactccttgccctcctatagtcctatttgcttgcagctggtagtccactagagtagtgagatatttttttcatggccaagcaagcaatgttgttgtcgtgtgatcatgttagtcaaattgcagacgtgtgcatacatgcaacatatcaccaatcattcagaaactttaagttctactctctctctattccagtttaatcatcctctaaataaataataccaaaactaaggacactaaaatgtatatcattcttaaattaatcctcatcggttaaggtgcttttactacagtactatagtattttttttcctttttcttttacttcatcaaaacatctctgttttcgccttgcagccttgagagtttttgagtccctgatttgttctgcttgttgctggtgactgctgagcaatttggtgcaatacactgaatctgatatccgacattgaatccagaaagcatgcgtgcaacttgctctggctggctaggcatgggcgtctgtgttatccgtgcccggtttgcgatctgtgtgtgtccctctgcatgcgacgaaacggcacgcatgttggtttgcatctatcagacattcagacatagaggagaatctttcgtacaagaatggtggtgcccatgcgtgcgaccgtgcggaagctgcaacagcccgtgacacacgcacacccccacgcctcgtcgacgacagcatctcagtattggaatcgtacagtaaaacaatcttaatacatacaagtggcagccaatctgataatacactaaacctttttttgatctttgttactactgtaacaaggagcagaggtcatcttctccttaccgtgccggcccataaaatttatggcctgggcctggaaagaccatggcaggtgttgggctggtgtcgcttgcaatgggcccgaaacgaacgtgagcccattgggctggcaccgatcgagagcttcgcgatccatcgactgcacagcaggccggtgtccagttcccgtgcgatctcctcaatccggcccgttcccgatgcccatggccgtctgctgcttctgcctccgtgaggcctctaatcacgaatggaagtagatcatgatcatgcataggaataagttcacttgatgaccctcaaaagtgatcggaatctaatccatgaccctaaatcgcaaaaccggatatctcgaccctcaaactattaaaaccggtgcaattttactcccttggcggttttggagtgcggtttcgctgacgtggcggtattgacctaatctgtgtgctgacgtggcgcttacatggcatttcaattaaaaagatacacgtggataggaaggatagctatactaatttggtatactcaaaatacacctttggtacaaaattgacaatctcacaaggatgaaatatcagtaattttctatttactggttgatcccatcttttacggaatcaattccttttttgaatgtacaaaaatttggggagctcagcatgtctggaagcacgggagaacgttcttttgctgatattattaccagtattcgatactgggttattcatagcattactataccttccctattcattgcgggttggttatttgtcagtacgggtttagcttatgacgtgtttggaagtcctcggccaaacgagtatttcacagaaagccgacaaggaattccgttaataaccgaccgttttgattctttagaacaactcgatgaatttagtagatccttttaggaggccctcaatgaccatagatcgaacctatcctatttttacagtgcgatggctggctgttcacggactagctgtacctactgtttttttcttgggatcaatatcagcaatgcagttcatccaacgataaaccaaattccaactatagaactatgacacaatcaaacccgaatgaacaaaatgttgaattgaatcgtaccagtctatactggggtttattactcatttttgtacttgctgttttattttccaattacttcttcaattgagagaaagaaagagagtagtaagaattctcttatccccatttggaaggataccatccttataactatccatgactgtttttgtctctagcatgaccacttgataaaatgtggaggaaagtaggggaaatggccgatactactggaagaattcctctttggctgataggtactgtaaccggtattgctgtgattggtttaataggtgttttcttttacggttcatattctggattgggttcatctctatagtaattggagggaccaggttgtaaacatgaaaaaataggaacttagcgggtccttacccccttttatctgattagagcggaaaggacccgcggaattcttactcttataacccgacttttttaatctattccataacctacaaacgggtttcctattttgatttgtaaaaataacaaagagaaagcctttgctctgatggtcagaatccctctatttattcgttttgtttgttaattttgtttgttaataatgttagtgaagtaatccatcagttgatttataaccccctcgccaatgaaattaattcacttttatgaagcgaggagaaagaaaggatcaatcgaggatccaatattttattccccggaggaagtctcttgtaaatcattgatttaatttagagtaataaactaataaaaccttaattaaaactactcaactagcctaaaaataaaaaacagccttcaatggaagagtatccgttttttttgcaaaatttctgtaagttctaaattgaacttaattgaacaagtcaagcaattctatttggtcacaaaaaatttgtcccacgccatattttctttccctctttttgtccactacatcgcctgaacctaagcaaaagaggttcaagagacagacccaaataaagaagaaatagtaatctttgccgaataggaagaaaaaagattcatatttcgatacaagaagaatcgacacaagaaaaaggcaaaaaagcctttttcttgtgcccaatagaggattaagaagaccagcaatccctcctaaaaggatttgttccttttattgttctcgcccttgccttgcattctcctcgttttgcatgagatgatagaaataaggaattgcagacaagacatctcgcaaacaaaaaatagtctaaacaaaaaaaagatttccaaaatggatcatagagaattctagcaatcgccaataaatcgcggctttttaccaacttgatggtaagaaatcccgggacctagaaattcatttcgtacaattgaaccttttcaaactgtttctttttgagaaccaaaaaaacttgtgccaaaataacggatgcgaagaagaacaaaaggccttgaacgcgtaatggatcctgaagcactatttctgcatccccctgaccaaaccctcccacattaggattacttgttaatggttgatcaagcttgatcgattccccctctgaaacaagaagttctggaccgggaggtataagatcaatcacttggcgtccatccgatgcatcgactatggatatttcatatccccccttttctttacgcagtatttttcttactacacctgttgacgttgcattatagaccgtattgttactcttgctaccatcaggatagatctgtccccttcctcggtttccccccacatatatgggatattttaagaaatgaacgtctttcttcatagcagggtcgggggaaagaatgggaaagacgatttcactatatttcttaccgggaacagggcctatcacaagaatattttttttattgggacgataactctgaaaagagagatttcctatcttttctttcaactcaggagaaatacggtcgggcggcgctaattcgaatccctcgggcaaaataagaacagcacccacattcaaccctccctttttcccattagcaagaacttgtttcagttgcatatcataaggaattcgaagaactgcttcaaatacagtatcgggaagcactgcttggggaacttcaatatccacaggcttattcgctaaatggcaattggcacatacaattcgtccagttgcttctcgtgggttttcataaccttgctgcgcaaaaatgggatatgcatttgaaatagatgtccgagttattacgtatatcatgatcgatacagaaatcgatcgagtcatctgttcctttacccaagaaaaagtatttctattttccatgtccaatcacagatcccggaatttctacaataaattagataggtagctaagctaatctagttccctatacacgaatctgttgtcattctactgcaacagttgtactggaatgatgaataccttgagcaggtagaaatagaaaaaaagaattttgctaaaatggaaaaaggctttctttctaaaggaaaaaggatgctaattttgattaatatcaggagatcaaatgagtttatgcttcactaattgaatgataaatgactacaagcgaaggagataggcggtttaaacaaaaaaagacccaaaatttcaaacatgtatctagaatcacaggaaaactacaaacaaaaatagtgaaaattagctcgttaggaacccatccaagatcgttatagacccaacgaattagtagttcccaaccgcgggtggagtgaaatccaacaaaaaaatcagtaactaaaagaataaaaaaagcttttactgagtcatttaagttatagaagaattcctgaacccaagaattcaaaataacaagttcctctttacccagaaaaaaagaaccacttagaatagccaaacagattatatttgtcgagaaatgcaaaatgatatggagatgaccctcattatctattttggccaattgtattatttccttgcgtatttgtggatcccactgacatgtgggccccacatgccatcttatccgtttcttcttcctcccctccccccttctctattctctccctctcccctacagccgttcgcggggagcgagcggaggcgggcgggggctgaagcagcggcggacggcgggagctgaagcggcggcggcggaggtaggttggagtccatgtcgtgccgctgccaccaccacccgcaccacccgacggccggcatcgagatgtcgtcggcggccgagctcccctctgcgggtgtcgcggcggctggcggagactgcggcgagcggcggcggctgcacggagtcccgagcggcggaggcgcaggtgtggagcggcggcctgcgagcggcgcgacggagacgcgggtgtggcggcggcgacctgcaggtcgagcagggcgcggccgagctcgccgtaccccgccgcgtgtgcctcccgccgccgccgctgtggtctcctccatcttcgccgtggtggagctcagcccgggcaccgccgccgcccgcaggcgatcagctacaccgtccgctccgaccgcctgacgcgctcgcgctgctcctcttctcgcagcagatataccccatggtgaacgaagacgcgcagtacggcgacgagctccgggccgtgtgcccgccggatgcggaggagacggcgtgggtgcacctggaccacggcacgccgggggagctcgacagccagtgctacgtacaggaacgtgctcgccgggaaggtgctggctattcaactcggatcactgggcactgatcagcgaagcggcgacgaggcagatggtcgaggacaacgcggtgaaccagtcagccctttgcttgttggcttgccgcttgatgttagtacacacatgcactgcctgttgctaccgcttgtgcttgctagccgcagtccagccagtcctcatctgtcgccccttgccgattgcctcggcaaccagcaggagaatgctcaacgcagatgcctcccaactcgcgtgtggttgcgtcgttgtcggctggctcagcacgccgaccgcgtccatcggcggcggcggcgcctcccccgcccgcgccgctcctcccgccttcaacgccgccgccgtcgcaagtgcaggagaagccgccgccggatgctgccatcttcgaggggatgccgacgcgagtcgcggtggcgagacgcaagcggcccttacgcgttcgtgggcgcggcgggagaacggcggaggcgggtgcgtcgtggccggcagagagggcgtggagcacagtggtggatagtgcagtcacgaggccgagggtggcgaggacacggccattctcgtggcccgttttcttccttccgacggccaaccttccacggcgggctcgatctccgccgccgccgccgctccggccctcgcccgcatgccgccgtcaccgctccagtgccactcccaggactccgccgccgctggccaccgtcccacactcgcggagagaaagagagaggggagaatatgatttatgtgagccccacatgacagtgggtcccacccatacttttggtgaatgacaaatgggtcccacgtatatatttttatttctaatgccacctaagcgccatgtcaacgccacgtggacagaagaccgagtcaatactgccacgtaagcaccacatcaacaccacgtggacagaagaccgagccaatactgccacataagcgtcacgtcagcgaaaccgccctccaaaaccaccaagggagtcaaattgcaccgtttttaagagttgggggtcgagatatccggttttgtggtttagggtcacagattagatttcgatcacttttaagggtcacaaagtaaacttattcctcatgcatatactcttcagagattttgatccaaaagaaacatatgatccatgacaccatccatccacaaacacagaagcagttttccccagtccatcgtaagcaatcctggggttttaatttacatcttcctcaaatccgagctgttctagtttctacaagagggagcttgctagtaggcatggttggagaggatggccctcccatggcggtgcgggtggtgagcgcaggcgcagtggacggaggtgaggctgaggcatccgctgatgatgagggagtgccgctccgggcacgtgtggagcgccgggaaggagtcgcacaccgcctggaccgccggcggcgtcagcgccgtgcactggctgatgttcaggctggccagcccgtcggcgccggcgccggcgttcttcctcgccgccgcgtcccagctccggcctttgctcctcacccgccggctgttcgccgccagcgagtacattg

SEQ ID NO: 13569 - DNA, 16271 bp, Oryza sativa
agtttagagtaaatcagcatgtcaaagcaaatgttattcaaaattcaaactgaacaattttaacattctgtgaccctaccaaaattttggtaactttaatagtaaacatgctagtttagattgaagccaacaattagtagtgcccacgctcactttggctacattctataatcttcttcactctcatactaaattttagctttatattggtattaaaccaaacatagattagctaactttgccctaccaaaaaattgatagtgccaaaatttacctagattttggtactaccaattaattggtagtgtagagaaccaaataggccctctgatcaaggaaaaaaaaacatcggagattacctgttatcagaacacagccacacaagtccagagcccgaagttcagggcaccctgatgccaagctggtcactcccttgtcagttacactatcacaccagcctaggttcaaagactgaagctgaccacagttacaggcgatggcctgcatcaaggttataaagatcagaaagaattcgatggagagcaatggcgcaactactttggtacctgcaatgctctgtcggaaactgccctcacacacccgcacagattcaggcatttcaggttcttgcactggctactgagataggccaaagcagcatcgctgaaattggaacatccactgatgttgagccttgtaagatgggggcatccatgtgccagagcatacaacgatcggtcgctaagcctaaagcttctgctaagatccaactcgcgtaaatcatgacagttatttgctacagcctccactgcactgtcctcgagctgaggtttgatttgccgtaaagaaagaacttgcagcttcgtaaatttctgagcaagtgacatcactaagtcattcatgtgagcctggcacctgaaaacaacactctccatggttaaccaacagccttattgtccacagatgcaatcaaaattttgttcagaatgacgaggttttgcagtcactaaacaatatgtctgaataaagcatactcctaaaccatattgccaatacaaagttatctgatcatgcttcttaaactctcgtatgactgtcttagtatcaaaagtttcaatcaaacaagcatttgcaccaccttgcaaaaaactagtaacacaacaaatgatgtttatgactcaatgtgaccacaaacaatactcttctcaattggtggcgcgagcaaacagatgaggcagaaaagttgcaacagaaaggactacgttcagttttcttgaccacgctttgggagatttggacggaaagaaacaatcgcattttcagagggaaggagtctacaccatcagctcttgctggcaagatcatagatgagctttatttgtgggaaatggtaggtgccaagggagtgaagtgtattatgttaagagattaggcttttgttttttctcaggagtgcaggcaggaagagttccttcacgaatgcctctcctcttctgttctgtacagtttttgtgttctctaacttcttctataatataaaaccagttcgctgggttctttcaaaaaagatgtttatgactcaatagaaaacattggaacaagccagtcagaatatttttgtcagacatcataagtggcaaacaggcaagtttctataaacactacaaaattaaaatccggagtttctttagctataaaagcatccaatttaaaagttacataactattttgtggatattatcacataacaattcttctatgtctgtaatattcaacatgtcaatactatgtgagccatctacccataaaaggtcagatagagacgacacgaagaatctaaatgtttcgtgagaatcatattcaggaatgggaggagaaggcaaattgccaaactcaccacgaaagagaaagattcgtgactccccattctaatgtatcacgccaaccggtgcaaacaccagagcccacgattaccatcctgtcgtctccagccatcgataatatccgcaggagcagctccatgggaaggtccttccaacctaacaaggtagtccctgtgccctcatgatgtgcctgtccactctcaccctctccagaaaccatgagtgcgttgaacgaattgtccaattcaccactcatcagctgctcaccgtccattctttttttttttttggataatctgaagctccgaatacagctaacctgcaagcaacagtgaagttatcagggactctgcactgatgtcaaatcccaatctgaacttgatgctaccagaatatagcaaattaatcccagaaaaactcaacaaaacagatgggagcaatcataaagtcgttttgcaactgaacaactcaaatcttcaaaagaaccgaaatagagctaagaatggagagataattcagaaagagcaaccttactatcaacaattctacaccatctagatgagaatattatcataaaaatctcctagagaaacttatagggaacacacagaaaggtacctcaaaggagctcctaaaaaagcacgtattctctgcaagtggcaatttgagcagaaaccgaacttttttttttcccttttgtataaaaaagggagctccttgtaaaggtcagaaccgcattaaacccaaatgcagatgagacggcaagcaaggaggaggcgaggcgcaagctgcccagcctttgatttggccgaaaaattcaatcccttctgtcgctaaaacaccagaggcgtggccggcaccgcaaatcccaatcaacaagaggcaagtaggcaacaaagctaggctttcagatgattccgggccacgagaagctaatccaggaaaattcaccaagaaaaagctcaaatcatttggaggcgagatgaatgagcgaatgataacggagtcaatctccaacgcagataacatccgttcaagactgatagtgacctggtctaaatatcttcaagaaagggaggaaaaagaagaaaacaactccatcgctaaggatcgcagtagctttcgcgcacagccagccacacaaacaaaacagctcctcccgaaatgcagagtaaagctcaaagattcatacagcatccaagaaaactacatgggatccaaaccacgagagatggcgatctcctcatcagcatctaccacgaatcccagacacaaaggccaagaaatcccgcaaaagaattcacccccataagacgtgaaacttcctttcttactcacctagtcctcgctcctcctccaagaacacgcgaagaaagaagaaactctagatgaggcagtcgataacccgggggagaattttgtttttggtttttgccgcagttgtgaactggcggctgggttgggaggggaggagggctcgggttcttgtaggggaggaggacgccaccggggagggcagcgacccgagtggcgcgtggcgggtgggaggagaggacacgtgggcggtggcgtcggggggcggggcggttagggccccgggatttttatccccgttgatttgcggatgcggggacgggaaaacgggaggagttcgctgtccggactccaggcctggaagcttttgcccccgggaaggctctggaagggccgaagggagggatcgtacgccttgctctatcaggtcacgatttatttatttattttttaccgggcttggccggtagaaggcccagcagaaattttgtgcttctgcattgttttctccatcttaaaataaacgatcggaatgggatatgatacaacaaattagaatatagggttaattggatctatggctatatccgctaatctgaatttagacataatccggatttattgtattaggcgtcccaatctagattggtttatttggaatagacgtaatgcacactcctgctgtgtaaagattaatttaggtgtgtctatattctatagcactagtacccaataaaaggaaacctgaatagcaagggctagaaattttgaaaaacggttagcatgtggatttttcctcttctgtctactagctcattttcaagcagcgaagctattcgatcaagctgtaaattttggcatgttcgacagcagtggtagcatctgcagtcgcacattatgcatgctgtttataacactattctggctggatacggcgcaaccacaaccctaacagccgaataggccttatgagaaacaactaagcatcggatcttggggcttgatcagattatagccaaaataaaccttaccaagttttggcaatgcaaaaaatttagcaatacatttttggcaagtgataggatttcttatgtattgaccagatttggtaacgaactaaacgtagacatttttttagtaactttgcgaaaaaaatagtagggttgaaaattgaatcagagtgaacatgcacttgataagctaagatatcttagcttctagctactaattcattttcaagtattaaggctatctaattgagtcggaaatattaagaaatagctggtatgtatcgaattgcttctaaattctactaattcattttctgaatcctaccgttgagttttgcatactaaaaaaatgaatatagacttttcggataggcagatattcgagcagctgtgcatttgctagaaacttttcattttacattgccagttttacagaagattagagtagattatccagccagaatgccagatggccgtccagattcaatgaactaaaccaatgaacctacagtacggcatgagaccaatcatgcctccattgattgattgatcgatcccaaaagacaggcgacacaccggcctctgatcagatcaatctttgctcccttagtgggcagtgtcactcaccactctacatgctgatttgtccttgctaatgctctactgctacccactcgcttgtcgatttgcagtcgccatgaacctagccacgaatctagcccaaattggcactcatccccggagctcccaaagcagaaagcacccgacgagcaagagacagaggcaatgtggtgataagatcaacagagatgctttggcagagatcggccacgacgtagatcgatttctagagattaatttattaatagatgggttaaccaaatcgcatggcatcttctcatgcgggttgacgcaagcatgcatggaccccgttaattggcttaatttgtggtcttaatacagaggattactcagtttcagagtttctatgtgttgctcagggcaaaggttggattggatgatccggcaagcaaagtagacgcaacctttaagctataataatggccatagttatctagcctttcagtgtgtgtgatgtttacttggatgtatccttctaaactctgactgaattaccagtttaccacgcaaaggattgttaatttcatgtagagttgagtttattaaaaagaaaaacatctgaccatctcattccatgggctccttggttctgcagaagccatcagttcacaggtctttttcccgacgttgatcagttcacagtaataatcctgtgacttatgtcatctttcagcaagaaaccgcaggcagaaaaggctaaaacctagtcaagtacagtcatcaggaagagcttctccgaatactcgcagacatttcgatatgcttttatccctgaacatattcctgcttatgtgtacagtatgtttagcatttttttttgacgcaatacgcttaacatgacacacatgattcctttcctcatttaatgtacagaactatcaattcagaatatgtgttctttgctaatcccgaacgatggagaagcttggcttttaattatagttgatgtggacgcaaaaatccttgtacctgaattccttgtttctgcagtttttgatcggttgcctacaagctggaacagcaatggcgtctgctgctcatttgcttgctgatttcaacaattggctatgctatgggatatcaagaacagctttgatcaaaacactgtgtgagtcagcatctgacgagttctgatattgatagaggtggctggggtccattagtattagattaatgatgagacctgagtgtaacacaagttccttctaatccttctcttggcagattctctttgaactgttgtatcaagtaaaggaaattggaatggttccttgtcaacattaaagctgtcacaacacgatgcatgagtggagtgctactcatctttttcttgttcagagattcctaagataaaatttgtttcattaaactgacatagtacaactttagcacggtcttctaattaacatagaaaattttgccaatgatgttgtttactcgtaacttgttgtttcattagtaggaaaagcacctttcctcctagtacacaacacctttcagtttcgtaggataacgttatagtattccaggagggaagaacagcaacttttcttgcgcacacatatatgcttttgcaggttcttggcttcttgggtaatactaacattctgccctcatttattttctgaaattgcatcctgggaataggcatccaatcaaaaggcattttattccccctacgaactcaaatcgttgaaacggttcggccgcctaatgatgacccagaatttcagacttcccattcaacagaatgctggttccattgccaacttgtagaggatggaaaaggacggcagacagcaatccacaggtcaattcattccctataagcatgaatctctttttaatcagaagtttttttttttaatttcttctgtaagttagtgattggaatggccccataaactatattctgcagaaacctgttcagctgggatcaaaagcagatgtcagcattttagatggctcatatccttatctgattagtacttattttcacctaaaaacggcaacggatggagaaactgaaggaaaacagctgcctagattgcatatctttatattagcagaaactaaactgctgagttacatatatgctaataaaatggtcacaacatagcacggctcactcttctttcgtactctacagatcacactcttcacctacacagtagccccaaaatttgatgttagtaacacaaaggacaataacatgacaagatgcttttctttcatttacaaagataagacagaactatcagaaagtgaagcgctgattcctcaaacatacagcgttgtatgcatgtgaacagataacgggagagagatggaaaaagaaatcacaacagtggcagagtattattaagggtgaactcaaagcagacgatttctctctgaatactgcttcacttggtaaagtgtgggatgaattgccgggacaaatctctgatgtgttcattttctgactcaataagacgaacaacctctcccatagaaggccgctgttctgggtttatcctgacacaaagatatgcagctcttgctagatgatacagcccatacgtatcgtatgtttctgcaatgcgctcatcaattagttcatgtagtgcaagactctcgaccaaaggttcagcctgaaaattttgaggtgtcagaaatgaatggtgcaggtctactgtaagtaggttgacaaaaacaataagaaggatctactaaagtgaatacccattgtaatatatgtgtacactgccctccacattcatcaagcaccttgcgaccagatatcagctggaaaagaacaatcccaaaggcataaacatctgttctgacagaaactatgccatattcagcatattcgggagccaagtatctgacaataatgacaagaaatactggtactgttagaccttagaaaacaggagcaaaatgttagcataaattagaagataaagttttatcggtgaaataatttgagtttattccaaccctgattgccccagaatccttgtatggatagaagcattgctagccttccattttgcaagaccaaagtccccaagctgtgatggtataacatatacaatcacagtcagattgcatgaagcatttgcatcttgaaataaacagataagcagtgactgagatctagtattctccagattaccataggaacaaagtcatgtgtcaaaagtacattgcttgggcgcaaatcccgatgaataattggaccagcacgacattcttcgtgtagaaaacgcagcccttttgctataccaagggcaatagcatgcctcttgtgccattccagtaagtttgcgtccttgtctatttcatcaagtgacgagcaaagtaaattagccacccttcatcttcacaatataaattactttctgcacatcaactaagctcttaccaaataaatgccactcaagggatttgttgcatatgtactcatacaccaaaatgttgtagctttctttgcaacaatacccaagcagcatgacaatatttcggtgccgggcaaagctgagaacttgtacttcagagaagaactcagtatagccctgtgagcttgcttccttgcgtactttagctgctatgacctggccatccttgagttggcccttgtaaacatgcccaaacccaccctcacccagcaaattctcatttgagaattcagacgttgcagcttgaatctctgagaaggggaatttcatagattcctttatgtaaagaactgactttagaccacaaccagcacacagaactggtcgctctgatgaatcatagtggtagaacatgtttccttcaacacctttacctgtaaggacaacaggagcatatgtaatgtgcgcaaataggtatggtacatgggctgtataaaatcaactattggagggtaaaattgcacaattttaactctgagaaaaggttttcaaaagctctctaattctatctgtatgaaatagcagaaatacaaccaggacacagtgtttccttttctttctttacacgtttatctagtttgaaattttgagcaaagtacactagttgctaacttacgattttgctttacaaaagaaacatgccataccgttggacaaggaatcagttccgtcaatcgttgtgagagacatggcgctcattgatggtgtcaaatatgacatgctgctcccgaccacactggatgtttcatgcatctcgtgatagcttagagaggcaaaataacttacaggtgatgacttggtcaacacactatgagtgtcagtatctaatgtctccgaacgcaggtcgagtgatactgctaggtgctgcagagcctttacttcccccatgcttttgctcggtggaattgtcctaattatcttcaatggctgcaccaccaagttatcctgaaatactgccaccttgcaggcaatgtgcttttctaagtacttgaaatctctcctgaagtgcctaaaaaattacaaaataagtacctcgtcaagtattgaaccaaacaggcttaagacttgtcacacagatcctctcctgtaatgcagagaggaactgtgtggacagtaatttgtctctgctgctagaatagaaagtctgtaacaatgttaaacaagacataatgtgcatacctatctagtacaacccaagcagctttgctggatttgacttcattgataatgacaaacttggctggtgatccaggagataccttaagggtcacattaatctgaaataaaaacaacgagcatcagagtgtaacacaatttttagtgcatgttttcaatctaatcggtgaagcacttcattatccagacagaaaaaggttggacagggattactggattagagacgaaagtacttgcagttttgtttcataaaaagaagacttatttctctatgaaatactccgtaaatgcaagcattggtaccccgactttgcttagctcctccacgtcatgacggagcttgttttggtagaattcagctttcgccttaacctgatcacttagtaatcgcaagttcgtcccggcaaaagaatcaatacatgccttggtttggtatcccactaaacaaaggaaaaataaaaagaactagtaagttttcagtaaatgcaatcattactttgctaacatataacattcgaagtagcacaaacactcaaacaggaactgaatccatatttccaaacatacctgtactaagatggataagggtgcactagctaaccattatttaaaatcgaattattacagcttcagactagatatttttaaaatggaactgttatcattgacattcaatgtgaaatttcacaaaagcaggatctaaacatatcatcgtattaatgctggactatctcttgaataaatgaataggattctgtttttgaaacaagaaaagaggaattctaacagtttccttgtgatggaattagatgttcagaaatccaactttgtcttcagtgattcgctgaataaagaatgcatggatcttctttttttcttcttttattttcttttttcctcttcgtcactctgtttcccttacatgacattataggttgtcctacccaacgagatgttgccccaatattgatgaccaacagcacagaattgcagtaggcacatctatttgacatctctttcactaacaaaacaagaatgccactataaaaattctatctaaatgtacgataaaagtgctagtgtgctacaatccattcccactctagaatttgcacatgtttaggcttccacttgtactcatgtaataccacttcaattgtggagtactatgtaaatgcaaaatgcaactagacagcatttcgggtaggttaattcgtctaagtacaatttctgagctgtaggagttaacaaaagagggagttttaattcaaggagaaagagctgggagaaggtaacccgtgggaaaagaagggggagcgtggccctcactgggattggtgatggcgtggagcacgccgagcacgaggagggagtcgccgccggcgcggaggatgtccccgcgcgtgaccaccgccctgagcgccatcctgatctcctcctcccggtggtccctcgtcgcgtcgagcgccagcaccaccatctgcggcggcggaagcagcggcggcagggccgcgggctggaccgctgccccgccgcccgcagcggcgctcccatcggcagcctccgcggccaccgacgacgccggcgtggggtggtcgtccccggccgcgatgaccgagtacatcgacatgggcgtgctgaccggggtgctggtggcgctgctccggtcgtccccacgcccccgccgccgccgccttcccccatcgtggccgcccgggagcgaggctattagtaggccgaggcggcggcgcgcggcggagtatattcgcgacagcgcggagtacatcccgccgccgccgccctgcttgctgcaggcgcggggggcatctcgaaggcgccggggcgggatatatggtggggcatctcgcgggcgatggcgacgcggggggttctaccgagggcgcccgcggcggcgacccgcagcaggttgcggttgtcgcgttcgcgcgcgcgcggacggcttcggcttcgccggcggaggcgacgagacgaggcggcggagaggagcggagacgaagaacttttcccgttgccgtcggccggacacggcccagcgactttagggcccattgcgcgaagactatccgatcgctcgcgctgagcatcgtaggccgatttagcaactaagcccatcccttcgagaaaagaaagcccatgcacgaaatataataggcaacattttggtgtcctctgttatcgattatcaacgtgggagtaaatccgacaattaagtgctctaatacctcttcatttgtagagtgtgcagcgctacccatcaaacatgggtcacccaaatcacattgagatatgctctatcgtaggtttaaccggaattaaaactttagatactggtctgcacaatctaaaaaattagtctgatgggtgagaattgtttttaccttttagtcgtgcttctccatcatcctataacggtataggactaaatccaacaatttaatggaaatggaagatccgaccaaccacgaaacaccaccgacggagaatcataccaaagcaaacgagtcagatcgtaaatcactataaattatagcagcagcacgtgtggataggtgagaaattgctgcaacacggacctgacgaccagcaatcgtggccagtttctagccatttatggcctgtgattaatacagtgtgtggccgaactgattaagaggtgcagccgcctataaattcagcctacggagtactgaaacattcacgatctcgatctacgcggcatcggagagaagctgatcgatctatcggtggggcgcgcggccgcgatcgatggcgaagctggcaggccgcggcagcaacggcgccaccgacgaggcgctgcgggagtggcggcatcacggcagcaagttctacgatacgttcaccgtctctggcctccgcgtcgacgccatccagcccggccgcgtcctctgctccttcaccgtccctcctcgcctcacggtacgctactagtagctactacgtccgtctcattttaaatacagttttggttttttcgcgtccaattttaaccgtccgttttatttaaaaaacttttaaaaaaaattaaaaacataagttaggagtaaagtactatttatgctttatcatttcataacaataaaaatactaattataaaaaaatttcaaataagtcgaatgattaaaattgggcgcggaaacttatggctccacttaaaataggacgtagtgagtagtaaacactctttctgtcgcaatatacatgcatctagaattgtatataatattgcgggcatatttagattgtagcgaaaataaaccttaccaaaatttgacaaattgccaaaattttggtaggatttcttatgcatttattaaatttgacattttttgcaactttaccaaaaaaatagtatagttgaaaatagcatcaatttgaacagtcccttcataatacaatgagtttaaatggataactgtccatagtcgttttactatgaaatatcacaatcgatcctagatacgcttataataaaatggagggagtacttcctttctccccaaacaaacaacgccattaacatttttacataaggctcgactattcatttctctactacttaaaaaataaaatgtgcttccatcgtccgtaaaaaaaaataggcgaaaaaaaacaagtttgtccgataaaaaaaaccgggcgaaaaaagtgcgaaaaaaaagaaaaaccaaatatgcccgatccagaaaaaaggggggaaaaaccggggaaaaaaaccaaaattgtccgatccaaaaaaaaaaccgggccaacaaaaacgtaaaaaaaaaagaaaaaacaaaatagcgataaaaaagtccgactcggtcccgtaaaaaaatagcgataaaaataaaaaaaagcccgactcctcgttgcgattccctctcagaaacaaaaaaaaagtccaactctagatccgagtcccactcctctcggtttgagtccgagatactaggcaccgcttctctcagtttcaatctatagcgtgatatttcatacatcttggtaaaaaaaaattgatatgccggattgaagatctgtttgcaaaaatggaacctacatgtcgagagcatttcatttttatatgattttaatttttgggtttgtacatttgcatttgagtccctgtaatttttatatttacatttgagtccctataatcttgcaataaggtgcttttggtcctttttttttgaaaaaaacaataaataaaagggatagaacaaaggcagaaaggtgcataaaaaggaaaagaaaagccacacaaaaaagaaaataaacaaaaaaacaacaacaacaaaagtctatttcccctaagtggtaaaaaaactatagatgcaaacggaaaaaaaatctaatttgtataaaaggcaaaaaaaagtggcgaaaaaaacgctatatccgattcctttaaaaacggaaaaaagtctgatccctgtaaaagcgaaaaaaatctgaaaaaaatctaaaaaagtttgtccgattccctaagaaagtggcaaaaaatagttcgtaaaaaataaaaagctggttcgtataaaataaaaaatgcacgcgagaaaaacaatgaaaagggcgaaacaaagtccaatttctaatcactataaatcgctctgaaaaaactgttagaaaaaagctaaattgatggacgcttgagtcggataggatccatcgattttttaccatctactacacggtttttatttcgtcatatattctcatgtattggaaaaaagcaaaaaataatattcagaaaaaacaggcaaaaaaaccacgcgataaagtaattgttagaaaaaataggcaaaaaacacgcgagaaaagcaaaacaaaaaaggggagaaaaatatggttttcgtcatcagtaaaaaaaaggaaaaaacatgctaggaaaaaattgttagaaataaatgcgctatttctgaaaaatagtttgagaaaatcgagcaagaaaaaacaccgtttataaaaaaaacaagccgctcattaaaatacaaacattgtcattgacatgattatggatgaaaaacttatattatcattagaattttttcacccgttgtaacgcacggacattttgctagttatttaaaagttacaaaaatattattttttgtcgtaacttgttgtttatcataaaagaaactatagttttaacttatattttcatatatttatactaattttttaatagtacgaatgattacacgttatatatataaaaaaaaatcatccgctcggatattttgggacggagtagcacacatctacgcttacatgtgtatacgtatgcttacgactcgaaaaatgagtgaagaatgcaaggagcaaacgcatgcatgggggcgcggtggcgtctctggtggacctggtggggtctgccgtgttcttcgccggcggctcgccgaagacgggggtcaccgtcgagatcaccgtctcctacctcgacgcagcccgtgcaaacgtaagtacagtacccgtgatcgagcttcggctgcttcgcgatggatattgatcgatcatgcatgcgtggtcgcaggaggagatcgagatggaggcgagggttctgggcatcggcgagacgaccgggtgcgtcaccgtggaggtgaggaggaagggcgccggcgaggtgctggcgcacggccggatcaccaagtatctcgctgtctcgagtaaactgtgacgatatataataccatcctgctagctaagcttgcagcaggcaggcatgtgcgtagtgcatacatacatttgtacaattaaatagctgatgatttttccatgaaatttgatgttttactagtagtagatttaaaagttggcaatatatatccgtcccactctgctgaagggagtagacgggcgaacaggggaggctgcgagaaccgagaggtgcacgagcacgagtcgggatttttcggccgcggttgggcctaaaccacggtagcctggctggatgacggcccatcaaccttctggcccaagagagttcgggcccatgttacgatgccacgacggaactgtggatgaataagtctattctgtcttcctcatgtcttgccaccggttgaatcgtgcccctaaatcgcaaaggaaaaagtacaccgaaggtccctcaacttgtcatcgagttacaaaatcgtcccccaactgcaaaaccagatatataacatccttcaacttacaaaaccgtttactttaggtctcttggtggttttgacccgattttgtctgacgtgacggctgaatcagcatggatccatgtgagccccacatggcaggattccacatcatcatcctatctctttcctctcctctcccttcctccactctctctctctctcacttttctcctcttgggcaggccggccggtgggtggggaggaggtcgccgacagcgggatgcagtggctgcggcgcgtacctagccgtgccgccgggggcgcggtcggtgcgatgcgcgctctgccacgccgtgacgcgcgtccctcggccgcgccaaccacagcgagcttagcgcccggagccacgagaagtagtcgctaatgacgagaagcgcccgcgctgcctgcctcgtggtcaggatccggtgcatctgctggagcgtctgctacctcagcagatcagcctacacaaaaaaaaatcatcgcatcacgccatggtaataagcaatttagttcgccattgatgtttgaccgaagcttgaggaagttctccagcgtggtgagcatggccatggcgatggctatctgtcccatgtagttggtgacgttgtcgg

SEQ ID NO: 13570 - DNA, 13814 bp, Oryza sativa
  unsure (1)..(13814): unsure at all n locations
ctgtcatatgattgttcaataggcctggcagcaactaattttgcttcagaacaacaataggacaaaggtcacatacagtgtgtactaccatgagcatagactatgtactcatagttagggattggatcagactgggccaaccaattgtttagttcctttccaagaaaatacttaagtgcatgcgcacaagattattcactacttgccctttatccttgccagacttctatcaatattttttgacgaaacagcagctgtcccaagatccctctaaatcgcaagaaaggtagtaaagtagggcttggggacgaccacttggggtcatatgtgaaactgggtacccacactcatttttgccgggttggccgaaggattaggcaagattgaaacagttacaacatcgacaggatgctgtcgaaactgggtacccacgctcatcactacatgtagatagtccatgcagtataaactataagccatctttcccttcacatgcagggttccaaaatggagataatggaagctagtggagtgtaaaaaaattacaatggaatttattacttggactagcctaccatacctggaatcgacaagatggatcttcagtgatgatttctggggctatgagagatagagctcgaaaacagtccgagttccttctcttgtcaacataaatctttgatccaaatgtccttgacacctcaattagggatctcttcgtgaccaagaagatcacatgcaagatagacaaatggagcatgaggatgcttccatatgcaagctataacctgcaatcactgaaacatttctcaatggtgaccatccatgttgtcatatgcacactcctacagttaccaacaagcacatttaatctaagcggagaggaaaacctgctgaatagctgactccttgcttggtagcttgaggaagcatttggaaaatgtgcagtccaggaacacaaagtctaaacggcaaatgttttctttccctttctttgctatgtacttcagtggcaaattatgtacacaatctggcgtcagccgacagtcccccgtgtgcagaatgctaccgaattgaccctcgaacaagaacataaccgcccctggtatcacagaacacgcaagcattagccgtggtcaacccttcccatttctcaatatacaaattcaataatgttgcgctgaaaatggcctcatagaacgatgaatcactccgcctgaacagcggagcaaaaactacaattcccatggatctgttaaaaaaaatcggccgctgaattgaacaatcactcccaccatcacaccctgatccctgacaactaagtaatctactatttctaccagcaaattatcaacttatatatagcacggtaagctgtaacacgacggtatgcagaactgaagaagcggaaccagaattaccagggcagtgattggcgtcgtacgccgtgacggagaaggccccggcggggtcgtccaccaccaccgtcttccccacctccatctccacgaactccccccgctcaagctgcgacaccacgagcgaccattcgattagcacggcacccaccaccaccacacgggaacagaatcggcttccgcgagtcgggggggcagttttacccggggaaaatggcggagggcgaggtcgagggtgagccgcgtcgcgtagacggcgccggggcattccccggagtcggcggcgccgccggcggcgacgaggtggtcccggtgcgcgtgggtgaggaagcggtggcggcggcggcgggaggaggggccccacgtgtcgacggcgaaggggagccgccgcggcatctctatcggcatcctcccgagaactttccgaaattacagttcagtcctccgctcccctgaacctcgccgcctcgtttggtggggccatcgggttgagttagttgtgcccgtttatatacccgcgggaagtggcgccttccagaggaagaaaggctaacgggctaatggatgataacgggttttatttttttacatccatccatgacccgctaataagtagtaccagtctgattttgatgggcccaagcgttggtatgggccttcacaaaccggtggcttgatacactttcggcccaataacagtacgacaatgcaatgtgagatccataaagatgcagcccaattaaactagattttttttcttctttttatgcatttctgctcggattcttcttcattatgggggcctggggggcatacagtatcgtacggtagaaaaaaaaatgggaaatggcttcacgcttgcaagaacagaacgggaaatacagtatcatactctctcgatcgggcacgagagacagagatcagtaaaaagaaaaatcaagaaaggcgacagcaataatctgcttaaccactaatcaatccagcagcagcaacaatgctttaagctgcattcttccgtgcgtgtcggccgggcgccgtgcggggccccgaacgcgtcacacctggctggcgaccttgtcgtccgccgacttgccatcggcgtcggcgtcggcgtcgtcggcgacgaccttgttggtcttggcgtcggccatctccaccgcggcggccgccttcttcgcgtcctccacctcgtcggcggcgtcccccttcccggccgccgccgccggcgtggcccccttgtggttccggtagatcgcgtagaggatcagctgcatcaagcccagaaagctcccgcatccattggggatctgcacgtcgtacaacacaacgatgcaatttcgtcagttaaactctttgcgtgccattcgtgtgcacggctatagctgctactcctatgctccctccgtctcatgaaaaatgaatatgtggcatatcctaatactacagatctggatatatatatatccagattcatagtatcacgaatctacgatgcgtcatatctggttctatatttgtttttcatggaatgaagggagtacgtacgtacgcccaacatgtgcgcgccaagttggacgagacaccgaaaggataaccgacgccgccggccatttcgcggcattgagttgcaaacagcgttgcttgtgcagtgcagtgctgtgcttttgcagcggtttgcatgtgcccatcagacagtacgatcaatcgagatccaaacaaaaacacaaaaaggcatcgatcggattggatcatatgtctcgtcgtcaggttacgtatctttctgtaatcaacgtcgacaggttgcttgtaggcttgcagcaattgacagcgaaaagaaagacgatgagtaaattaccgcgatgaaagggtcgcggccgagcaggccgtagatgaaccaggaggtgccgcacaggaacacggacagggagagcaggaacggcatgaactccacgctcttcgtcttgatcaccagcctctgcacaccggagtcaattgatcagcgaatcagattatggttaattttgttagttattactccctccgttcacaatgtaagtcattctaacatttcccacgtccatagcgatgttaataaatctaaacatatatatctatttagattcattaatatcaatataaatgtgaaaaatgctagaatgacttacattgtgaaacgaaagaagtactatactagatcatttgtgtggtgtgtactgtcttaccatgatggagagaggcgaggcgtacatgcagatggagaagatggtggcggcgaggccgcagaagagcttgcggccctggccgtgcagggccaggagggagacgagcaccaccatggtgaagatggaggtgacgaggcccaggagacccatcatcttcagcctggccttcctctccgcgaagatgaggaagatcaccacgtagatggcctcgatcaccgaccccgtcccgttgatcgtcgtcaccaggatgttgttcggtgacacgaacggcagcccgtaccttcaaccaccattcatcgttcatcacaaaccaacagcaatgctgtaattctggttttctttaaaaagatatatatatataagtttcagttatagttatagatcggtagatttcagactgtatcttgtcaacaaaactccatctggaaagaaaagttttgactcccagaagaaagcatgtgggcatgcacacacaagagcggaaaagaaggagattttcagagctggtgcgatatggtctctacaacttttatgatattgtgctttgccttgatattttggtactaacactaacctgcgaagaatcgactcgcggatagtgtttctcacctgccaaacacacacacacacacacctaaaatcatactggcccaaaaaagctcacccactttttcgagctacaaacactcgaacgtgaggctgcatgtgcttgcacaacggcctcttgggcccacatgtcacagccatcctggccatgccggcagcaagggctatagctgctgctgcacacacaccagtgatacagtgtgtgtacaagttccttcgcaggagtcactgtcacagcgatggcaggtgggtccaggagtagctttccatcgacgaggcaaattggacagaggctacactaggagccaaccactgtggttcccatcaacagtatcatccagtgtttccggatgaattacggcaataggagtaaacatcaagttaactttcagtaatcagtagtactattactgatgagtcaattactaggttcactaaacttgctcatgttgtggagtagtgtgtgtctatcgagaatcacacgaaacttctgagagaaaacgtagtgtaatgttgtggggggagaaatgcagatggtgtggagaggagtgtgaggtttcagttagttaccaagcagatagcaggcagttgagaagtgtcatgttgtaaggcacgccggagaagtcctccgttgatctcttcttgatgatcctccagaaggtgacactgtaaaatgaaaaagagccatcaaaattttctcaccggtcagaagaaacaagcggcattcgtgcgaccgatgcacacgcatcaacgcatgggtagctgccggtgaggccggcaaacaagcaagcaggggaaaaattgcaagattttttaactttgataacttcttttgcgaaaaaggttgaccaaatatcatggtagatgaaactaaggagcagagcaagctgacactctnatgaacaaaaaactctactatgttagctccttttttttttccagacacagagactatgagttacaggtatcttttgtttcttcttcccttttcacttgtttttttttccttcttcccacctctgctcacacgttacaagacctcacaaattgggataagattgacgataaggctaggcagcaaggaatcagaaacttacactggcgaaaggaacaggaagagagcgatgacattgcctggaaaacggagccaacaaaaaacttagaacgaattcacagtagtgtaaaacttcaccaaaaattaaccagcaaagtaggtagctctaggagcacccatacaccttcatttcttcgagtgttcgaagatgggagaaacaaatactacatgcacatatagacagataggaaattaagaacaagctgcagctagccatggcggcacactcaccggaaactccaaagaagaacctcgcgatgtgctccatttcgatacgtttatctctcctccttgtggctagaatagatcgcttctagctctcccgagagtactgcgctgaatggatggctggctttgctagcttctcagcggtggactactgctacacaacactacaacacggagctacttctaccaatgcggtgcctctgtgtgtgtgcttatataagggagtggagatatacagagcaacactggtgtgtagagaaatatgccaagctttttttttttaacgaaaaacagcactagagtgacttttcattgaacagggcaggagaaaatacaaacccctaggggtaaaaggaaaacggagaaccactatagctgtacactatacatagtgcgggattaactcacgcaaccgcttagctcctgctaaagccaaaaggcttgcctaatctttgattttcgttagtaggaagttcgttgccaagcttaaacagatgttgtttgaaatacgtacgacgataaattttgctcctaatctatgtgaagacagatatcagtaaatttgtcggtacttttatttcattgtgtttttagtagttctgtaggagcataaatatagagtagatgtaggaagccacaactattttgtgaaaactatcagtacactagtacaactttagctatgcaatttcatagaaactgcatcgatgataacatgatttaaacagaaagatgcaactttatatgtccaatatatttgagcccacacgccatacacatatgcaatactcgtgttgttgcatgtcgggtttattatgtcatacacacgtagaggatggagttacgattttcaaataaattattgtcattttccgtaatagctcgacaaagttgtaacaaattgttactttttagcctgtgttcagctgggctaggctgtggtagcagccagtttgaactaccgcagccgcagcggctacaacagtaagtgcctctgaataaagccttaatcatgagtaaattgcgttgatgacatacaaacttgttagataactatgatttagtacacatactagaaaaaccgtgtggcttcgccacgcatggtaaagtgaacctagctcattcgactttagtggagtaactaattagggcccctttacttgaaagaaaaatataggaacttttattctgtatagaaacgataaactttgctataggaattttttctatatgattctttgaaccaaaggattattgaaaactattgagtcttatcaaatttctaaggaatgcccaaattcatacaagttttggagtatttttaacatgaggttcaatatcatgcgaagtctcttatgagtttatctctctcatctaattcttgcatttttcatacggtccaatcaaacgattatttcatatatttttatgtgttttataattctttgttttgcgcttgattttttgtcagaattttatgttttccctattcatccctcaatcttcgtttcaaagtagccctcacaagacatatataggttgcattggaccgagggagaacagagaaagggacaattttgtttgtacaattgtacccctactttgatgtcaataccgattttaccctacattttagggttgttgttttttgccctatttttttcaataaatgaggcgtttacccctgtttttgatggaagtgagtgggattggacttagtgcggtaaagaattagagaaagaaagagataacgattttttaaattattgattgacccttttacccctagaaaatatccatgtaccgcttggtgtccctccaggcttgggcacttggcatcaactcttcccttcctgaacccgaatccccgttgtgaaacagtggcggcagtgtccgtgggccggccaggcaacggggacgacccgagcaagtgcaggccacctaacccagttgcagcgtgtaggaggaggctaggcattgtacaagaggccatggtagagaggaggacaatggcggctgctgtagctcagcgtagggaggaggtgcggctgctcgacgtgtcgaggaggcgacggggaggaggacaacaggtcaacgacggtggtggtggcttgatgataagatgaggcaacagcggcggcttagcgcgaggaggtgatggtggcggctcgacgtggggaggacgtggtggcggctcggtgggaagaggaggcaacaacggtggcggcggtttatgagaggaggcgacgacgacagcttggcacaggtaggcaatagatttgcttgacttgtttgtttttctcaagatgtcaaactttgaagcaaatttttgttgatatttatgttaaaattatcatattggtaaaagtttatcgaatttgcaatgttcatgtgctaaatgtgggcaaattctcaatcatgaacaaaaacaggggaagtttgcaacatgagtaagggtattgaatgccttctcgctaaagatttaacatcgttaatctgtccatcaaaagtagggactaaatttatctttatttcaaaaaaccatgggcaaaaacaaaaccctaaaatactgggcaacatcaatattaaacatcaaagtaggggtaagaatgaaattgccccaaagagaaaaggttatatgatttctatagaggaaaacacaggaaagaaataatataaatcacatgaatacggatacaaaataaggaaacacaataactgtaaaagaatggatgtttgcaacgtaggaattatagtgggtgatttgattacatcctgttaatcctcttttagtctctaaccaaagtatgtatcattacttctttaatcctcaatatccggtggtaggaggaagcaatagctgcctgagctttgccagccgtacggcggcaacgcgagaaatcacatagcctgcacgcgcgcaattagcaggatcgagccgtcccgcgaaaccggcgttgccacgtggcacaattcttctttcaattgtttgcatggaattcgtattataagatttgtaaaatgctcattatgatacacatatttgtctagtgcataagaactagtacaaaacgatatattgtgactaatcatattgaattagtaaaatgtctgcacgcacacatgaggacgtgagatatgtcgcatgtgtaaataattaacctttatacataatatttattttattattttattatattttttttaatatgtataattaacatggcttattatatgtttgattggacatatgtatattatatgtcttgacatacaagtctacataacatcccaagcaacatccaacttattaaaattagttacgacacgttggttagctttagtttgtacacactagataacttcgtgaccgaagtgagcgatttacaggttcatatattaaatcggacctaccttggaagttcatatatcagtagtgtaatttactctttaatcgtataattgttctttttgtagaaagatactcataaatatttcatttatagaagtgatggttggcgatatacgttattgacagtgtccatgtctagagacggtgagaactaatcgcaaaaggcaaaataaattaaaaagtaaaaagaaaatgaagggaatggctattggatgaatgttcatctgaccaacctgtaaacaatatgttgtctttcttatctacacgtttatttataaaagcttctggcagctgtaacttatctaataattataagttttcccccaaacaattcagatcatcgcctatgttctaatagtccggttgtataatctagaaaataaactaaaagctgagtttagcagcttctccagattttcagaaactgaataccaagatgatctactcaagtaaaacctcagctctcctactttcctccgcaatcaccatccacctccaactcaatgccacctccaccagtactactgtactagtgcacaccccttctccggctgcagtcggtccgcactgtccgcggcttgagaattcagacaacagagaaaagctacgtagtagcacacatacgtaccagccaaatccttcggcggtggaaccagcgaaatttgcgtggacgagcgtgtcgttttggggacattaatattgttgtcgtgcgcgcggccccgcactgccccggcatggcgaaactgcaggtctctgctcctcgactcctctgcaccagaagttccgtgctatttcacgagaccaacatgtacatagccagtttactcggctagtccactagaatcagcggcagagctggagtaaaccacagccacaagtgactgtacccctcccctactgatgggcacgttcagagagtgaacaaccgcacggagtttataaagtccaattttttctttcaagttcccctcttctcgttcattgatctggctagaataatgggcatatttttcttggctgtaacaaatgttggatgataattacagccacatcaaagatctgtagctcgtaatcatgatgtgaatatgcgttccaaatgctatagatttatttttaacaatttctgaaaaaactgaatcactgaatctagacgcaacgcttctcctaaacataagaacaaacagttgttatgtgaatgatcggtaagctttctcgatgacatgcaatctacttggctgcgtttgagagaagctcaaagagaagaaaaaaaatcatttcttttgcgcacacacttcctgaaccactaaacaatatctttaaaaaccatattaatccatattttaagtttcaaataattaatacttacttaattaggcatcaatagattatctcgttttatgtatattctctatttgtgtcttcttaaacacagacgtagtgaaagttttctaaatagaaagccttgttataggttttttcaccgggcctaaaatcttatatggcgtagcagctatttcctcaatttcaaaatataaggatttttaacatttaaatattgttgatgtttagtgcatcatttgttctatcaatcacctttcatttgtttttcccccattttacctccacgtactctctcatctccactcatcctttattttttacactaaaatccactttttaatcttaatttttgctaaacaatatataaatgcttatattttatagcagttcataaggttgaatcctccatttgacagctactaataatgatactccgttcgtattttgactttttgtttatactatttgaccattcgtcttatttaaaaaatcatgatactccgttcgtattatttgaccgttcgtataatgatactccgttcgtattatttttttacttactttattatttaaagtactttaagcacaattttttaaataagacaagtagtcgaacagtgtaaacaaaatgttaaaatctcttatattatggaacagatggagttggactctaaacttgaaattttaatcggattaacacggtcaatgccatgcatgtacacatgtgaccgagaggccaggacccaggagccagagacccagagtatttgacaacaggtctgggtagaacagaggccacgctggaattgtgtggactcttgaaatccgcaataattctgcatgcaccagctattgcattcttctgcctgataatgataattttctgcagttctctgctctgctgccatccgcggcaaaagttggagcacatcgcaatgcgtatttgctcccctacacggaatttatccggtgcgtgcccttttgtcctacggtagtacggtgtgagccatgcccttgatgctctctgcctgctcgaacatcgatatttcccccacaaaaatggagaatgtttagcccacctaatcaaagccggtctgtttcctcgacaggtccacgtcctttttttcaaagatggttcaaattcggtcgcgtgttaaagaatgaaagcacacaggatatatcaacagatttgggtgtcaatgtatcatcgcccatcaaggcctaatttagttcctattttttttttctaaaaacatcatatcgaatctttggacacatgcataaagcattaaatataaattaaaaaaactaattatataattagggaggaaatcgtgagacgaatcttttgagcctaatcagtccatgattagccatatgtgctacaattaggctcaaaagattcgtctcacggtttccagtcaagttataaaattaattttgtcattcgtgtccgaaaaatccttccaatatccgatcaaacatccgatatgacacctaaattttttttcactaactaaacaggccctaagttcctttccttttctgctgaatgtagcgtccaaaccagaaactgtatattagctccaattcatacatatctctagatcgatgtgtttgctagctcaatcagtgtatgactaggggagacctgcaagtcacaaatcacgccgtgatcctgattatgatgtatcacgtatgagatgatgatccgtcggtccagtttgtcgtccttaatctggcagataagatatggcagcaatttgaacccatctactgtatgtgaccagagtcttgcactgacggcaaactgaccaagaaaaattttgtcattgactacgcggttcaccatcatttaaaatgctgacgtacaaaaggtagtactatgatatatgtacactgtactggattatatatatcctttggtttatttgaaacacaaattgtgcaatgcaaagtatgatgaattaatcatgcaacaaacgcgaatcttaaaaaggggagaaaaataaagaaaacagcgataagtaccttgcattacgtgtggacctcgccaaggtgtccatctgatggcgctctgtgttggctacatgcagctaaaccagggacgctgcatagtgcacggccagctgatccgaaccgatataccggtgacaaaattcgcagcccaatgattcgacgtccgtcttatccttcacatgcgatgcatatatactagccgagctgcttttgcagggtccagaaaatgaggtaaactttttggtttggctttgtacgttgcacatattctctggaaattaaaggccttgtcgttgagcatatcttacaaaaactttatgctcatgatgtggggagaacgtactgaaaatgaaatgccgggtagatatttcttctggcagatgctgttgtggtcgtactacatcatattcgtgattgattcgatcatatcagtgacagagttaagaatttaatcccgtggattaattactactagtttgtatttaaatgaaattatttatttattatataaaaatcaaattctatagaagtgttttttaaaaagctatagggtaagccaaccctatagtttatgcataaattcatccctagtcgaataccattacttcataatttagtggggtcaattttataaattctaatgaatttacaagtaaatagacttttaatagaactttagtaagattagggatgtctcgctggtttcagcttctaaaattatagttaaatactctcaaatcatcattaaatttagggaaaactaaatagctcattagttaagctctatgttaaccttactttttaataatttctatatccgtcactgcgtatacgtatatgtgtacgtccttatccaagcgacgacgtataggaagaagcctcgggataccggtcaaagtcggcatcaactccatacggctgcgtcaacaacaagacgacccggtcccactgtggagtttacgtcgaactgtgaacgacgctgttgcccaccagtagtagaactagaagcgtggctgatccggtcacggacagtgtcgccacgcaacagagaagtagtagtagccgtactattcgtagactctctgtttatgggtgtaaatgcgttcgtattttgcgtcctatatgtgagggcagcagtattatcccaggcggatcctagagtaaaaataacagtgaagaccgaacaaactgacaaagcttttaccattctttctcatgaatacttcctccgttccaaaaaaaaaaaatctacgactagagatttatagtcttagaatatgtcacatccaatactatattggttttttatgaaacggaggaagtatatagaaaaaaatgatagtggggttcgagcctcctccgctcctacggtagatctgtcatttgtctctggttcagcaattaaagttaaacacgaacccggatgatattgtggagttgtgttcaaccgtact

SEQ ID NO: 13571 - DNA, 17173 bp, Oryza sativa
tgcctgaccgacccagatgcgtctcactcgatgccatccttcaatcacctaattaggtgctttgttcgtaaaaaaaaaaccaaccgaattaaagatgaccattttctaatgcaataaatctgtacatatataatttagtcgaggatggaacgttttctatgacaataaatctgtacatcattgtcctataaaatgttctacttcctccgttttacaatgtaagtcattctagcattttctacattcatattgatgttaatgaatctaaatagatatatatgtctagattcattagcaacaatatgaatgtggaaaatgttagaataacttgcattgtgaaacggagggagtatcttaattaggttggttttcttttttttacgaatagagtatgtacaatccaatcattgtcccgagagaagatcagatcgacctttcggcgtgtccgtcgtgtatgccatatatccagtttctcgagttcttgtcacggacttcaaccaattcttcgtatgctcttgagtagagtacaccatacggacagtagtagcgtggttactttcagcaaattcagcttgtgttttgttaggaatggacgacaatggatcgagatactgactcaccagatacagcatacgtacgtttgttgttgttgcatatgcatgcgacgacgatgcgcgcgtccggcaaacggaatcctaaatcacacctactaactttggactgcccacggacaccactcgtatatgaccatatgtgcaaagttgcaaatgcaagcaaacaaagcgaacgatccttgaacggcactgtcccactggctaataaacctacaccttgccacatgctactgaatttctagacttgtagcgactcgaaaaagttggcacaagaagctgcaagaaagcgatcggaattcggaatacagcgtcatctgttcgtctctacctgcctgcctgcattttgctgccatatcattgttgatcacaggagatgataatacaaatgggcaagccctgtttaagttcgattaagggtgtgtttagttgaggaaatgaaaatttttggatgtcacatcggacgtttgaccggatgtcggaaggggttttcggacacgaatgaaaaaactaatttcataactcgcttggaaaccgcgagacgaatcttttgagcctaattaacccggcattagcacatgtgggttactgtagcacttatagctaatcatggactaattagactcaaaagattcgtttcgtgatttcctcccgtgtaattagttttttttatttatctacatctaatgcttcatgcatatgtccaaagattcgatgtgatgtttttaggaaaaaaaattttagggaactaaatggggcctaagtacgcacataaaaaaagaaaaaacacccatcggtttataattaattaagtttcgatctttttaaaaataatttatctaatattttaaaataacatttatataaaaagattttaatatgaaatgtgttgttagtagtttgaagaacgtgtaacaaaattcgagtatgggagagttaagagcaagtttaatagtatagccaactacttactctaattcatctatatccaatttaatagctcatttatacaatagttacatactacaatattaatacatggtcccacttatcatacacacactgtgttttagagtccgtgctacagctggctataaatctgtagcccgctcctcttctctcttctcatttatcttcttaaaatatatttgcagctggtttataacctgctattgtacctgctctaagagcaagtttaatagtatagcccactaataactctaaattatatatagccaacataatagccaattcgtaccatagttgcttactatgctattaatatctggtcccaccctgtcatactcttattacgtcttggagtccgtgatgcagctggttacatatatgtagcccactactattctctctcttttcttatcctttaaaatatatttatagctggtttatagcctgttattgtaccttctctaagtatagcagcacgacaaagagcttttggccttgtggagttgtgggggagtgagctgcgagcaaattaaaggtggaaaagtgcacgcagaaattggctggctctacgcgccaacatgattcctggcccacgggcggatacgtgacaggtgaccccgagtacccgacgcgatgggaacaaaaaaaaaaagctggtttttgggcaagagttcttggatctttcatcatttcgtgcaattcggctgattgccggggcagcgaccgtgcactagcattcccgtcatcctgttagaaaggagaagtctgtgcttttgcattttcagtttttcatggtccagactacactcaatttttctgagaaacttatgttcagactgtggtacctgatcattgatcaatcatgaaagctagtatagcttccatctcacacaacaacaagttctcaatatgttagtgcatgtatatgtctggttctttcatggagttcggcatgttgctcatgctgttcttgggtcaggttctggcactgcgtctctctctctacgctgatcaatacatgggctggtgatatggtgatttggatagcgatgtgtcaactttaattttgggtgcacggttctaattgatggccggatcgcaacaggctaggctatctcttgatgtgaccgtttcggaaaataagagaaagatcttctgttgttacgcgacttaatggtggtatggccttcagcttgaagatgactaattggtgcaggtcattgcagaaagcctatagcgttctctctgaattatgatgaatcaatggcaggaaagaagatcgcatggccttctgccgatcgatcatgcaagctgaagaaaaagcctatagcagttttgatctgcctgtgtgtgaccgtgacaaatataaacgctccctgaaacgaagggcggtgtttcgctaggatctcatttctcaaatcattgttgtgcaattgagcattgccgttcatcaatggatctcattatttccttcagtttaacatgatcagattttgaggattcacgttctctgcttgaaattcatcgcccgaacgaattaatatacaattgatgcaattgatgatgagcaattgataacaatatatggagtagattgcatcccggccgggcagtattcgaggggacacacacttctttcccacctgtatgagctggatagttactttcttgaaactattattcttgcctggattgctccgccataaataggagtccaccgcttttatttttaaaaaaccttggggctgaaggcttctacatatgattctggttttccttgccttgtcgactcatccgcgtttcaggggcagagaatgaagggcaacatacagccaagctcaggaaaacttcaaatttgctactgatgagtgtacagagtacactatcaccgcattaacatatactttctgccttctctagttctcttcatcgtttatttttgttttatccgtctgttttcatcatatcgtgaatctggctgtgttcatcaataattggtgctagtaggagtattatcctgtcaagaaacccggtttaacccaaaataaataggcgcatgcgattcaagactgcagtatgtcgcgcagcaaagtttgtgaaaccagaagaactggagtattctgaatcctactgctgattgcttcggtctaacttcaaacatagcatcttttgcacgttttcaggggtgctgaagatgacagtgttacaacggttcagattcttgattacctcctgaaacatccgatgctagacacatcacaaggcgactgtgacctgattcttctctttagattagcagttctagacccctactccctctggttcagcataaggtgtttcgatttcattataaatcaaacttccttttatgtttaatcaagtttatagaataatgtagtaatacttctatgccaaacaaatatattataaaatatatttaatggtgtatttaatgagattaagggcttgtttggataggtgccctaccaattttttggtagtgccaaaacataggcaagttttggcactaccaattatttggtagaataaatttgtattcatcttatttggcttgctaccaaaatctagccaaattgtgatatcatagtgaagaaagttctagattgctaccaaatttgagatgggcattactaaaatgttgacaccaatccaaacaaatggtggatactatttatgctaccaaaatattggtatggcaaattttggtagcaattcaaaactgccctaagttggtattataagtgttgctatgtctttttatatatacattctgaaacggagagaggactagcctagaatgacataacgtaatcgcgtgaatgatacagacctgacggttatctttgctctcgaagtcgaagtgtttaatttgaaggggtgacagatgaagaaagcaagcaaaattagccagggcctggctatgaaaaaaaatcatgggtcaaaccgtcaaagcccactagctttttcagagttaaccagcctggtcaagcccaatagacccactgcagcagtgggcctagttatgtctatgtgggccttttcccccctacaaaatgttctatctttcagaaggaacacactgcataatttgttcaacagaggatacaaggtgaattttaagtgttagcaccaaccataatttgttgagaatagctaacagtaattcagttactaccctaatactcttaagataactaacagtttcatcgtttggcttatgctcatacatgcttatctgtattgcttattaaaaaaataatttacagataaaactcgtatatgcatgtatttaacaattcaaaagcaaatgttatagagtaaactacaataaaaaaaactcacaaaatcaactgtaaaataaaattttaaaatttaaatttcactagcttatactccctccgttctaaaaaaaaaatacaaaccctgggtttccgtgtccaacgtttgacttcccgtcttatataattttttttataattagtatttttattgttgttagatgataaaacatgattaatattttatgcgtgacttgtctttttaatttttttccatattttttttaaataagacggatggtcaaacgttagacacgtaaattcaggatttgtctttttttttttaaagatggagggagtaagtataagcataacaaaacgacaagactgtaaataggtaatgctctctgcataagcttgagctgcaatcccacaggaaacacctcatgacggagcagtcaccagtcagctggaatactaaattaagcctccaaagccgcgtcaaacagacgaggaaacaccgtttcgtcagttaagttcaggccccaacagaaacaccgagagaaacacgcggcccaaacggccggcatccccctcaaccgctcgtccgcgcccatcaaccgccaaagacttcccgcgcgcgtctacatatttcttcctctccctccgtctcctcctactctcaaaggcctcgttcgtttaatccctctcacggagagaattgaaggggatttggaggggatttatttcacacctatcgtggtgtgaaattattcctcttcaatcccctccaatccctctgtattgggattaatcgaacaagccctaattcgtgagaagctctgatcgatggcgccgagcaagctccgggcggcgctgggcgcggtcaaggacaggacgagcgtcgggctcgcaagggtgggcggcgccgacgaggtggccgcggacctcgccgtggccatcgtcaaggcgacggcgcacggggagagcgtgcctggcgacgagcgccacgtccaggagatcctcacgctgacgtgctactcccgtgcgcgggtggccgcctgcgtgtccgccgtgtcgcggcggctcgggcggacgcgggcgtgggccgtggcggtcaaggcgctggcgctggtgcaccgcctgctcgccgacggcgacccggcgtacgagcaggaggtgttcctcgccacgcggcgcgggaggcgcatgctcgacgtgtcgcaccggttcccgcaccgatcgtcgcgctcccgcgcgacgtgggacttccacgggttcgtgcgcgcctacgccgcttacctcgacgacaggctcaagcaccggatgaagggccgcgtggccagccagggcaaatggtgctccgacggtcgccgcgacggcttccccgacatcaccgacgggagttacgaggtgggcgaagcggtagccgaggtctgggcgctggtgccgagggacacgccggcgacggggacgacgacgaccgaggagctcgtctccaaggcgcagcatctgaagcacatactccagcggttcatcgggtgccgcccgacggggaaggcgaggacgaacaaggtggtggcggcggcgctgcacaggctggtgaaggagagcgcggtgatgtaccgcgagctcaccgaggtgatggccatgctcgccgaccgcttcgccgagctggagaccccctgctgcgtgcgcgtacactccatcttcaccagcatcgccaagctgttcgacgagctcgacgagttctactcgtggtgcagatccgccacgatctgccgcccgtccgaaatccccgaggtcgagcgcgtcgcgcagaagaagctggacctcatggacgagttcatccgcgatagacaaccggcgtcgtctcggtggtggaggtgcacgccgccggcgccgtccagcccgcttgcccccattgccagcaatggcgacaatagcagcaaggcatcgccagctgagccggcgccggcaggcgcactcgtcgtggtcgacgaccacatggccgacttcctgaaccttggggaagaatcgacgccattgtcgacggaggagcaagaccgggatctgacactgtccctgttcggcgatgacccagcgacgccggcgccgaagtgggagacgtttgacgacgaccaatgcgatgactgggagacggcgcttgtgcagtcggcgagcaagttcgccgccacccagagcgcgacggtgcttgcactgccaccgccacctggggccaccggcggcgaggtcgcggacccgttcgcggcgtcgctggccgtgcctccgccgacgtacgttcagatgatggacatgcaggcgaggcagcggcttcttgcgaacgagcagatgatgtggcagcagttcgagacgcaacaaatggcggcctggagttacagttcattgttgtaagatcgtaaaaaacgaaattaatgttttagagcgatgagaaatttcaatgctaactatgatacacgctaaatgaagctgattttgcaccataattttgtgcccgagttggaaccaaatcaagtgatgcactcgtttggttgagccgaagcgtgcctaagttcaattttgtggcgaaattgactgttttatgctatagctgttgtccttatccagatttaattagtacctatgttttaaaatgttgctaattagtactccctccttatcaaaataaatcaatctcctaatacgaggtggtttatttaaagagagtgtgtaagataagatatttaacaggattatgaatctagacatgagttacgtcctatcaatttggacataagatactattagattcataattctttcccgtttagattcatacataagccaacgtctcgcttattttgcggaataaatgaaacggtatatttgcaaacgaaaaataattttcgaataaattttttatatacgtgttcttagcgatctaaaaaaactgaaaaataattcgatgaaaaagcctaaaaaattagctccaaatttaaggttgaaaattaaaattttggctaataaggataaggataagaaaaagatgaagcctatagttttataaaatatctaatcttctactggctaatattgggatggaaataaatgttcataatgtttccatcaaaattcaccccaccttttttaacaaaaaaaaaactcacctaccactgacagaggggcacagggctaatggataattacggggatgcatcccgaaatccagcgtgaaacctcccaaaaaagtagccacgaaaaatcaacccagataaaacacagcagccgcacatcaccctgacatctctcaatcggacggtggataccacctcaccgcacaggctccccgtgcgctcatccgcaccaaaaaaactttttcctcccgctccccgcaacccagccccttcgacttcccgccctcgcaccatttccgtgaaccagttccaccgaaaaccagaaccaagctcaccgtatggggcccaccggtcggtttcctcacgcgtcaaacaccggttccacgtgaggaagctgagctcgtggaccttcccgcctctcccacccaccgcgagctattaaaccccgtctcccccatcacacactctccccacgcctttgtcccccgaaaccttcacaagttcacatactcgcggcctctcctctctccgtactcgcgaagccacgctccgggccgttgtcttctgtgtcgcttcgaattcgggaagaccctagtcactgcgcggccgccgagtcgggatgccgccggcgagaggcgggaggcgtgggagggggcgaggtaggcgaggtggacgcggaggcgccgcctctagggcgcgaggcgagaacgtcgtagacgtcgagccgatcaagctcggtgatggtgagtaggctggatctgggttctggacgcgatcggttttgggggattttgttcgggctagtgatcgatctgggggttttgggggtttttgttactgtgcgtttggttggttcgagagtttgtaaaatcaaaccgttggggattcggattttattaggggatttctggtggattttttttgggttcaggattgtaaggaagtagcattgctgtttttacgtcctccgatcggttcttgatgaggctgggaacggtttcccccctccatttgtgtgctcttcgcgtatttggaggagagcgctatattctgtggcggaagtatgaaatacatttttgatcaaggcgttcgaaactccgtaacattctgatccccacatatttggcagatgatgcgaaggtagatccacagacgaagtcacctaacgaagaaataacaagcgcggaggtttgcgaggtggagacctctgaggctagcccgcttggtgccccggaggaaggtgagattgaaagttcaaacttctcggacggcacggggttggtaatttgttatacccttatcgtttcggcttaatcccggtttcgatttatgcagatgaggggaagccaggttccactaggaacctgaagcgtcttcggaagacgatcacgatcgattccgcagccgctgaggagcatggggcagagagtgacgatgaaggtgagtgacggagtttgcttagctgacaatttctcggaattacgggtgccgcttgtcctgttaatgtgtagtacggttgtttgcattgtgttcaccttggttgtgctcagttttgatttgttttggcaaaatgaacactatataaaactccagatgttggtatttgcaatattagtctagaatgttgtatagctagtcattattattgtttgttttgacctgttgatttagagtttgatgttcttgccacagcaagttgccaagagttggctccatgcagaaggtccaagcgcctaaggtgcaaaccaactaggaagaggtccaaaccaactgggaagagggatttgggtggcaaggagagtgaagatgatgtatttgcaaatagctcgagcagttcccaggatggtaacagtgttatttacaatatattctgtcttgctgatcctaataaatttgtttggttgaagatttattccagattgatattttacagacgccgggaagttagcttctagaagatcaaagcgtctcagggagaggcttacatctgattattttgatggtgatgtgggtgaagacagacaccctgggaagtagctctgatgattatggtattgttacaattctcaactattgcatgatttctgatatgctgccagtctgctactacaaatgtaaaatttgcattatgtagatgaaaattgttcggctccccgccgaggatcaaaacgccttcggaacagactgggccccagaaatatttcatatgctgatgatgatagcgacaccgatgatagtaagtgggcaccctttgttatggcttgacataattgacccttttgtttgcagatcatgtgattttgtaattaacttcaatccagtttatttgggaaattggataacttgtagtttctcttctgctagaaagtcttaattgacataattaaaaaatactttgaaatattgtttaaccaaggatgcatttaaaacaatgtgaatagagtttttttacggaatggaagaaactatctattttcctcaatgcattctttttcaatatatatcttcattgatttgtgcactatgtgaaacttgcacctttcctatttacacgagcagaaagattaggacctaacagttgaatttattcccttctgtatagctaatatacaaataacataaccttgtttaagcatgttacattaactactgaaattaccacagatcgcaagaagattgtcccatgcaggagaacgtcaaagcgcctacaggagaagcggaaagctcatgatgtttcagaggtaagttaactaacaaaagaactcgacctactgttcttcatgaagtaataaatatctcatcgaaccttttcaggagagttacactgaagcttcgtcttgcatgttgtcgacttcttcttcatcaggtaataactaatcattttatgatcgataaatgtatcacctactttataatttaatatgattttgtggtcaagagattattgcaatcttgcattgtgcacaattaattaatatcaccgtacaaatatgtaaaatacctaggaaatattttgttttttactcctacctgttatacatggaagtgcgaagcatcaatgatccagagtcacatctaaacacattcaatattgttgatcacctttattcaatgcatttgttgttgcttgcatctataatatcgcatgaattgacaaccattccttctgtgcttcttaatgatttgtgtggaacctcagaatgcttgtcgtaaagttgatattacgtcgtgcatgtttcgctaatgacttgtgtctttcagatgatgaattattgcacaattctataaaacctggcagacgtaattcgggtggacctagttgttcgatctgtaaggtttgtcagcagttctgatttattaattttctacccccccccaatctttacatgaaatcctaactgattttttttgcagattggaattgcctgctctttcctcatcaaatgcaagaattccacttgttctcgtagcttccacaccttttgtcttgatcctcctttgcaagagattataggcacctgggaatgttcttggtgcaaaagcaatgcagcaccagcagtcaaggtgacagaagtgttaacatcaaaaaaaatccaaagacttgttggccacagacgaattcttcaggaggcagatttccagtatcaattcctcgtgaaatggcaatctctttctcatcatcatgactgctgggtatgttaaccttcttgctcaatctatatttggtgtctttttgaatgacttatctttgctgtctttttttttctttttctgtaaggcaataggtgtttgacttttcctttttctgtaaggcatacttgctagggaacctccctctaccaacacctttcttgtttgtagcagtacattatattgagtttctttgaactggtaccttgcattgtatatttcatttctttcaagtcatgaaactttgtattagcccttgctgctacaactaaaaaaatgtcatgctgcagctgctacactttgatttctattttaatgcaaacatacacatatttggcgtattcacaaaaaaaaaaacggcatcttcctaatgtttgtttatgatgttagaattgtatcctgccacactttgcctaatatttattatgtaattgctatacttgatgtggaccatgcaaatattgttccctagacacttaattatctactctctgtaggttccgcttgaatggcttcatgtatctgatcctttacgagtacagagctatctaaacaagaactggtaaatcttctcagtttcatgtttttctgtctaccgcctccagtgtaaagtttcttgtgttattttcttgttacatgtatttatcttttataattttttttgtgttcgtcaatgttgctaaattttttcttggatatactagttgcacataatctcgtacctgagtaatcgttgttcatatcattagcaaattaataatatgagcccctactaattttctaccttttttttcattaatcattactgagctattctggttgaacaccatgttgatgtttgccatttttaaaacaatcttgtttgtttataatcttaccagctgtgttctctagtgcaccatagtgcttatttttgttcttgtttgtgaacattgcaacagcttgcctaaggaagtttattcagaggatcaaaggaagcttgagtggtttgaagtagatcatgccattgcatgtcggaggaagttccatcatgaaggtttatgtgatgtcttggctactttccaggataaccaagatttcgacgggtatgagttccttgtgaaatggaagggccttgattactgtgaagctacatgggagccatgttgtaccgatggtgtgcaacaggctgtttctatgcttgtcaggaggcataaaaatgcttcaaaaagagttaacatcagccaaacatgtctagatggatcaaaaatagaagaggtgcactgtggtgctctatatgactatcaacttcaaggtttacaatggttaatagataacttcaaaactaggagaagcgttattcttgctggtatgtacataaactctaaatacataatccatgatgcacttgtacagttgtaccttaccaaattataatgcaccaataatacacatgtaaagaattatgctgatcagtttttattttgttgttttgagataatctgatttatcatgatgcttgtgaactgtataattatgtagcgtctctttgatgttttctttatttgtttggcattgtcttgatggaaaaatagcttgtacaactcttatttcatgacaaaactatgataatggggtatgttctgctctattggcagatgaaatggggcttgggaaaaccgttcaagttgtttgctttctgtaccacattattaaggaaagtttgactgcatccccagcattgatccttgctccaaagagcatcctcctgcaatgggaaaaggtttgtatatagttatgtgatattctgccatattatactgtatattatataaatgaatttaaaattttaccctgaatcctttttttgatattgcatttcagtttacatcaaatatgttgcattaatcctattttttggatgcatgttttgtgctctaggaattttgccagtgggctagtgatcttaatgttattgtttatcaaggagacagagactctcgaaagtgtatccaagtccatgaaatgtactcttctgatgggaaacctttatttgatgctctagtgacgagttatgagtttgtccaaattgacaaggcagttctacagaaattcaagtggtctacaattgtcagtaagttttttcttagatgaagtcccccattatttggtgttcacttgccggcattagtgtattgtctctgttcttttcttgtaacacttgagcatttccccactttcacttcagttgacgaggctcacagaatgaagaagcttgactgcaaccttgcagcttgcctaaaacgatactgctctgaatttcggttgctccttacggtatgtactgcctacttgacctgtaatttcttgtccttaattatttcttggaattttagaattggtttgttccttgtcactagtttgattattagtagtcatctgggcatgaggttttgaaagtgagatgcctggtatagccagcattcaaccatagtgagtgcccataatactttaaaaggggtgtgcattactgtagctgaggcatggctcgctcctactgctccatgcatcgtatgatttggggactaggattttaaatccattatctgaaaatggttcgcttctgtggtctttctgaagcaacttaatcctgtgctagagcctaatcaagtgctatatagccgctagagcctatataacatagagagatctggttagccctttttacagatatcatatatagccgattctttctccttggctgtcagcgtagtaattcttacgaagtgctttacaattgccctttctttaaaagaactatgttctgatcctggttcctcttcctttcactgtacagggaacaccgttacaaaataacatcatggaactgttttctttgcttcattatattgatccggatgagttctctgatccaaaggctgatggattgttctcaccaattgaatctggaagggatttgacaatggatgaaaaagttgctaggattcacaatattttaaagcccaggtgaatactctgaaataagtactatatatgtttaatatcttggacacggatatttttttgccgggttggccggaaggtttggtcgaccaatttcattattaaagaagggtattaaaaacaattgaacacggatcttaagtttcttgtttttgctaggatgttgcggagaatgaaatctgatgttctaacagattctatgccagtaaagaagtgggttgaagttccatgtgcacttgcagattcccagagagaactttacattaatattttagagaggaattactcaaagcttaacagtgccattcggaatggtgagttaagcgttctgctcttttttcatgctctggtaaaattttaagtcagattcactttgtaaaagcatatttgtccctatgaattacgtatgggaatatgaggtttttcaaatccctttaattacgtatggaaataacactgttagtcttgtttgtacttttgcaggcagaaaactttctctgaacaacatacttatggaactcagaaaatgctgcaatcatccagtaggttttactttctgttttgttgatcagatgcagaacttggtctcttttctcttagatgtaggaattgggtgtttttgcttttccgagtctctcattttgacagtgatttgtgtgcagtggttacagaaaatttgtagcaaacgagaagcttaaaattggctttaatgtatcagtttgttaaactccattcttacaatcctgccttctatacaaggaccactagaccaggccttgctccctccgatcacccacaagctcacaacaaagagccctttttaagtagatgtgctgtttgttgtgcatgttaaatttttctgctgtcctaagatgctaagattttgcctttcagtatctatttccaggacttgaagttggacagcaagcaactgaagatgtgtttttatcacttattgcttcatcaggcaaacttcaacttcttcataaggttctttcgagacttcatattggaccttatattgctatcatatcttagcactgcacctgaagtttaaactgctagaaataacactgctcaattgctaaattgcagttgctcccaagattgaaagaaaggggaaatcgtgtactgattttctcgcagatgaccaggatgcttgacattcttgaggattttctttgttccctgggatacaaatatgcacggtatgcttcattcgtctaccttctatcaattctctaaattatatgcttcagactttcgctgctcttttccttgtatatctagtaattgaatgacacttcttttggccatttcatggctgtgttaacacttggcagcatcgatgggcagacatcactctctgctaggcaggagagcatagaagagtacaaaaacattgatagtgaaacatttattttcttgatgtcaactcgtgctggtggcatgggagttgacctggtaatgtattatcatatcaacttagttctttcagttgaaactgttagcctgtagggcaagctcttaaccagcaactgcaatagtatgattatgcctctggactgacaaacatcattataatttgcagcctggtgcagatagggtaattatatacggtaagtggttttaaatgttttcattcactgctaattatataatttgcaagtggatacttgcactgatttggccttcctatttccagatcctgacttcaatccatttatggacttgcaagcacaatctcgggctcatcggatcgggcagacaagaccagtggttgtttaccaactcattacaaagtgttctgtcgaggaaaagatactgcagaagtcaaagcagaagttggccatcgaaaatatgttgatgaactcttccaagaagccaagtgctgatgagttgcagtctatattactccatggagcaaagacaattgtggacaggaagatcagtgcaacatccatccattatgacaatgaagccattgagaatctcctcaagttagacccttccactggtgagaaatgctcgtcggatgataacggttatcttggcagcattgtgagctttgctcatggcgtcgaggatgaagcaccttcttccccaaaggttgaggatctgaaagttctcaagcctgctactcccaaggttgatctcggccgtgggaagaggcaaaggaaagtcgtgaactacgctgacgaggttgagaatgaagacagtgatgatatgtatgccccggaaggttcgtcgacttccgaattcagcagttcgtcctccgatgatgaaactgacagcgctctgcagctgcaaatagttacagtaccggacattgatgcagattaggtgtacaactctgtttcttactttctgtttgcgtctttgccttttgggacccttgcctttttagtgaagggatggaaatagaaggaagcttttggataggagcagtatatatttaaaggttgaa

SEQ ID NO: 13572 - DNA, 14056 bp, Oryza sativa
  unsure (1)..(14056): unsure at all n locations
tgacgagaggatgccgtgacccagacatgtgggccaacctcgccaaggtctacgcctccaactccttcctccgggaggccgctatcatctactcgaaactactgccccatcgtactcaccacctgccccttgtcatcgtcctcctcaaggcaaccgcctccgcgcggatcccgtcctcggcagggccctccacgcggaggccgtgaaatccgccaacgcccacgaccgcctcgtggggacgacgctggtgtccgtgtactgcaagtgcggcctcctggccgacgcgcgcagggtgttcgacggaatgctggaccggaacgccgtgacgtgcaacgccatgctcgccgggtacgcggcggcgggagacatggtgagcgcggaggcgctgttcgccggcatgggctcacggactcccgtcacgtgggcaacgctgatccgggggttcgcggggaagggcgacatggcggaaacgcggcggtggtttgaggccatgccgctgggcatgcagaacgtcgtcacgtggaccgtggccgtgcaggcctacgttgccgcgggggacatggagaccgcgagggagctgttcaacaagatgcctgcgcggaacgcgtttgtgtggtcgtcgatggtcaccgggaacttcaaggctggcaatgccgacgaagcgcaagcggtgttcgacaaaatccccgtgcgcaacttggtgaactggaacgcactaatagcagggtatgccaaaatgggatgctgcgagaaggcactggaagcatttcactccatgctaaaggacaagatcaagccggacgagttcaccatggcaggtgttctctctgcctgcgcacagctcggttcgctagagcaagcgagaaaggttcacaatttcatcatccagcaccgtatccggaagaaccagttcgttatgaatggcctggttgacatgttcgccaagtgcggtgacctcgctttcgcacgaaatatcttcgacaacatgcaatggaggaacaccgaatgctggaactcgatgatctctgcactttccagccatggacagagcattgaggctattcggttgttctccaagatggagtgttcggagcagaagcctaatgagatcacacttcttgccgtactcggagcttgcacacacggaggatttgtagatgaaggactaagaatcttcagcaaattcgatatttacggggttgctgctgcagtagagcattacggctgcctggttgatctcttgggccgttctggaagattgagggaagcttatgagattgtcaagaacatgcttgttgaacccaatgaggtgatctggggctccctgctcggagcttgcagggtgcatggcgatgcagagatgtctgaactcgtatcaagtgagatccaccaattgcactcccgtcgtgtgtcaaccaacgatgcagagtacatcttgctgtcaaatatcatggcctcgtcggagaggtgggagcaggctgaacgcatgaggagaaagatggcgctccatggagttgggaagaccccagggtgcagttcagtggagctcgagattactgaacaccaagtatgtgcaggcagtggtaagttatcccagctacactgactgcattttttgcatgtcccaaatgttcttccgaaagtgttttcacaagttgcccagaaaagaaaagcccctcatgtgatggatattctattaactgtacttcttatacatagatgattagacaaggacattagattattagacaagggaattatctgttctgttgcatccctttatcaactggtgctggcatagaaataactacacacttcgtgtcaattttatatgctaatatcagtcaacaggcacaattgaattatgtatttgaacatcaatttttgtggttgaaatgttaaaagaaaaatcttcactaacgatatcagaaaatacatttctgccaaatttccaagatcaaaggcaccaaaacgacttcagggtgcagttcggttgagcttgacatttctgaacaccaagtacacgcaggcagtggtacgttatcccaactacattaactgcaattttgcttgtctcaaatgttctggcgaagcggtttcacaattggcttgaaaagaaaagggattttctatcaactagtatgcttcttgtacatagatgactgtacaagggaaatttataatctgctgcatccgtttatcaactggacacgatgctggcaactgtgcaattccctcaataaaaaaacggtcatgtcaattttatatgcgaataatgtcagtgtgcaggcacaactgaaatgtgaaatgtgaaattctgtatttcaacattaatatttgagggttcaaatcatcaaatgtgaaaagaaaccaaactatcttcactaatgataccagaaaatacatcaacgccaaatttccaagatcaaagcaccattaactattaccaatttactgcattgcaaagagaacacaagaacagagatgataacgaaatggcatgatcatctaggactgggaattcagaattcaaccaagacaagttaaactagacaatcacttccctatcatagatccagctgaacttgaccttcctctgctcatccttcttagccctgtcctcagcccgctccgcggcccgccgcatcctcttcgcgagcccgcacacgaagtcccgggccctccggccctcgccggagagcccagtctccagggtctccagcttccaccgcttgacgaggaactcgacgatgtcggcgtagtcgcgcgcggtgtagacgttgaggcgctgcgccacggcggcgaagtggtcgaacaggttcatgtcgcggccgtcgtgcatgaggtgcgcgggcatggtgatccgcttgtgcatcatgtcggcgatggcgagcatggcgccgtccgggtcgagccgcagcagctgctccacgatgcgcccgtacgccgtctcgtgccgcttctcgtcggcggcgatggtgccgcaggtgcgcgccaggacgtcgtccccgtgcgccctggcgaggcgcgccgtgttcccgtgcgacacggccgtcgcgcgctcctggaagctggtgtacacgaaccccaggtacgggttgttctccgtccccggatcctgccatggattcagcaacaatgctaagcaaaaaaaagattgaaaccaagcagagaaatggcatcaacatttcgagagattcgtaccatgccggagccgatgaggtactggacggtcttctcgaccatgcgcatgtcgacgcggccggagaggtacatgtacttgccgaggatgtcgccgtggcggttctcctcggcggtccaggtgcgcgtccagacggcccaggggcaggcgctggcgccggtctcgtcgcggacgccgtcgagcgtgttgatcatggtctggtacgtcggcagcgcctcctcggtaatcatgtccccgaccagcacgacgaagtactcgtcggggagccccgcggcgcgcgcgcggagctcgtggacctggtgctcgaacatctccgacgacgagtccggcaggaagtccgtcggctgccagcactcctccacgggcttgagcagcggcagcagcgacgacctcgcccacccttccagcgaccggaacacctccgccttctccggcggcatcgagtgcgtcacgcggcgccgcgtcgccgtcgccgtctccgcggccgtcagcaccgccgcggacacgcggcactgccggcgcgagggcgccaccaccgcgccgcagccactgacacgcacggttcccacgacctgcatgactgccactatcactgtcagtcaactacagtagctagttggtggttggtttcttgatttcttctgcctttctgggatcgccgagctgccgcggcgtggtatatgaagggaggggattcgcctccaatggtgggcgaaaccgaaaccggtgggtggtgcagtggttttgtgcgaacgagccgatggtgtgggagagcgaatcctgtgggtgctcgcggccgttttagccacgctcacagctgggtgcacggctagcctccacggtgtctgaggctcatggcttgtctccatttttggccagtgtatcgggtccacagatcgtagtgaacacgtccgttgctttccagtttccaattttccataccggagatctggctgtccctctcgatacgatgtcgccatcacaaaagggaccggggtcaaacggtactttgtccagctgcatgggacaagtaatctggccggcagtgacgtggccatgttgggaaaaacgagctacggcgagaatttttactgtcaactgtggagaacaaggtgaccaactttgttgaaatgggtggttcgtttttgttctgttgtgtgagataagcaggctggttatggtaaacaccgtggtccgcccctggatttcactaccaagcggaacggcacgtgcggcttgtgcatgtgcagcgctggtccatatacaagtggcatgcatttcgcggacgcgctggctgcagagggattccccgagcccaccaggcgccgccaccgcgcgctgctcgcgaggaaacaatcgagaccaggctggcctgcccctggccgtctggcgccgcgacctgcgacagattcaaaccaaaaccgtatgtaaacccactcgctcaccaagcggtttcgtatggccaagcatttaaccggagatccgcctccacgtcccgtgcaagttagcgtccgtgctcagcacgaactcgccattccttggaattaaatttaaaaatatactattgattcgtttttttttcataaatactcgggatgtaaatttgttagcagaaatatactgtcgatctcgcgcaaccgtttcgcataagtgacgtggacgtgacgacgcaaatagcatctataacaggtgtcggccccgtacaatgaaaccgtgacaccaaacgacgaaatcgaggacgtgcgtgcagacggcgtcagaccacacggtctcgcgcggccaaaccgcgagaccgagcagtctctctcaatcagtgagcgattacgacggttgaaaattgttaattagtgattgattaattgttaattaatcactaattaggataattaatcactagttattattcgataattaggataattgatcactaattaagtagaaccgctggacaagacgttcggtctcgcgatactgcgcggtgtgcgtcgtcacgcttctttgcacaacggttgtgcgagattgatggtatatttctgctaaaaattttatgccacgaatatttctaaattttacgccacgaatatttctaaggaaaaacaaatcaacagtatatttttaaatttaattccattctttgtcattgggttgacgagacgttctggaagccgttcttcttcgttatcacgccgactcggtgactccctggttcgcttcaccgaagcgacgaagatactatgttcggaacgagggttgggaaccgtcactccctagcacgtaaaataaaacgtatgattaattaagtattagctaaaataaatataaatatattaatatgatttttttaaaaaataacttttatataaaaaatttttcataaaaaatacaccgtttagcagtatgaaaaacgtacgcgtggaaaacgaaagaggtgagttgggtaagtagagataagaaaggagtgatcgcatcacaactcacaagcacatcaccggaagttttgcacttccaccatgttgtaaggaaaaagtttatattgcctttcctcaactatagtttaagtccgattcattttctcaccgtaacattaagactccttgaactagggttggacgtttggtcaaaccaaaaaatccggtctcgatctttgatcttctacaagtttcggttatctaaaaatagaaaccaattaatttaggaaaataatgaagatcaagaaaatcagtctcgatctcgatcatgactgaaatatcaaaagttctaaaataatcagggcaagtctaagttccagattaaaaaaaccatacacataaacacacacccacaaaacacaaattgactctcttcgctatcacgggccatatatcgaagcatgctagaggccaaaattcgatttaattgggttgctggaccttaatagtcttattgagccaaaatttgatttgtgcagtttatttagttaatcgaaggtactaactgaattgaccgaatgaaattcggtcctttaacacctgatactgatcaaatttctcagctttttcagtcctagttccggtctttttggttcggtttttttctgtctaccctggcttaacaaataaaatgaggagtgaactcctttgatggtttgctcagcggtttcaaccgacgtggcgtattcacctggtccacacgtgatgagtcagtatacacataagcgtcgatattgacgtagttaataataataataataataataataataataataataataataataataataataataataataataataataataataataataataataataataaagcaattagtccatatgtcatcctctctctcctccccactccccactcccctatcttctcacacatcggccatccttcatcttcgtcaagtgcactgatagcctaatccctccttttgccattgagtgtgtcagcggttggatccgctggggcacatgcaattcaaggttgtcagtaccccaaactgtataatattttacgatactaggatagtatgctacgaattcaaaacgatatcgatctcatctaatatcgtaattttcatagttactcgatcttactatttatttccacacgatcctacgaaatcttggatagtatcccgatattacgatctctacgatcctaccaaatattatttaataaggtggattgaaaataatgtgataaatatgctcaagtttacataaaaaccaattaaatttatcaaaatcaatattatatattttaatttatacaacatattatatatcttatataaaattatgtaatttctaaaatctgatagtcttacgatcctacggtagtatctagatacttattaccttggatcatggttgcaccgatccaacgacgaggccaccacctccaagcactagtgccggagtgctccttcaatcctctcaccaccaccaccatcgttgatactctctgccactactgttgatgatagcacgttattatacgccttgcctctagctggtctctcctcatgcttcaaatccgcaccagtggcggggtggacaagctcgggctcctacttctcaatcgaatgggccacctacacgtgggtcctgatttttttttcttcgttaattgtaatttataaggtgagggtggaaaaattacacgtgatttctacagtatttttttaaaaaaattcatgtaggtgtcatattggtaaaatgaattgatagttgagataggcttaatgtttggtttaacgattgagatagagaaatcagactatgaggtagaatagacctttttcccggtgcgaacagagttggaaaaagtacaccgaaggtccctcaacttgtcatcgagttataaaatcatcccccaaccgcaaaaccagatatccaacgtcccttaactaaccaaaaccagtcacaaatggttctctggtggttttgaccccggttttgtcctacgtagcggctgagtgggccccatatgtcagactgccacatcagcctcctctctctcttttccttcccctcttctctcccttccttatctctctctctctcccttctctgacccccatggctgccaccgccgcctcctcaagctctttgcccgtctcgctgtccttagctcccccactaagcgctgcaccgccgccgctgacttccgtctcctcccacgccgaagcccaataaggtggtggttgtctcgccgccacttccactctcactcggcgccgacatcgtctcggccgtcatcgtcatcgtgggcgccgcgtccatcccggacacgcctaacagcttcacgctgcgtgggaggctcaacgaggcccgcgacttgctgtggcgcatccgcagggccggggcggccaccgccgacgtcgacgccgagctcaagnnnnnnnnnnnnnnnnnnnnggaggaccggaggtacgagtcgggcgcgttgtggcggcttcttcgttgcaagtaccggccacacctggtgatggccgtgctaatcatggtgttcaacgttgatgtggcagcctgatatatggagtccacatgggtcccacgctgactcagccgccacataggacaaaaccggggtgaaaaccacggaaggaccatttgtgaccggttttggttagttaagggacgttggatatctggttttgcggttaggggacgattttgtaactcgttgacaagttgagggaccttcggtgtactttttccaacatagtttcctacaggaataagttcacttcatgacccttaaagagtgatcgaaatctaatccgtaaccctaaaccacaaaaccggatatctcgaccccccaaactcttaaaaccggtgcaatttgactcccttggtggttttggagagcggttttgctgacgtggcgccacgtggcacctacgtggcaatattgaccaagcctttgatccacgtggcgtttgacgtggcacttacgtggcattaaagttaaaaaatttacgtgggacccgtttgtcattcacacacagaaaaaatgtggggcccactaactgtgggacccacatgtcagtcctccttcctcctccctctctcccttctctctctttttctctccccttcttccccttcggccggcggcagggcatgggctgcggtgtggcgccacccggcgggagctgaagcggtccccgcagtggaggagtcgacgatggcgaggccagctctcggcgagatggggtcgtcgtctgttctccgcactagccggcgacaagggtgctgatcggtgccagcgtcaccgtggccttcttgctcctgctcgccttcttcttcatcatcttgccgcgcggcggcacaccgccggaggtggtatcgtcgtccaaggagggcgggatccgggggcgtcgcgatggcggcggcgtattccaggttgagagctatggggagaggtgcgagcacgtcgccgaggaggatggccatgatcgccggcgattcccgcgtggctacgtcgactacctgtacctgttcgactgcgtgttcggtgtggagcggcgggttcttggctacggcgtgatggcggcttggctcgccgtgctgttctacctgctcggtgacacggcggcggtgtacttctgctccagcctcaagggcctctcgtggctgctccgcctctcccgacgatcgccggcgtgacgctcctgtcgctcgggaacggcgcgctggatgcgctctccaccatcgcgtcgtcgcctacggcgggggagagggggagaccaccaccgtcgtcaggaaacttgcaattcgctcacaactcacacgctcaacctcactgaatctctgaaactctgaagattgtaagactgtgaacagtaaactgaaaaaccgaagaacagagttctgaacagagtggtttttgtgctgcttaagtctcaccagtcaccgcagcttctctgttttcttctctatttattcatctccatcagcagttcgttacatgcataactggaaagaacaagccagacttcagccccagccactatatgcatgcaaaacagaaattaaaaagctcaagattgcacatcagcgcacacggcatcatcgccgacgaaccaccaagatcccgacgcgagccagcttcctcttctctcgtcgccatcgtcccgctcccgttcccactccctccccgccgccgactgcctccagtcgggactatccaagaagagccgcggctgagcggggacgaggagcctcgccctcctcatcggtgctgaacgggcgcgagtggacggagcggcagccggacatgtcccccgacgccgatgcagttgatggagatgtggtccagcgactcgcgagccgtcggagaccgcgccggtaaccgcaagggcgaggatgacgagcagcatattgggccgccgccgccgccgttcccctcgtcctcccactatcgcgagcctccgcggccgagccgccgccgtcctagccgccgactgcgctgcgccccgatgccgccagccgccgccgctcaccccgtcctcccgccgctgctggcaatgaagaaagagagaacgtaggagaggactcactgacaggtgggccccactttatttttttaatttatttgatgactagaatgccacgtaggcaccacgtcagcgaaaccgtcctccaaaaccaccgaattgcacttgttttaagagttgaggggtcgaggtatccggttttgtggtttagggttacggattagatttcgatcacttttgagggtcacaaagtaaacttattcctttcctacgtgcaacagatgtgcccaggccggactttgagaacgtgcggtccgtagctgttgggtcggaaacggcctaacgggatccccacggacgtgtgggctgttgtagttgggcctataaaggattgcccgaaggtttcggcctcttagatcaggccatggaacactaacgcgccgcacatgaaagctggcctagatccggcgttgtgttcgtttagaaggcctcccaatccatcagcccatctccggttctcctcacatttaactctgagctgagaatggcagaaaagttgcagacctcccctaaccttcgtgatgtggacagatcatgggcgagtacggtcgtaccgatgaacacttgaccctccgtatggccgttgatgttaccggtagggtgatactccctcggtcccacgatataacaaattttaaattttttcttagaccactcgtttcacctcacctcaccaccgcgcacgaccagagaaccaccaccctcctctcgacaccgccaaagtcaaaaagcaaagcgtcacgtcacgtagcgcagagcggctgcaactcaatgccaggtgggccaggtcatatactggccccacaggtcagtgagcctagaaacctccttcctcctggtatctggaagctctggtatttaaatcgcacgcgttcctcagccaccgccctcctcctctgcgcggagccgtcgtcttcctcctctactcctcggacttggccctcctcctcctcctcgcgccgcgccagcgctgacgtagccgtaggtcgccgggcgacgcgcccactaagatatcgagcagttccggagcctgctcagggggctgggtgcggccgctccggcgatcgccggagaagaagggtggttggaatctggtgagtagccggccctgatcccggtcgtcgtggaaatccttccttcctcttccgtggtgggcagcaagagattttggtgctccgtgatctggagagctgtgcgcgggactggggttaggtggcccccccaaggttcgatccggcccgatttggcggagggattcgaacgcggcgtattgggataggaagccgcgccggtggatttgttcgagcagatttggctgctgggggtttgtgtgatgggagatcaggcggcggcggatgcggcggcgagatggtgaccgggagctttagcaggagcacgtcggcgcggctcacagcgaggggcggcgtcgggagcccgcgggtgtcggcggcggcggccgcgcaccgcaagtggtggtggtgggcgccctcggggccgtcgttcgagtgcgctgccttggccttcttcctttcctccgtcgcgctcgtgctcgcctgcgcgctgtatctgtatctcttccggtaccagggccgcggccatgcggtcgccgagttcgccggcgacaacctagagtcctgcgacgtgttcgacggaagctgggtgccggacaggaggtaccctttgtacaatagctccgattgcccgtttgtggagaggggattcaattgcctggcaaatgggaggaaggacaccggctacctgaaatggcggtggaagccaaggggatgcgacttgccgcggttcagtgccagggatgtgttggaacggctgagggggaagagggttgtgtttgtgggggactccatgagccggacacagtgggaatctttcatctgcatgctcatggcaggggtggagaatcccaagactgtttatgaggttaatggcaatcagatctcaaagactatccggtttttaggagtgagatttgcgtcattcaacctgaatgtagagttcttccggtcggtgtttcttgtacaacagagccctgcacctcgcagtagcccaaaaagggtccgagcaattctcaagcttgataagatggataatatcagccggaaatgggagaatgctgatgtgcttattttcaactcagggcattggtggactcccagcaaattatttgatatgtgagttttcttattgtacttgtacttagcaacaccaatttgttcttagaattgttgtcatatctactgcagttaacttaaaaatcatgaacctaatatatgtttgctccaatacatttgtttttgcgaaaaatccttggatagatgttctgtgcatgccaatggtttggcatataggtagcacagtgtcgctttgaaagatatctgttatttagtatgtgacttctaagcaacccctagatcaaaggggtgctagacagtattttttttaagagctcaacacaatttatcctgttcaggaatcatgaagtggactgatcaaaagtattgatagtaacaaattgacaaaaacaagtgatgggttgccttgcaatcttagtgaagttacttgaggtcaaagcaacacaagtaccagtgtttttgtttctcctgtcaaaattgcctgatggctgatgttggtgcattccgtccttcaccagaatagtcgtagttaggaaatatacactgtcgataattgcattgtgtttcaattatgctattaagttatgtttgtgcatattcctcagaagtgtttctactaatgtggattcctattattgcaaattgttacaatttacgaacaatctactaaattgtcatttccctgtttcactaatgggtaattattgttttgtgtttttaacaggggctgctattttgaggctggaggtttgcttaaactaggtacatccattaattctgctttcaaaatggcacttgaaacatgggcttcatgggtgaaggaaaaggtggatttaaaacgaacacatgtctttttccgcacgtatgagccatctcattggaggtgtgttttctcacatacatcggatcttttccagtgtattgttcttcttgtattgtgttataaaggcacctaatgaaaacaagactgctactgttgtggtttgaagaaagtgtaaatgatttgcgaaagacatacactcatttgtatttttttccctttttgcatacttacagtggttcaaatcaaaaggtatgtgaagtaacagaatttcctacagctgaggccaaaggagatgacagaagtgaatttggagatatactcgctggggttgtggtgaacatgagcgttcctgcaactatcttgaatgtgactttgatgggggccttcagaagtgatgctcatatcggtatatggagtcatccttcaaccatacttgattgcagtcattggtgccttcctggagtcccagatgcttggaatgaactagtaatttcccaccttttgacaaatggtgagatcctttacattatcattcttttaacatattatttagagtaaagtgtactgatggcccttaaacttataggggtgtgtcatctaggtctctaaactctcaaaatgcatattcaagtcctagaacttgtcatagtgtgtcatctaggtcccaaatcgccataaccccttcagcatcctacgtggcgttgatgtggcatgccacatggacatgatgtggcatcattttgactgacaaatggaacccatttaatttttttccttttccttttttcttctctttttttcccgtttcgtctcctttct

SEQ ID NO: 13573 - DNA, 28070 bp, Oryza sativa
  unsure (1)..(28070): unsure at all n locations
gctgtctttgaattgatggagataaatggtgatatattgatctgatctttcctcacgtgcaattttgcaggttggcgaaatttggctggctgactgactgctgacattatactttgtttttctttttctttttcttttttgtttttctgctgcttctgcttcgtctgctatcaagtagcggaccatgatttttttttcttagacagcactacagcagcatgtcttcatcttggtttttccttttcctcaagtgctccttatacacgcctccggggttacagattttgtatcattgtctattttgcgttttagacagaacatcacaatcggcaacctgtatgtaaacaccaattcatttgcaagttttggaaagtcatttctcatgcatgaaatctgtttggtctatttttttcttttgtgctagtcgtacatagaatgcaatcaacagttttccataagataatctgtttgctctatttatttttgtgctgcagtggtattgaattcatgctaaatctattgtgaaggatatcgcagcatttccggatttgcatctatgcggctgtgcctaactggcgagtactgtacactctacagtctaagtggacactgatccgccagatgccgacctgtcacctgtgtgcactgtgattcccgtgatcatgtccagggaaccagtaggctacgtggaagaggatgtgaaaaaaccacccatctctattcgacggccgcgacatcatcctgtggggagcgagctgtggtgacaaaatcacagaacgacaatgtcacatggctacattgtgaatatgtgacaaactgacaacaggttgtttagttttccatgattaacgtatgctgatgtacaaaaactgtgcatgtttgcccggcatcgtgatggactgatggcttcgtgttcgctgggaccggcagatggcatggctaaacgaactctttagattcacccggacggggatgcaacccaagagggaagtgtctgccgtgcacggttgggcaatttcaagtatccttagcgtagcttcaaaagatgtctatcatgtcggcttcacgaggcaaaccagggcagagcatgtagaggtgaggaatgctatcaaactccaaatcgtgcgatgatcatgacagtgtttcgtggggaagggaatgcagtggaatgaaattatctgcattatattactttctgccagtaaaaacgaagactgtggtttgcggagagacattgtatcaccggtcttgcactagcggaacttccgcaggtgagatctgattccgttccatcttgggggtgcaatgcttagaaatggaacacacaatccaacaacataaatggttagcaaaaccaacagcagaatttcaactgttaccagcaaatttacacacatcaatgccttatctgcaatggggagtactttccattactgctgcacccatcaaaatccatcctcttcatttctttcctcccttgcccatttgcccaaccaagcctcagctgcccccgcctaataccgtcgccgatataaccaaccagtctaaccaccactacacactccactccatttcccactcgactccatccagacattgtctccaatgtcgccgccgccgcttcgcctcctcctcttcctcctcctgctccacctcccctcctccctctcctcgcgccaccaccaccacgccccgtcgccgtccaagccggcgccggcctcctacgcggcgccgctcgccgtcctcctcgcttgcaacgccacgcggttccagcccgcctgcgtctccacgctctccaacgcctccgccgacgcgtccactccggacctcctcgccgccacgctctccgcgctcagggcccgcatcccgccggccgtctccacggcgcggtccgtcctcgccgcctcctccaacgtcaacctcaccaacgccgccaccaactgcctcacgttcctctcttctccacccaccgcctctcgccgccgccctcgacgtcgtcgccgtcgctcctctccgcctccaccgcgctcctccacctctacgactgctggtccgcctacaagtacgtcaacttctcccgcaccatctccgacgccatggcctacctcgacgacaccatcgccgtcaacagcaactacatctccatgctcgccgcgctgcagcgctacggcgacgacaccttccggtgggccccgccgcagaccgagcgcgacggctactggccgcccgcggcggcggggtccgccgccgacgaggacgcgctcggcgtgcccaaggggctcccccccaacgtgacggtgtgcggcgcggggtgccactacaagacggtgggggaggcggtggcggcggcgccggactacggcgacgagatgttcgtggtgcacgtgaaggagggggtgtacaaggagacggtgaacgtgccgttggagaagacgaacgtggtggtcgtcggggacggcatggggaagacggtcatcaccggcgacctcaacgccgacacgccgggcgtctccacgttcaacacggccaccgtaggtgcgtatacccgtaattttttccccttctttcaacgctatcttgtctttgtacgtatacggtagctggcacagcgtacgttttttctctacggtggtacacgtggtacgtgcatgaatcaatgcggtgtcattagctgctgctcgtgaccagccaatttagcactttgtctgcacctaaaatgcctttctgtgaatttgtgacgtcggccattaattgttggcttttgtgaacattgcgttcggcatgcgtgaggatcctctgacatactaccattacagttattgagagcatccacgatgtgagacactcctagatgtgagacactcatagagtatcttcactaactaaagacactcataaggaaacttagcttgtgagacactcatagagtatcttcactaactaaaaacactcataaggaaacttagcttgcaatagaggacacccctggatgtgctcctcaaaatctgaagaaacttaatagagacactccaacccacaatgggtatcccagcccacaaagtcccatgtttatttttactaccctacccctaatctctctcccgccccctctttttttcgccgccctctctctctcgccagtgtcgccaccgccccctcctcttttttcgccgccgccgccgctcccctctcccttcgctggcggccacgaggacgatgaggagggccgcctctcctgtcgccggcatccaccgccgcccctctctctccctctctcccgtcgccgctcgtcgttgtcttccccggcatcctccgcctcgcgccgtcgccggttgggggcgccagatccggcgccgtagtgggcggatctgggccccccgcggccagatttgggaggcgccggcggtggcaggcacggcgccggtggtggcgagtggcgcgtggatccctcgtcgccgccggaggtcgcgtgctgcgccgtcggatccatttctctctctctctctctctctctctctctcgcgcgtcacggggtcggccggaggccgtgtgccgcgccgccaccccttttcctccgcccgtcgccttcgcggggtcgtcgccggtcgtcacctactcccaacgacgagggcgaggggtggaacggtaaaatgtggggtggtagcggtgtccatgggacactcacctagccacgccctctgcaatgcgtctcccggctcggtgtctcagctaaaagttgctaaggaatgcgacccctagcgaggagccgcgcgcctggcagtggagaaggtccgactgaaaagctaacggagggcagacggccgttcctagggagacgacccagggacacccattgtggatggcctgatatatggatctcacccttctatcgttctacgtgtcaatgtctgtaacaagaatgtcattataatagatgatgtgaaccctacttgactacgtctatattaggaagttatttaaccatgagaatgtgaaaattgtacccccaatatctcttttccactgtccatgataattagtcagacactaccctaccctagtcttacatggagatcaacgcaatccctgatgcattttttatcgctatttatctaactatgtatatttgtaaaaaaaataccatatattaaaatataagtttcttgcagtgtttttcatgaaaatctatcaatatggttttgtgtgaaatctaaatattttttaattaattaagcatgtaaggtttcaaggtttgacttcacgcttttaggacatctgtttagtaggggaacgccatttgtgtgatggtgagtcgtgtatatatgactctacctacgttagttcaaattttgatgtacaaatatatttgtgtgcatgtctggttatgttcagggtttacattaccgtcggtaaccacgcggttaccgcagggtacggtaatagaaaaaccgcggtaacctccttaaattcaaataaatttaaaaaataatttaaatttttgataaattttgcatggtttcgtacgggttttttcacggttactgcgtggtaaccgtgcttaccgccgaggcgcggtagtcccggccccaacggtttggaaaccctggttatgctgtgtttagttggtgttgatattttttttataaaaaaaaaaacttgtggtagtaccgcatgcagttaatggctgctaattgccattgaagtgctagagtaattcattggacaattggacagatatgaaatttctatacactacaaagatgattccaaatctttaggtacatggcccaccaatttcctggtagccctaaattttaggtaagttttggccctaccaatattttgatagagaattctattgatgtagcaagtattacatttaaccccaaacaccacacaggtagtactatttagactacaaaatttagaagggcaagatttggcactgaactaaaacaatctttttcttcagaattaggctctgtctccagacctttggaggagaaagagagtacaaaccatctgggatagtgggatgtgataaatacttgttgtgttttcccccttgcaaatgattaatcaatcggcttatcgcgcaatgaaacattcgttcttttttattcgttcttaggccatccaattagtgtggccggaagcgacaatgcgtcccagcatcacgagcctctctactcataggcaaagtaaaagattgtaccttttcgtgcctttcccttttgttggtccctgccaaacagatagccaaactaggcgtggactgccgactagacctggcatggttcgttcggctagtcacaactctcagttttaactttaccctgagatgtactatctgtcacgagacgtgatcgtactcgtgctcacagtaatcctaatccggctgtaatgtgtttggtgatcttaatctcttatctgtttccaggcgtgctcgcggacggcttcatggcgcgcgacctgacgatctccaacacggccgggcccgacgcgcaccaggcggtggcgttccggtcgacgggcgaccgcacggtgctggacacggtggagctcctgggccaccaggacacgctgtacgcgcacgccatgcggcagttctacacccggtgccgcgtctctggcaccgtcgacttcgtcttcggcaactcggccaccgtcctccgcgacaccgccctcatcgtcctcccgaggcagctccgcccggagaagggcgagaacgacgccgtcaccgcgcaggggcgcaccgacccggcgcagcccacggggatcgtgctccgcggctgcgtcgtcaacggcagcgacgactacatggcgctgtacagggagaagcccgacgtgcaccacgtctacctgggccggccctggaaggagtactcgcgcacggtgtacgtcggctgcacgctctccgagatcgtgcagccgcgcgggtggatggcgtggaacggcgacttcgcgctcaagacgctctactacggcgagtacgagagcgccggccccggcggcgacggcgccagcgggagcaggatcgggtggagcagccaggtgcccagggaccacgtcgacgtgtacagcgtcgccagcttcatacagggtgacaagtggatacccaaaatacattagttagagcagcataaaaagaagtaaatggtggtccattgtgtgatcccctcgaatgagatggtgccaaactgccaacggcgtatagccatttaactgtgcaaacgcattgtgccgtgcataatgtttaatgaaagggtggccaaagccttttccttgatcaatgaggatgtatgatctagtgctagccgaccgtgaacgtgaaggctaaatctatgaaaagaaacagctgaaatttccaattttgagtcggccgagtgcggatgcagacaagcagataggttcggcgtgccgcgtgcgctatccgcaattagcatgactgaggcgtcgccagaacattatcatctcgcctcactcgtagtggtggtccatcaggccatcactcgcagcaaccttttttccgccgtagcgtccaccgaccaccgccctcttcaccgccccatatgcagatgtgcgcaaccggccctacgacccaacgagcagaagtactgaaccaagaccaaccaacttcggagttgtgctctgcgcctccgcctacccacttcggaagtgcactggacaacgaatgcgccgtgacgcaccagtcaatgtcaagtaaacagaagcgccaagatgtttgtggatcgtcgatgctaatccacttcgaacctggcaaacgaccatctattcgactgtaggattgtagtaaggaacatggacaaagggtgttgactgccttttgaatgagattatcaaatgcgacacagaatttacgggcccagcccaacttgttcagagaggccttctttggacccttgagttcgaccttcaagcccaacttaaccaacttatcattttagatagaagcagattagaattttgaaaaggtccccaatataggtccgatcttatttagcaaccactaaacccgtgcaaaaaaactccttgacaatgttgatggtcgtttttactaatgtgacattcatgtgatagcccaatcatcaaagaaatttaaaacatatatatatatatatatatatatatatatatatatatatatcccacatgtaaatgattaaaaaataataagtcaatcaactcgtagggagctgctggaaccaccaccgccttccacgcccttcctgcttctgacgaccatggcaccccaatcctaggagagaggacgaaaggaagaggggaatagtcaccggtgccctcctggctccggttcatcgccacctccacccctctcgggctctctgtctctactgtttgttggaagtgtgatgggaggaagagtgaagagaaggaagaggaaagagagagagggagacgtgatgaagaatatgagacatggacttacatgtgggtccactatttaaaaaaaactagtatggtggcctgcgcagcttgcgcggctagtatcattatattttctctcatataataataatatatatgttttctcaatatattattcaaatatattaaaatgatataattttaaattttgcaataactttacgaaactactaatgggtaatattcatattgtattttatatacgtgttagttattaattatttttaatatcaaattttaattatttgtaaattatatatatatatatattcgtatatgggctctagactcgtcttttaatatttatttttttaattccgaattttctgtaaattgtatttctatatagactctatgctcttattataatattatttttttatttctgcatttttattatttttaattgtatttctatgtgtactctaaactcatctttcagtattctttaatttttaatttcgaatttcagttacttctaaattgcattcctatattgactttaaactcttcttcccatatttttcttaatctcaaattttagttatttgtaaattgtatttttatacggactctaaacactacttttaattttattatgtttgttctgaattttagttagttttaaattcactctatactcttcttctaatattccttattattttaattccgaatttctatttttttcttaattgtatttctatatagactctgtactctacttctaatattccttattttttaattccgaatttctatttttttcttaaattgtatttctatatagactctatactctacttctaatatttcttatttttaatttcgaatttctattattttctaattgtatttctatatggactttatactttacttctaatattccttatttttaatttcgaatttcagttattttctaattgtatttctatatggactctagtctcctattctaatattccttttttttaattccgaatttcagctatttctaaattgtatttctatatgaactctgttttttctttttctccgattaatgtgaaaatttctagaccatgagagcaaacgtaaagactcatttttctattcctttaataatatatataatagatagatgtgccacgtaggataaagactaggttagtgtgccggcacataagacaaaaaccattgtccaaatcacatgtggaggtaaatttgaacctgtattaatagtagagggagtcgttcttaactggttttatggttgtacgaataatatccgatctatattttttaggaactctgattgaactttttcctttgagttcggttcatcctttgtacacgttctccttgtgggcttctttccttctgtaccggatgaccacatgcccactactgagccctcacgaggcccaccatatccactactcgaacacgaacacgagaacctttacgagggccaccatatccactacgcaaaacacgagcaagaaaccaaccgaatagtccaatacgtccggcccgtggcatccgtgccaacccatcgaccatccggctaccgagcagcacgccaaccccaccgggtgcaccggccgggagctgccccgatccgctatttctgagcgaaaacttctccgattcgaagcccccgcagccgaactcggcgaagtccccatgccaatctgactagccgcccccgatccgctgccgctgccaccggcatggcagatggcatccccgcacacgccgtcacgtacgcggtacgtcccagcgtgaggaccggccggccctcctccgcgtcgacggcgacggcttgcacaagactgtagtagggtaatcccttcgccctcccgttttctttagccggtcaaagcacgaaagctggcgtctggcctggcaccaggtacgacgagaggacgcgtgtcgcgggaagggtccctccctgcctagggcagtgggcactggagtggagtcggtccatgccctaccatgcgcgacgaccgctcgctttgcctgacaacgctggtgggtgctgcctgtggcgcagggccgcggaagatgacatactacactcggtggccgcgccacactctcgtgctcgcccggacaagggacacccggactccaacaccaccacgtgtgtactcctaccccgtacgcctctctctctctctctctctctctctctctctctctctggacggctgggttggtaggatttccacgatattcgcgtgaaatgtctcgcagcccactgggaatttgtttatgttcgtgctaagtcgtaacaagtccagcaacctcataaacaacagcttgatgaaaccttagtagctgacccgtttcgtttactacgactcctgtagatttagctagggatgctcacgcaattcacattttcctcatgtttcagcttctggctcactgcatttgcaagttacttctctcacaaaatttgctcatgtactccgttagctgtgtactgcccccaatgccaagctcgtggatgaacagtaccagtatgtagtaaagtaccagtagatgcataaatgcattataccactactagttcttgagaagtaaactagtcaatcacttgtgatgcaatcctccaactactcccatcttgaaggacaagggaagtactactagaaagagagattaggagtatctttggcgaacgacgctgctagaaattgtacagcctaacacttctgctttagtcggtgcgttgccgttggaaaagggcagcagcatgagctacccccgaaaggctgcatctcgaaggaacggaagcatggctaaataattgatactgggaaattatgatgttgttcttctttggcagcatggcattgccaccagatctcttcagaaatctggttgtgcccatgttccacacctgcagtgagcagcagtgcgtttcaatgctgcattgttaggttggcactgcctctctgcctgtgcagctgtgcatcagtgccccacgaatggggctcatcacttgagttttgaatgcatgtttgattgcaagtcccgcaattaattgctatgagaaaaacaaagattcccatctcttaagccttaactaagtatgccaaatataagcaaagcatacatacaacctcgtgtgcttcagggacttccagtgcaaaatggccccagctgctccaacgtccaaccatctgtggatgtcagccgtgaccgtattaatccaactcaattttaaaacaatactgtatttcatgtcaaaatgaggcagtgtttgctggtcagcaatctcatgttgcgtcactccagattttatcaccgaaacagttcaaccaccatacatcgaactaggctattgcagccgagcaacaaccaaccccagactgaccaaacaattcatgaacagaaaatttacctatactgatgaattattggccaaaaaaccaaaaaaattgtgagctatcaaagcagccagagtggagccgaagccatgatagcaaacacaaggtatagttttgtcgagaaacctaagcatagctacctttacaagctgttgctatgtatgtatggagcttagaagtttgtatctggtatagggctatctacacatctcatgaacttgtgaggctcgcggtaggtgtggccggcacagggttttccttcgttgagttcttggattcaccccagtgccataacatgctctcccagaagcagaacttctcaaagcaagttttcagcctaggatcagttatgttcctccgccaatgtccatcggtgaagtttgctttctcagcctgcctccgatcccactccaacccagccttttgccttgatctcaaaagacaatagtgctgaagtttctttggcatcttgtcatgtaccttccaccaacgggcatgtgcaacatcactggcaaactcccgcagtatcgggttattccagttacagtcgtaatcccggaagcacagccatggtttgagacccaaatagtgaaggacatagaggattggtgggtcagcaccaaacaaccgagtcttcttcactttcacttcctcttcatccccctcccagaaatgttttaagaagttcatgtgcttcggaattcgatgccaccatgtgaatatctcattcaggtatccttggtcaccaccattgtaggatgttatctcattgatgtggtccatcaacaactggaatgtgcagtttgaaggctcaataaccattactccagagttgaacagtgtcgcattgttgccggttgcagtgatttctggcattgcgaacagaaaatcgacatttctcagaatgaggagatcagcatcaataaatataatcttgtcgtaatctgtgagctgccatagacggaatttgctgtagttccactcattatatgcatcacgctcagctttcggattccggatcctttggattattctaaccttccacccagcagcttccaagcccttccggtggtggttacttatggtctcgtcaacaagaataacaaaatccctagttgatccggcttggcgaatgctttgggcagctgtgattgcaccacagacatattcacttgctgaatgcagaatagtagcatatgcttccctccgtctgtctaccgagtaaagtcgtgctgtaaaggagatgaaagatgttatctagtggaaatttcaatgccacgcaggaaaataaaactagaaggtgcaaaagtatgttctaacatttccggacaaaatcaccaaaacattactgatacatctgcgataaagcaaccactcttgctcattcccgaaaaagaaatgcaatggtagattctaaaagcttacttacagcaacatcgatattttaactacttcatatttggctctcttgttatatatcatagggattaagtggcatgaaatgggaagccatttaaaaatgaaggcagtaagacataccttttgctttgagtggaacagcaagttcacaggatccaactggaagtctgagcttctcccttagtgccttcaagtcaggcttgtacatccaagcattgccttcatgtttcacaaggttcttgcaagagaagagatttggaatagggaagcaatccgtcacaaacagcacatggataccacgattgcctcttgagcagtcactgccacttttgcagcagatagttgcaaatgcagacgtgcaacgtctcttgaccatccaccagctcgggtacagggaagtttcacagcaacaacatcaaagtgtgtccctcttggaaaaataggatctggaagcgatggacacgatggtatctctgtttcttcctcctcatcaatccattcagggtaaagagtctgccaggtgatgctttccttggcatgctctagcctaatgatcgaaaaatcactatccgggagcaattgtgtccatgagccaatttcagtgctgntaaaatttaatagtccaactttgagcttccgttcaccatcattcagattttcgacggttttatatacatcctcccactgaacaccaagcgaagatacatatcgtggatcaggaatggtcttgtcccatatccacccactgacaaacctgtaaagcatatgaaaggtatggtcaaaaagggtaatgcgcaatttcttattatatataactccaacataaccactgtgatgcgagcaggaattggtgttctagtttccactggatattctactgctgacagaatattgtaataagtttccttttgataggtctactcaccgagaactagactgcatttgatggtcgtacacagatggagtgtacaatagtgtcagaaatgcagcagacatgatcgcgaagagcagaagttgtaaggaccggaacttgcaaccagagcttttctctaggacaaagacatcaaatttttcgacctctttgaaacttttgcttttctgggtccttctcttagctgtgtcatccctgaaagaaggtatagaagaaacagtcagacagcgacttcttacagtaattatttgggcatcaaataataattggtaaagaacaattcagaaagcaacccctgaatgtaggatagtcagcaagatgaaacaaaactttggaatttgcaccaggtatgaagacacaagggggaattctgtctgaagaagaaattgtatatgaaagaactactgaataaataagtatgatatattttccccaaaaaacagcttacattgttgtactgttttatcgaaagcacatggaagtaataaaaattgctagccaaggtccatatcaattgtaaggccccattgttcccattagttaatcccaaaaagatagcttagaaaacatttttcttggtgatcatgttttgttttcctagaagtttgcactagtcttgtgtgtatttgatctggctggcctatatggacaaacagccctagtaacactaaatctataaaaaaaatatagcacatcttttcaaaggagtacttaatctctcatacggtagtatggaaaagcgatcatagtaaagttgattagctatcaaagaaaaaaggctaaagagaacaaaatagcaaggttctccgcactgagaattaaagaaaaagattagcaaaaagaagtggtgccaattcattttcctccattcttcctttattagtcacaccacatcttttaggaaagaaaagcatcactaatcacaaagatactccagtacctaaccccatgttattggtctcaaatttaaaagtgcgcttagcgatttaaataacgttaaacatgaaacgaaaagctgcactcatgggtaatcccagctgtgaacaccaaagctttgtcaagaagtttgattcaaaacaacggagccggcccctgactactgaacccactagactagcgtgcatcgaagcatccaactagccaaaacccagcattctatacacacgctaagctcgcccatttggcgctgatgggccacacaggcacaaaacaactgtagcttacgcttcaacgtgcctaaagactggtgaccactgaggactgcacatggaactaatgtgtgtagcaattttaatggcaccggcgatgcaaggtgcagtcattggggtcaaattggcagtgaaaacacatgaccaccgacgcctggctccacatcacagcacatccaatttaaccaaattgcagccgctaaaaaggggatcagatggccacaaaagtaaaaccaactttccgtctggagataaaggaaaatccgcaaaaacagacatccattttctccacacatcagcatcaaaccaactcgcatcaggagcagcagcacactagaaaagagagagtaaaacatgcagagatagcacgtttctgctgttctctgattctctcttagctgtaatcagcagcagcatcaacaagggggaggatggaaaaaaatggaaggatggatgccataaaagctgcacaactaccacccaccacaccacctacaatatgagggaagttaaggaggagagcatgatgaacggagaccaaaaggagaacaacggcatcttgtacagcgtactaaaaaccagtacaccatcaccactaccacctcctgcaagaataccacgacgatatggccggcgccgggcgccacgcatcgaccaagaagtagaagtaattagtttttgagtcaatcgaactcgacatgcaacacatgatagcacatggcaaagcaacgcaccacagtagccgggttagcaagcgagcacatacatcaaagcatgtaaaccagctaaagagagagagagagagagagagagagagagagagagagagagagaagaacagtggaagagaggcacgcaaaggtggagcctttcttcagatcgggacagcgtggtggtagggagatcttacgctgctccggccggccggtaccgcgtgttcgtcgtctccaaagaacccatggggactctctttcgttctctgcgagcccacctgaatcttcccccgagccgtcagctatggctctccggtctcaggcggtggccgaccacactgtcgccgccgcggtggagcagcttctcatctgaaatcggagcaagaaacaagggaggattcgtgtgagcatggagttcaccgaggcaaaagaaaacaatccaatgcggccacagaggacgaaggaagagagagagagagtagcaggcaaagaactgaaattttcccgagaagaacagcatcatagtgagagcaaagcccaggagaacaactacacacacacaccaaaaaaaagagtaaataattgataaaaatgcgaagtagaagggagctgcaaaatccaacatcgccactggctaggagcaaggcaacagaaaaataaatctgctagctgctgccgcgcaaaaaaagagagaacccggacaccgaatcgagcaaatggtggcgccacatcgccatcggaaaaaaaaaacccagaagcaccaagcccggatcgagcaactcccaccggcaacgcatcaaacgcaaaccagatcaagaagagcccaggagcaacacaagaacaggaggcacgcagatgccacacggtgaggaagaaggggaggaggatgctggatgcagcagcacacgcacccgcagagaaggcggacttgggagcaccgacgggcgcgccccggcgtcggcgtcgtcggaaatggccgcagttggtggcggccgagtgggttagctgggtgccaccggctctctcactcctctctctctactctctctctctctctctcgctgtgcagagctcgcggccaagggggtgtgaggcagcaggagcgcgttatatacaggaaacaaacggggagagacgggggagaccggagtggaagcgaagttcttcaccgatttttgcccatttttgccgccccgcggggccaatctcgtgtacgtcaagggcccagatttggggatgggctcacggtgattagcgtagtcggtgagaattgttaggcatatatcaatggtggcaaagaagataatggactggaatagaagaagttaatggagaattatgcatgccaaaattggcgtatattcgtcctagtttgtaaccaaatcaaactgggctttattaaaataaagggacaattgtttttttaccctaattttaagactaactctgttttttcgactttactcatttaaccttcttttttttaaacgaagatgaggtttggccctattccgtgaaggcaacgtgacggtgttaactcaagacaaaaattccaattatacccttgtcaatttaacccagtttctcgtgcaaatttgtgtccaccgaaaaagaaaaacatgtcacatggtgcgctgccaccgtcggtgctccctcctctccgcaccaccaccgccggcggtcccttcccctgtgcactaccgctaatcgcccgtcgccgccgtcctccctgttctagtcaaggaggagcagcgccaccgctcgtcctgttcagatcgaggaggagcaacgccacagtcgtcgtcctctaggcccttgtccgacgccgctcttcgtcgcaccgccgcggccctccacccgcaaccgccaccacggcaaatcccttcacgcctcgacgcagccgtcctccctccctcccttcgtggcccgccgccgccgcccctcgtcgagccacggcagcggcccctcctcgacgcgccgctgcggcccacccaccgccgctacctccacccgcagctggtgtcgccatcctccctccgcgagctggcgccagcgcggattccctccctcggaggcccgccgccgccctccatgagccgccgctcctcgtcgagccgtcgcagcggcccctcctcctcaacgcatcgccgcggcccacccacagacgctacctccacccgcagccggcgtcgccgtcctccctccgcgagccggcgccggcgcggattccctccctcagaggcccgccgccgctacccctccgtgcgtcgctgcccaagcacacaggatagggttagatgtgcataggcttggagggcattttggtcattatggaaaataaatttatttcttttatttttttaaatgaaatcttaacggtgctaaagaaacagggtcaaacggagtattcgtttttaaaaagtaggatcaaataagcaaactaaaaaaaagtagggtcatattgataattaggcttcgaaagagggtcaaataagcaactttccctaaaataaaccggtgcaaatttaatggcttccaatatgatagtataacagactatacagtagaataaatctcctacttttgccagagtgtttgtagcacttcgaagtacgaactgagcttagctcggctagttatgtccgtggtagtaaaacatggccacactcgagtttaaattataaacttaacatgggacttgtatttacattaattatttttcactattagcaatatacccgtcaatagtgaaatggttctgatatgcttaatcaaccttcaaatactcgtagaggtaagatgtacttcctccgtcccaaaatataacaactttagccatcaggatttattctaaatataataatttctccaccaacattctcttcctcaccaatcataaccctccatcattcactttttccacctacctctccactaatcatccaatcacaaccctccaccattcacttctagtaacgtgtttaactctaaaattttttatattttgagacggaggaattgcattgcaaaaaacattcgtagcacaaaaatcgttgataaatcttaaaaaaaatcattggctcacaatctaaggtgtgcttggaaattcccgttagagtactttctttacagtttatttcactaaaatattcgtagattatttgttatacgcttctaaaaatgtgtttcctagaaccttaattttgataacttattctaagttatttctgaaagtttattttagaaattatgtagataattcattacattaattcaacgaataatcttcaaaagttgcatgcaagttttcaatgagttgaaaagaaaagcgaaccatgtctctatcaatatcaaactgcatgtgtaccttaggccttgtttgtgattgtgaaacttctaactgttgtattatctttcaaaatctattgcttccaaacaatttcctcgggcaaattcttagaactcatagtggattttttttatttttaaaaagttttattaatttccaaaaaatatttggcgtggcagcgttgttttgccacgcctgccacggtggtgtggcaagacaacactgccacgccagctacgcgtggcgtgacaaagtgatttggccacgccatgacaaaaggttcagatttagaaataattttcagaaatgtctattaataaaattttaaaaaaataaaattctaaaaaataattaaaaaaatcctcatattgatagaattaaaataaataaattagaaactggaaattgggttcttaataacttttcttaaacactcacggcagggtttacgattccgacatgcacttccattttgggcactggcggaattcagaatttcgtgaaatccggtggaaaaccggtaaattccgaataaatttcacaaaccaaaatttgaatacaaattctctgagtttgccgataaattcttgaaaaccggtcggtttaggcgaaattccgatcgaaatcatcgaaatttcgatcggtaatccggcccatgtaagtgttttcctttttttatttttttattcttttcttctctgatgtaagtttaaatacacataatatatcatttttttcgaaaatttatatcccaataggttctatgaatatcatagtatttataagattttatttgattttttcttttttttatcaattcaaatttaaatttggatgaaancttctcgaaatctctagtatgaatttcctacttttcagagacttcgtctaaaacgtcgaaattttgcgaaatccgaccggatttcgtcggaatggtaaaccctgctcaccggctagcttggcattagctgccttctcaaatactagtgcctaaagtccacagagagcttcctgtacgagtttccatgagtttataacaaggttatgttctaaaacgagtaaaaaaaccctgcagttacggatctgtcctcaagtcttttggtatttggtttcctagccaaggccatcatgctaatcagcttatatgtagtcaagtttacatgaagcatgccagcatggtgctactgctacggagtagaatctgggcgttcacataaccttgtgtaaaatggcatccaagtcgtctggtttgacccacgttgacgggtagatgagatcagcttgacgcgcttaggcattagattggggcaaagcgtctctctgcgtgaatccacgcctaaagacagagctaaacaacactctactctctctaggttggaaaagcttaacccagtggtcattaggaaacttccccgccatagagttctcatcctacccaagattactttacataagcttttgtcactattaacttctaatcagttcagccgtctttgatcgctatgtagttgaaccatcctctctttttgtcctttgctactctacctatatatgcaaagttgtgaccaatgcgtgttctctcaaacctaattcaacgccatgcgtgcatgaacccattcagagatcaaacaatctgcagaaaattccatggtaaacggttaaaaagaaatttccatgtcacaggtatagggtcaaattaaacatttgaaaaaccaaaatttccatgttgaaattaatggatcgatgttacggtaggattaggaaactgcattattcctgaacttttacgtccgtttttttcttcccttctcgtcagacaaacgctagtgatgctgttccaggccgaatccatgacaccatcaaaggaaacggctgtcaagcctggattgacgggggccaacgggcgctttcacatgtcggagacgcaaaaaagccactttgccggccggcgccaacacattgattggctgcttgagacctgttcacaagctagctcatctcgtctcatgagtcatggaggccattacaggttttcctctccaagacgatgctgctaagcgtcgccatgacaccatggaaaggaagaaaaggaggggaataaaaacggaaggtagctagcttgtgccgctcaggccatgaatgcattacacctcgaaactaactaaattctatcacatcgtcttaactcgattgtgggcttaattaggaaactgtcctcttctggcgtcctcccattcataggcgataggtcgttaatcacctgtttcatgtaaacactattgggtattatcactagggatggcaatttcccccgcggggccgggtcctctgcggggacccgcccctacggaggcaggggcgggtgggatttttcacccgcgggtgcgctggggtcggggccccgcatttggccggggaggggacggggggaacatttcactcgccggccacatctcggcgtcgccactcgccagccaccatctcccctcccctcctctccaatctcccctccggcgtccggcctcacgtctcccatcccctccacggctccagctcagggcggcggcgacacacagggcgcggcggcagcgcatagggcggcagggcgcagtggggaggcgagacaggcaagggcacgcggcgaggttgcggcggccggcgagacatgcaagggcgtggcgaggcgacgggcgcagccggcgaggttgcagcgcacaggcgtggcggcggccggcgattcacgtctccaatactcccaaatactctaggcgattcacatgcgaggtattgctccatctccaatactccaagtctccaactgtgccttgtgaatgaaagtgtgcccaaatgcatgggttggtgagttggtctcttaggagataatccatgtgatgcactgagttgataattgtcttgaattttctatgttgattggatgaagatgctacttgctgcgggtccccggtcgggttgcggggccccgcaggggtcggaggcgggtgggatttttcacccgcatccatggtcggggccggggccgggtggtgaagtcggggggtcgggggcggggccgttccagcccaacccggccccgcaacgcttaccatccttaattatcactcaaaaaagagggcgttggtttaagtagggatgggcagaaaaagaccgaaccgacaagaccgagaccgagaccgagaaaactggtcatcaatttggtcctgggcagtgaaagaccaaattttgttcagtcaattctgttagtctcctcggttaaacgaataaaccgaaaagaccaaattaaaaaaaaaaggtctaaatgcaacctacaacccactaagttcaataggattaaactctaattttcacatccctactcttataggcatgcaacctaataagagtctttattcatacttgcttatgaattttttttgtgatttttgtgttgaaaatttctattatttctttacatatatgaaaatgttgctgaatttcggtcaggactgagaccgagactgaatttatcggtcctgatatttttgtgttggaattcggtcttcactcttcaaatactgaaatgaccgaaagaccgaaggccaagacagaaatttttggtcagaccgaatgtccacctttaaggtttgagagactcttttggcatcacacgcttcgttacgaaaccgttgttttctgtcaaaatttgcaatgctacctaccgactattttgatctcaccttttatgttctccccttttcttaccatggacacctgtgatctccaaaacgggtggaaaggagatcgtggaagaaataacattagattactcatgttagtagcaccgttgctctctttgccctccaatttccagaagtgaaaaaccaggcgagtgtaatgattggttatgtgggcaccacaagtagcctacaacatcattacacgaaaatacacgaagcctgttgcttgtgattaactcgcaaatatacttgtggtgctgagcaaataaagggtggtataattgtcctccattgtgggcagtggttggcagagaaggctggcttttgttaaactatcgcacaagaccagtggatgtgagctttagataaggcaaaaaaaaaaggcatcgtggattgctaggctcctcttataccatcacaatttaataacatagcctgataagctcatgtggaattaacaaacacagttgcaaagctactgtaaaaaaagtcccggtgttagtaccaactacatgctttcggttaagaccagtagtcatcagtcatcactgggcgctagaaaaacaattcagttgctcgcagagcccacggattaaactagtgacaccccccatatgatctctagctcaaatccatcatgccaccatatgcgtgatgcatctcaagatacccttgcctcagcagccgtggctggacgatgccttgagatcatttagtttaaagtctccggcaacagtaatcacattcagatggtaacactccccattggcccattgaattcttctagattcgtgccccgtgcccactaaccgtacgtcctttatacactgcgagatgtacaaagcgtactactcctactgtagtaccatgctctgttttcccctgccccacgtggagtgaagaagctgggccagtgcgtgtagcagcagtagcagtagtttagtttaactgccatctcaatatctcatctcatctggtatttattcgtggcgtgtatcgcgtccatcacgagctgcctggtcagtttggcactttgaatggaggcatgtgtgcgtctgaccccgaacgggatatggctgtgtggcctcaccatccatccatccatccatctgtgcaaaagtgcgatgggctgggctcatgcactgcactgggtgggacgtggcggtggtggtcacaggaacgcagctctgactatcgcgattcgaccacatttacaccgggcgctgggtggggtggttggctgcctccgccaccgcgcgcgccggctcgcgtctcacgctcgccttcaatgcgtccgcaccggcgcgcggagaaaccactcatcatcatcatcaacccaaccccgtccacgcccacccgttgcggagaaaaagccgcccgtgccgcacgtcgcagcggccgcggcccctctccacacgagagacgcaccggcgcgcaggcgcgcgcagcaacggccggctattacgaggaggaggacgacgtggtgggacgcctttttggcaggtggtgcgcggcgtgacggtgacggggcgcgcgcgcgctaggaggcaagcaaccaagcaacggagaaccgtagccaggtcgtgtgcgaagggacgccgaacgatcggacgcggtcggggttgggggaccatgcgtccatgcggtgcgtgtccatgtggcctcatgggacaaaactcgcagggataagtactggaaggaagggaaaaaacgggactgggtgtctgggtgggaaagaaaaagggaaaccggagagagccagtcacagctcacggttctgagacacatggaagcgtgtagcctaccaaaagggccaaagaaaaaaaaaagaacttaacgcagggatcccctgaaagcgaagtggtcggggtgctgtccttgtccagcctattggttcgaaccagatctcattaattggtgtgtaccgtgattgaaagggccgtaacaaaattcttcccgtgatgttgatgcggcaatgccctttcctctacgtatttcgttttgtattctgcatttctgcgtgggcgtcgctttacagactagccctctcctcccactgtactgtactgttattgtacaggtatatgcaaatcatgcaccaccaacagtatccttgtatatatcatgaaccttatctcgtttcttccttttcttctgctttttggatggaccagtattttctcctagttgtttacaagcaacggagtgcactgatacgtacactcttggcaacacgccattttgacaaacgaagtccacatgtgacgagcatggacgtgcctatctctgtgttggcatttgtcgagctgaaatggattgctcgctgcatgaattaattgttggccaaatgccaaaacattggagcagagagctccgctcactgattggattgtacaccaaacttaattagattctcgccagtaaccgccaactaatcagtggagctgaaagttggcaggatgctgcgatgtccccagaacgttaattttaacatccatttactatattctactgttgaatctggtcatgaaacaaccattagcgattaatgttagcccaccatctctgtaacagttactcctcagcaaattataggcagatggatgccctcctttagtaagagagagatgatgttctgttacagcttctttgtgtcggcagaaatcgcatggctaaaatggaacggcagaatatcaagcactattctctagtccttgcgaaagcatcaccacactgatggaatatcgcaccaactgcttcaacacattgattcttttttaaaaaaaacacatgttttgtgcgctcgtctatgaaatatgaattaaatgcttagcaaagctacatttctgatttgctttgcaacgttaccacgccttcttttttttttgtaagaatctaatccctggcaaagatgtggaaattatggagtagaatcaagttcgagatgacttctctatgaagtttggctaacaccatttgaaaatacacatatccacagaattcaaattctctaaacagaaaaaaagaacccgagaaaattcattgcatgccctgaattttacctcaatcctttccaggccctgaattttacctcacccctacatgccctgaggttttgttttggtcttatctatatgcttatatccatcttgtatacatatttcgtcagttaactggcaatatttattctaaaatgaccgtattatctatttctcatactaatgatccaacgtaaatcttagtgtgagaaaaatataataaaatcaaatgtgatagaattatttaataccaaatttcttgcgattaaacacaagacaaaattaggctggaaactcatctcccgcgcaagtaaaacagagcgacacattttcttatgattaatatgattttttaaagcaattttcgtatataaatcttttgaaaagtttaatagtttgaaaaacgcgtgtgccgaatacgagggatgtgacttgaaaaaggtgtgggaagaacacagccttagcatacccatgagtacccaaatggtgctgctacattgttttttctcatgacaacgcctctctcaaaagatatgtcattttcagattataagttgttttatccttttcttttaaatttttttaagttcgaccaagtttacataaaaaaattaacaacatctaaaataccaaatttattttattaaatcaaacatttaatatatattttgataatatatttgttttgtgttaaaaaatattattatgtttttctattaacttgatcaaacttttaaaaagtaactagagaaaaattaaaatgacttataatataaaacggagagaatatatcccttattattttggactatttattacaaatacggggcaatatttcggggccatcccttcttcagataaacgtacacgttgagtcaaactgatgtgcagaactgcagatgatgttaataccgatagctttcatgcctcgaaattgaggggaagaaaaacaatactcccctcaattggtctttatgatgatatcctctaacagccaccaaactgaattgaaaccatgtaagtcattctatcattttctatatttatattgatgttaatgaatttagatagatatatatatatctagattcatatgaatctagatagatatatcaatatgaatatgggaaatgttgcattgtctcgtgtattctacttcattcgtttcacaatgtaagtcattctagcattttctacatttatattgatgttaatgaatctagatagatattcattagagattcattaacatcaatataaatatggaaaatgttagaatgatttacatcgtgaaacggagggagtattatatacgcgccttacatcttttctccgtttcagtcatttgcgtgcatagctgtgtaggtgtgtagaagatatgtttgcatcttcgaaagcagaaaatggcgtgggcacgatgtgataaggcataactagcttcatcttcgtaggtagaatctagctatatatgtaccaactcataataatgtactctaattttgtagaaggaaacaatcatttttaataagaaaataaagtgtgtctagtagtatcctaaaaagtgaaaagggcggccctagaaaaacatattatctgcgatctgaaatactaccaactaacaataatacaatgttgttaaattattcatgcactgattatttcgtgtgtaagcatgaaatctgaacaattcaaaactacaaccttctttagaactaagcgattctatataatctctacaaaggagtggctaaggataactggtgatgacacgctaaaatacgtccactatgctctcagctacgctccacaaataattggagtagaaatctttctccaaacagaagcgcacgacacggcgaattttatccccttttattttttttaaataatttattttaaaaataaacaccagtaaaacttattttcacaattcaaagttccaaaatttctggtcacacgagccccacctaatatggtaaaataacattgttaccccacccacagcggacgtgataattttgttatgctacagtggcatgacagtactacgctgttacaacgttgttacagtcagatcgatgtgatcaaataatgttatcacgttatttagacgggcgtgaccttgttattttactacgacggtctatttagactagccaaaagtttcatatcttaaaaattaaatagtcgaaatgtttatttttaaaattaaaaaggtaaaaagagaaagagaaacgtctctatcttgcattgcatgcccctagtggccttcgctccaaccatccgccgcgagccgagccaacaagccgcccgctcgcgcaaggttacctttcgcgagcttggacactgtgctatacgtaattgaaatgaaatgaaacgcttgccgctgatacgtttttagggcctgtttggttgatgccctcactaacatgcctgaaaaatttaggtgcctgagagctatctgataggatgataaattttacctgctcaggcagcctgaacacttgtctgtttggttgttcttccgcgcctgtgaaaactaaacgtgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13574 - DNA, 172 bp, Oryza sativa
tagatccattgtaatcttgaaattctataaaaatggaaacagcaactttagtcgccatctccatatctggtttacttgtaagctttactgggtatgccttatataccgcgtttgggcaaccctctcaacaattaagagatccattcgaagaacacggggactaattgaagtc

SEQ ID NO: 13575 - DNA, 341 bp, Oryza sativa
gatagcatctattgtaccaggaatatcaatgaaccccattcttgcaattgctcaggataccctcttttagctgctaggtctatttcttagttcaagatccctcttactaactggaataaaagaattagtagatctgttccgcccaaaatgggaatgggcgctagggtaatgaacttataatcatggaatcgactcgatcatcagattataagttcattccataccggaccagaccgtgcacattcttattatgagaaggggtcattcgagcctatggaaataggatactctgtttacatagaaatccccacgtccttacattctatttaggattaggaata

SEQ ID NO: 13576 - DNA, 737 bp, Oryza sativa
atggtcagaggcgaattgaaagctaagcagtggtaattaagacccccgggggagaatagggatgtctcctacgttacccataatatgtagaagtatcgacgtaatttcatagagtcattcgatctgaatgctacatgaagaacataagccagatgacggaacgcggagacctaggatgtagaagatcataacatgagcgattcggcagatttggattcctttcctatatatccactcatgtggtacttcatcatacgattcatataagatccatctgtctagagatcgtcatatacatctagaaagccgtatgctttggaagaagcttgtacagtttgggaaggggttttttgagagaaaagaagaatctacttcaaccgatatgcccttaggcacggccatacataacatagaaatcacacgtggaaggggtgggcaattagctagagcagcaggtgctgtagcgaaactgattgcaaaagaaggtaaatcggccactttaagattaccatctggggaggtccgtttggtatcccaaaactgcttagcaacagtcggacaagtgggtaatgttggggtgaaccaaaaaagtttgggtagagccgggtctaagtgttggctaggtaaacgccccgtagtaagaggggtagttatgaaccctgtggaccacccccatgggggcggtgaagggaaagcccccattggtagaaaaaacccacaacccctcggggttatcc

SEQ ID NO: 13577 - DNA, 1008 bp, Oryza sativa
caaccggagagcggacggctaatgtgttccacttattgaacagggtctatggtcggtccgtgacccctggacgccgaaggcgtccttggggtgatctcgtagttcctacggggtggagataatggggtcggtccatggattttccttccttttgccacatttcgctcaaagggttgaagggagatagtgcatcaagctattcgcaagggccaacttgatcctcttccccagggatcccagatgagggaagcctaggagagccgccgactccaactatcgtccatgtacgatccatactagatctgaccaactgcccatcctacctcctctacctttttgacagcccatctttttgtctcagtagagtctttcagtggcatgtttcagtcctcttccccattacttagaaaaagtgagccaccggttcaggtacaagatactaccattaccgcctggacaattagacagccaacccgtaatcgcaacgacccaattgcaagagcggagctctaccatatgagctatatccccccgagccaagtggagtatgcatgaaagagtcagatgcttcttctattcttttccctggcgcagctgggccatcctggacttgaaccagagacctcgcccgtgaagtaaatcatcgcccctacgatccaaccaattgggagagaatcaatagactccttttcgggagcgattcatccttcccgaacgcagcatacaactctccgttgtactgcgctcttcaagtgtgcttcttccccttctcccccttaccatggcaagtccttgggaaataactccgatgggcagaaaaaggaaggcgttaagagaccctcctggcccaaccctagacactctaagatcctttttcaaacctgctctgctcccatttcgagtcaagagatagataaatagccacatcccattgcactgatcgagggcgctcgtagtgacttagggagtcgaagaccaagaagtggcttatttataccaagcattcct

SEQ ID NO: 13578 - DNA, 7808 bp, Oryza sativa
  unsure (1)..(7808): unsure at all n locations
accccacaggcttgtactttcgcgtctctctaaaattgcagtcatggtaagatctttgtttattcaaattgcaaggactcccaagcacacgtattaactagaaagataatagaaggcttgttatttaacagtataatatagactatataccaatgtcaaccaagccagccccgacagttgtatatccatacaacaaaatttaccaaaccaaaaaattttgtaaatgaagtgagtgaaaaatcaaaactcagattgctcctttctagtttccatatgggttgcccgggactcgaacccggaactagtcggatggagtagataattattccttgctacaatagagaaaaaacctctccccaaatcgtgcttgcatttttcattgcacacgactttccctatgtagaaataggctatttctattccgaagaggaagtctactaatttttttagtagtaagttgattcacttactatttattatagtacagagaacatttcagaatggaaactgtgaaagttttaccttgatcatttatcaatcatttctagtttattagttttgtttaatgattaattaagaggattcaccagatcattgatacggagaatatccaaataccaaatacgctcactgtgcgatccacggaaagaaaagtaagttgttttggcgaacatcaaagaaaaaacttgctcttcttccgtaaaaaattcttctaaaaataccgaacccaaccattgcataaaagctcgtaccgtgcttttatgtttacgagctaaagttctagcgcatgaaagtcgaagtatatactttagtcgatacaaagtcttcttttttgaagatccactgtgataatgaaaaagatttctacatatccgaccaaaccgatcaagaatatcccaatccgataaatcggtccaaattggtttactaataggatgccccgatccagtacaaaattgggcttttgctaaagatccaatgagaggagtaacagggactttggtatcgaattttttcatttgagtatctattagaaatgaattctccagcatttgattccttactaacaaagaatttattggtacacttgaaaagtaccccagaaaatcgaagcaagagttttctaattggtttagatggatcctttgcggttgagtccaaaaagagaaagaatattgccacaaacggacaaggtaacatttccatttcttcttcaaaagaagagttccttttgatgcaagaattgcctttccttgatatcgaacataatgcataaggggatccataacgaaccatatggttttccgaaaaaaagcagggtacattaacccaaaatgttccatcttcctagaaaagatgattcgttccagaaaggttccggaagaagttaatcgcaagcaagaagattgtttacgaagaaacaacaagaaaaattcatattctgatacataagagttatataggaaccgaaatagtcttttattttcttttttcaaaataaaaatggatttcattgaagtaataaaactattccaattcgagtagtagttgagaaagaatcgcaataaatgcaaggatggaacatcttggatccggtattgaaggagttgaagcaagatatccaaatggataggatagggtatttctatatgtgctagataatgtaagtgcaaaaatttgtcttctaaaaaaggaaatattgaatgaatagatcgtaaattctgaaactttggtatttctttttcttccggacaagactgttctcgtagcgagaatgggatttctacaacgatcgcaaacccctcagatagaatctgagaataaaactcagaataaaaaaaattgttgtaatccaataatcgatcttggttaggatgattaaccaaattaatccaaaaattctgctgatacattcgaatcattaaccgtttcacaagtagtgactaaatttcttgttattagaaccaataatttcgacaagttcggaaccatttaatccataatcatgggcaaacacataaatgtactcctgaaagagtagtgggtagacgaaatattgtctaggaaatttaagtttttctgaataaccctcgaatttttccatttgtatttctacttgaatcagagagagagaaatatttctcggtttatcaaatggtgatacatagtacaatatggtcagaacagggtgttgcattttttaatacaaacccctggggaagaaaaggagtctaatccacggatctttttccgctccttttctatccaatttgtttatgtttgttctaattacaaaagagaacaaatcctttatttttgcaggccaattgctcttttgactttgggatacagtctctttatcaatatactgcttcttttacacattcaatccataacatccttttcaatccaaaatcaagaataattaggatttctaaaaaaaaaagaaaaaatcaaaggtctactcataggaaaaccagcttttccctacatcaggcactaatctatttttaacgtctaattagatcagggagttcttccaattaagaagttaagctcgttgctttttgttttaccagaattggagccaggctctatccatttattcattagacccagaaaatcagaatttttttattccattccaaaaatccaaaataagaaattgattttattacgacatgctattttttccattcattacccttgaggatcagtcgcggtcttatagactctaccaagagtctggacgaattttttgcttcatccaaatgtgtaaaagatcatagtcgcacttaaaagccgagtactctaccattgagttagcaacccagataaactaggatcttagatacgatcgaaatccaaaaatcaatggaattacaccgcacacccctgtcaaaatcttaaaatagcaagacattaaaagaaagattttatcaccattgaaaacactcagataccaaaaggaacgggtctggttaaatttcactaaggttaaaagtggcaccaatcacgatcgtaaaattgtcatttttttagcatttttatttaaataaataaataaatcttgtatgagagtacaaacaagagggacaaccctaccatttgagcaaagtgtaggcaaaaaacctaatagggagtgaggataaagagacttatccatctacaaattctagatgttcaatggacctttgtcaatggaaatacaatggtaagaaaaaaattagatagaaaaactcaaaaaaataaaggcttatgttggattggcacgacataaatccagtcaaaaataggattaagaaagaggcaaattatttctaaatagttagacaacaagggatactagtgagcctctcctagttttttattcatttagttcttcaattaactcaaagttctttctttttctttaaagaattccgccttccttaaaatatcagaaacggttcttgtaggttgagcacctttttcaaggaaatagagaatagctggaacatttaaacaagtttgattctttatcggatcataaaaacctacttttcgaagatctcttccttctcttcgagatcgaacatcaattgcaacgattcgatagacagcttattgggatagatgtagataaacaaagccccccctagaaacgtataggaggttttctcctcatacggctcgagaatatgacttgcattaatttccgtacagaaaaaacaaatttcatttatactcatgactcaagtgactaattttgattgacagacttgaaagaaaaaaatcctttgaaattttttgagtggtctctaaactcttttctttgcctcatctcgaacaaattcacttttattccttattccggtccaattctattgttgagacagttgaaaatcgtgtttacttgttcgggaatcctttatctttgatttgtgaaatccttgggtttaaacattacttcgggaattcttattcttttttctttcaaaagagtagcaacatacccttttttcttatttccttcgataaagcatttccctcttctatagaaatcgaatatgagcgattgattctgatagacttttaatcaaaagagttttcccatatcttccaaaattggactttcttcttattttaaccttttgatttctatattatttcgatttctatattaagggtagaatgacaaagttggcctaatttattagttttcactaaccctagattctttcccttgataaaaaataaattctgtcctctcgagctccatcgtgtactatttacttagcttacttacaaacaacccagcgaaaattcggttcgggaccaatagaacagactatgtcgagccaagagcattttcattactatggaaaatggtggatagcaaaatccacaatcgatcgtgtccttcaagtcgcacgttgctttctaccacatcgttttaaacgaagttttaacataacattcctctaatttcattgcaaagtgttatagggaattgatccaatatggatggaatcatgaatagtcattagtttcgttttttgtatactaattcaaacttgctttgctatctatggagaaatatgaataaaagaaattaagtatttatcgggaaagactccgcaaagagccaatttatttaaacccatattctatcatatgaatgaaatatagttcgaaaaaagggaataaacaagtttgcttaagacttatttattatggaatttccatcctcaacagaggactcgagatgatcaatccaatcctgaaatgataagagaagaattgactcttctccaacaaataaactatcaacctcccgtttaattaatttaattaatatattagattagcaatctatttttccataccatttttccgtaacaaaactaattaactattaactagttaaactattgcaatgaaaagaaagttttttggtagttatagaattctcgtatttcttcgactcgaataccaaaagaaagaaaaaaatgaagtaaaaaaaacgcatttcctgtaaagtaaaattaaggtctttgcttttacttattttttcttttacctaaaagaagcaactccaaatcaaaattgaatccattctatctaacgagcagttcttatcttatctttaccgggatggatcattctggatatttaaaaaatcgcggatcgagatcgtttttgcttaaccaaagaaagaaaaagaagaaggaaccttttttactaataaaatactataaaaaaaatttatctctatcataaatctatctctaccataaaggaataggtctcgttttttatacaatgttctacgtcaagtttaaaattttttcatgaaaaaaagattttcaatttgactggacttgacactggattatgttttctgagacagaaaatgaacgcattaggactgcatcgaatctaagagtttataagagaaaaaaattctctttaataaactttatgtctcgtgcagaatacaatacgatttcatctttcgtttcatcagaaaaaatctgggacggannnnnnnnnnnnnnnnnnnnnnnnnnnnnnnnnnnnnnnnnnnnnnnnnnnnncacgccccatttcgggttttatgcgacactaataaacagtattatgtttatttcttattcgtcaatcctacttcaattacataaaaatggggggtattctcttggtaggattctagacatgcgaataatatagaatccaaaaaatgcattgatcattacatggaattctattaagatattatatgaaagtcgaatttcttccactctcatttgagagtgcgaatacaaggaggtattttgtgtttgggaaagtccgaagaaaaaaggattttgaatcctccttttcctttttcccttagaaaaataactcaatcaaaatccaattatctactctacaagaacgaaacgcttgttatgcctaatatacttagtttaacctgtatttgttttaattctgttatttatccgactagttttttcttcgccaaattgcccgaagcttatgccattttcaatccaatcgtggattttatgcctgtcatacctgtactcttttttctattagcctttgtttggcaagctgctgtaagttttcgatgaaatctttactactctgtctgccaaattgaatcatgtattcattctaaaaaaattcgaaaaatggataagagccgagaagtcttatattatgaaccttcgattctaaaattcaaattcttctacattgaatgtatagctgcagcaataaatttggatcagcctttctactccctgcatctacgttgagcaggtatctttaggtaaccgcacaatacctaacctaatttattgataagagtgcttattataaatcaattcttgcaatttttttcaaaaattgatttttgcatttttaggtgtcaaaataaacaaaacccatcctagtggatttgtgtggtaaggaaaaacgggtaatctattccttaaaaaaaaatcttggagattatgtaatgctcactctcaaactttttgtttatacagtagtgatattctttgtttccctctttatctttggattcttatctaatgatccaggacgtaatcctgggcgtgacgagtaaaaatccaaaattttttcttacaaattggatttgtttcatacatttatctacgagaaaatccgggggtcagaattccttccaattcgaaagtcccaaacgatccgagggggcggaaagagagggattcgaaccctcggtacaaaaaaattgtacaacggattagcaatccgccgctttagtccactcagccatctctccccgttccaaatcgaaaggtttccgtgatatgacagaggcaagaaataacgattgcaaaaaatccttcctttttctttcaaaagttcaaaaaaattatattgccaattccattttagttatattcttttttcttaatgttaataaaaaaaagaagaaaattcttcttttttctttctaattctaaaattggatattggctaaaagacaatcagatagattttctcttcagcaggcatttccatataggacttgttataataaaacaagcaggttatagaaaaaaactcttttttttattatttatcaacaaagcaaaaaggggtcttatcaaaccaacccaccccataaaattggaaagaaagataaagtaagtggacctgactccttgaatgaggcctctatccgctattctgatatataaattcgatgtagatgaaattgtataagtggatttttttgtatttccttagacttagaccacgcaaggcaagaatttctcgctatttactatttcatattcttgttactagatgttctataggaataagaagaaatcgcaacccctttccgctacacataaaaatggatttcgaaagtcaatttttcttttcaatatctttactttttttcagaatcctatttttgttcttatacccatgcaatagagagcgagtgggaaaagggaggttactttttttcatttttcccttaaaaaataggctttcttggaaataggaatcatggaataatcctgaattccaatgtttatttctatagtataagaaaaactaattgaatcaaattcatggatttaccacgacctcggctgtgacccatagataaaaatgcaaaatttctatcttcgagaccattgaaaaaaggcattgaacgagaaaaaatcgtccacagataatctatcgtatgccttggaagtgatataaggtgctcggaaatggttgaagtaattgaataggagtgcatgaactacttg

SEQ ID NO: 13579 - DNA, 3080 bp, Oryza sativa
  unsure (1)..(3080): unsure at all n locations
tatattccctgaggaggttctaccacgtggaaacgctctttaatggaacttttgttttagctggtcgtgaccaagaaaccaccggttttgcttggtgggccgggaatgccagacttatcaatttgtcgggtaaactacttggagctcacgtagcccatgcaggattaatcgtattctgggccggagcaatgaacctatttgaagtggcccatttcgtaccagaaaaacccatgtatgaacaagggttgattttacttccgcacttagctactctaggttggggagtagggcccgggggagaagttctagatacttttccgtactttgtatctggagtacttcatctaatttcctccgcagtcttaggcttcggtggcatttatcacgcgcttctgggaccggagactcttgaagaatcttttccattctttggttatgtgtggaaagatagaaataaaatgactacaattttgggtattcacctaattttgttaggtataggtgcttttcttctagtactcaaagctctttattttggcggtatatatgatacctgggctcctgggggaggagatgtaagaaaaattaccaatttgacccttagccccggtgttatatttggttatttactaaaatccccttttgggggagagggttggattgttagtgtggatgatttagaagatataattgggggacatgtatggttgggtttcatttgtgtatttggcggaatttggcatatcttaaccaaacccttcgcatgggctcgccgtgcatttgtatggtctggagaagcttacttgtcttatagtttaggcgctttatctgtctttggttttatcgcttgttgttttgtctggttcaataatacagcttatccgagtgagttttatggacctactgggccagaagcttctcaagctcaagcatttacttttctagttagagatcagcgtcttggagctaatgtgggatctgcccaaggacccacaggtttaggtaaatatctaatgcgttccccaacgggagaggttatttttggaggggaaactatgcgtttttgggaccttcgtgctccatggttagaacctctaaggggccccaacggtttggacttgagtaggttgaaaaaagacatacaaccttggcaagaacgacgttcggcagaatatatgacccatgctcctttaggctcttaaattctgtgggtggcgtagctaccgagatcaatgcagttaattatgtttctcctagaagttggttagcgacttcccattttgttctaggattcttcttttttgtgggccatttgtggcatgcaggaagagcccgggctgctgcagcaggatttgaaaagggaatcgatcgtgatttggagcctgttctttacatgacccctcttaactaagattttcttatttatacctgttctactgtttttttctgttctggctcggttattctatctagccgagccattcattcctttctatgaaagaaagataaggggacagaacaaaaaaaacaaataaagaaacaaacgtattcaatacgcaaaagaaaagagagaggaaagcaaaaggagagagagggattcgaaccctcgatagttcctagaactatannnnnnnnnnnnnnnnnnnnnnnnnnnnnnnnnnnnntctctccacagcctaatccttattttattcctacaaatagaacatagccatacgaaatgactcactaacctctagaaacatctcaaatacaaatcccttttcgatatatttctgtatactgtatccatgtatacaggatccgctatatccgcttgtgaaataaagcataaaaccccctcaaccccatatccaaataaaaaaagtggtgagtaataagttttaaagagaagaatcaatggattcatgattaaacccctcctacttcttgtattttattacaattttgattaagtgagggatcaaatataatatgtagtcaactttatttgatggtaacttggaggattagaaatatgactattgctttccaattagctgtttttgcattaattgtgacttcctcagtcttagtcattagtgtaccccttgtatttgcttctcctgatggttggtcaaacaataaaaacgttgtattttccggtacatcattatggattggactggtctttctggtagctattctaaattctctcatttcttaaatgtgtttagtacttagtagcccgatacaaaataaaaaagggccgtttattcggattgtgagacgcattaaaatgcaatttgcgccccgaattgattgacagacaattaaattaataaaaagaaaactcaaatagaaaatgaaacggtcgacccagacatagacggtcgacccaggcggatataccctataaaatataggacgtagcgagcgtagttcaatggtaaaacatctccttgccaaggagaagatacgggttcgattcccgccgctcgccagcttaatttagtaaggtactatgataaaaaatttagtctacttttattaaagtaataggtgttagtctagtaccgtacccctttactatcttaaccccctttgcaccccactcaaaaaaagagcactacagcggcgggaatcgaactcggcaacagggttccctaaaccggggattcaccgaaacaaacaaccagcaaacagcttttaaagggaagggagatagactgtgcctttctttcatttattttttcttttctgcaaggtagggagggggccttgagagttcctcttgtggtagcaagttacttcgcaacctgctcaatttggccttatagggtcgggaactaatgaataaaaagggttggataccgcccaaccacccagccctctaccatgtctagacaaatagaatagttattttatacagactgctaagtgcggagacgggaatcgaacccgtgacctcaaggttatgagcctcgtgagctaccaaactgctctactccgctctggagcgctggaaaccggtggacgaaaaaggttgaatacaggcctctaccatgtctagacaaatagaatagttattttatacagaa

SEQ ID NO: 13580 - DNA, 1209 bp, Oryza sativa
aacgtctctaattcaaaaccgaacatgaaattttgatttcattcggctcctttatgggtattctcaccacttaacatctaagtcagcttttttgtctgaatggaaccaaggctctctgctttctagatgatccctaaagagtaggagatagaaatttgcctaaatctatctaatctaattacttcgttccctaatttcatttaagagatcctgaggaaaagaattgggtttccaccgagctgaaacaatatgctgatggttctagtaaaccaaaactaccgttttttagctatttggcttccatttccttttttaacaaaagaagatttagttacgattggaaataaatttttttgtatcttcatccatagatcctttactcatatttaaaaaattggaatccttaatccaatgcaaaattatgcttcgcgactctgtactcataatccaaatcctatttgttttttggatgcaatttcaattagtctttgggtacaaatcgcgaaaatgcatattcttcctcaatatgctattgagagaaaaaggagtaaatcctttctaagaactaaagttttcatcggaatataaaaaaccttaaggacgccttaagtatatcatttcaaattcagttattaatagaacgaatcacacttttaccactaaactatacccgctacatgtaaattctgataccaacgctaccctttgtcaagggtagccattcgagaaagatgctaattccctcttagttaatgaaacagagaaggttcctcacagttagcggttggtacttcgatcgcgggcctttcctttactttcttttttgttcagaattgaacaaagaatttggggaagaaaacatcttcccccacttatcatgaaatctgggccatagagaaagagtgagatgtttttttttatttatcatagacactttccctatggcttgagagaaacaataaataacttaaagaaaaaggcacataggagccgaaggatttacttgatgtaaagaagattctgaatgtctctgcttagtcgattctctccgtttaactttttcttctcttcttttccactcaattctagtttattagattcttgtttaaaagaatcaaagaagatgaatagaactaagaacacacaaaaaagaacatataggcccgagaccattaccaaaagttcttcccaataatcatattgggtatc

SEQ ID NO: 13581 - DNA, 2078 bp, Oryza sativa
agatggagaaagttttcatgataagatcagccaatagaagaaaaaagtccctaatttttcagaccgttctgagcatgtgaaaagtcaatagcctaaagataaaaaaccctatactttgtgcaagtgataagagagaatatgaaagattttcctatttttcttgattttcttaagatttttttgaacctgaccatgaatagacttatatatctcgatatatacagatataatgtacattatggagtagacctataatgggaaatgaaagtggctaattttggaattgaataagaagcccttttaactcagtggtagagtaatgccatggtaaggcataagtcatcggttcaaatccgataaagggctttttttacttagtggtagagtaatgccgcggtaagacgtgagtcagtggttcaaatccgatacagtacttttctactaaattcattcactttctttctttttgaaaatttctctttttttattgaatttgataacttagtgcgagatgcatgcatttttagtttaaacactaagcgaagcaggggggtgtaaattccaaaaaagaaattggactctttttcctattagatcaatcaaatcactacccgtactgaactaatatagaatcccttttattaatctattcttattccatatcctttataaacgaatttccctaaaaagtaggggatgatccgtgaattaacctaaccatcaactaaaaaaaatcctacaaaagcataatggaaaagtaggaaggactccttgctttggatctagttatactcttcgagtatattgacaattccaaaaaactgctcatactatcattatagtataatgaggagcggttgtataccgccctatcgtctagtgatgcccctatcgtctagtggttcaggacatctctctttcaaggaggcagcggggattcgacttcccctgggggtagggagtattatgaaaggaggttaatcatagattatcaaaaaccctagaataaattcttcctgggtcgatgcccgagcggttaatggggacggactgtaaattcgttgacaatatgtctacgctggttcaaatccagctcggcccaaaaatctagggcttcgtgaatatgagttaaatccattttttttcttccataaaaaagaatatttgatccatagaaataaaagaaataaaggataaaaagaaaaggggaaatatctttctaatctatatctctttcattcctctcttacaaacaaaagaccttttcttattggttattgaaaggtggattattatctatttttagcgataataaatcgcgacatactagttatgtcattctcactatacccccatacgatacgggggtatgtagtatatgattcgtctatttcttagagtaggacaggcgaatattcttattcttatggttccatttaagaataagtatgccatacgccccgcggggattgtagttcaattggtcagagcaccgccctgtcaaggcggaagctgcgggttcgagccccgtcagtcccgaactagggttcaatgaatggagaaattcatctttcctttttccatgaaaaaaggggggcaggaagcaagatcaaatacctatggggtacccctatttcactttttttagttcgcgtttctcagtaaagagaggagagtataggaatttttttatcactacttctggttgatagcgaaagacatacatatcatacgtggaagggatcctcctatgttatactattccactctcaaccatgaattgatttgatagatccgatattcataatattgaattgattcagtattatcagaatgcaagtcctccccttgaatttacaggatacccttttccctctccatgggattacatcccgagttattgcgaaaaaaaagaggttatggaagtcaatattctcgcatttattgctactgcattgttcattctagttcctactgcctttttacttattatttatgtaaaaacagtcagccaaaatgattaattggaagttcaattaatcattgaagaaatgaaaaagggattaaataaaataaaa

SEQ ID NO: 13582 - DNA, 8271 bp, Oryza sativa
attatattatcttgaatctacatagaatagattactagattgaaatagtagtctaattcaatttcttttttcactgcatccacttaatttcaatcaagtcaaaatgaaaaaatccatggagggagagaaaaataatatgagaatagactatagtaaaagaaaaaaagtaaaaggaaaaaaccagcgaatctttcatgcttaaacatgtcgcgaaatgtttcaaaagagcataaaatttattttaagaactaagaataagaaaagaatataaaacaaatggaaaatgtgcgatatgttgggaatagctccgcggaagaaaatctaaagttcttatgtatagaacttttttaaccatgggtcgcttctagtagcgattatgaattgctctcaccgctctttctatttctattttctattctttctatttctattctactatatagaaatagaaatagaaagaatagaaagactctttcttacaagagtttcttacaggagtgaaacaaaattaaagaaagagagaaagaataaagttcggcaaaatgattaatgcaaaacggtcaattaaagaaaagagttgatacaacaattcgactactcaatcaattagtagtatccctagagtccactcctcccccatactactagtgaaagagaaaatgtaaagactaccattaaagcagcccaagcgagacttactatatccatgtaaattatgtctcctatttctatgaaggaattattctactattgatgaataatcatagtagaatcaagggtacagagtcaaaaaggggttctgacctaaggctatggatgaatcagttcaaagaatttactcttaacaaattcttagagtatttctggtagaattggggagcattaagtataaatatgatacatagccctttcttattaataaaagaataaggaaacgctatctcatccctattggtatcggtttgggccactactgctaaaacaaaccccagtttgaggaaagaacggtgggttctcaaaatccagtatcgccgagccttgttattctcttgccccaacttatgcggggtgcaaatttgtcgatttggatcagtactataagcctaagtattttattgatcaggcggcacccagatttgaactggggataaaggatttgcagtcccctgccttaccgcttggccatgccgccaaaaaatacgatctaaaatcgagaaaagagcaagtattcatccacgtttcttactaaaactaactttcttttatcttaaatctaattctacttacttttttccaatctttttcaaaaaatctattcatgctttttttggatccagtttcgattattctcctcaaaggattctatcttaaaacacacattgctaacactagaaaacttcccttttctttctattgaaatgaaaaaggagaaaagtggatttctagtcacaagctacaaaattaagaacaaattggaaccattaactagaattctctttttattttgaatttcggtattctctcccgcctgccatttaatgtcataataaaagacaatggatttatgcctaatccgtatataggtaaactccaggtccgaacagcattattatctatggatcccccttatgtacatatctctgtggagaatcgttctttaatttttcattgcattaaatatcttgaataaaaaaaagaaaattgactttgctatgtggaggtccagaactagattggcatgtacttaaaaaagtacttactttattttaggattctacaacgaaatcttatatcttatattttatagaaattctactactacgaaacaaaaaagaaccttcaaattcttttttgaaattaaactaagcgtgctattctcaatcgaactaaagtcaaactttctagtgcttataaattattatattttggttttatcccattcatagaaaggagaaaaaatgagaaatctttgccgtccaatctaagaatatcataaactgtaagtggcagaatttttttcgaggttctaggaatgttttatcacttcattttcattccatttggacccctgggaaattcgaactttcgttgaaattgtctctattcatatgtatgaaatacatatatgaaatacgtatgtggagttcccgagaatttcatgtgatttagtaaacagaatatagattccataattgctagatcgatctgtagggattgatgaagagtgagctgataatggaatttttcttcgataaacaggaaacttaagattaagatgctccggaatggaaatgagggaatgtccacaatacccggatttagtcagatccaattcgagggattttgtaggttcattaatcaaggcttggcagaagaacttgagaagtttccaacaattaaagatccagatcacgaaatttcatttcaattatttgcgaaaggatatcaattgctagaaccttcgataaaagaaagggatgctgtgtatgaatcactcacctattcttccgaattatacgtatccgcgcgattaatttttggtttcgatgtgcaaaagcaaaccatttctattggaaacattcctataatgaattccttaggaacctttataataaatggaatataccgaattgtgatcaatcaaatattgctaagtcctggtatttactaccgctcggaattagaccataaaggaatttctatctacaccgggactataatatcagattggggaggaagatcggaattagcaattgataaaaaagaaaggatatgggctcgcgtgagtagaaaacaaaagatatctattctagttctatcatcagctatgggttcaaatctaaaagaaattctagataatgtttcctaccctgaaattttcttgtctttccctaatgctaaggagaagaagaggattgagtcaaaagaaaaagctattttggagttttatcaacaatttgcttgtgtaggtggggacctggtattttcggaatccttatgtgaggaattacaaaagaaattttttcaacaaaaatgtgaattaggaaggattggtcgacgaaatatgaatcgaagactgaatcttgatatacctcagaacagcaccttcttgttaccgcgagatgtattggccgctacggatcatttgattggaatgaaatttgaaacgggtatacttgacgatgacgatatgaatcacttgaaaaataaacgtattcgttcggttgcggatctgttacaagatcaattcggactggctcttggtcgtttacaacatgcggttcaaaaaactatccgtagagtattcatacgtcaatcaaaaccgactccacaaactttggtaactccaacttcaacctcgattttattaataactacttacgagaccttctttggtacatatcccttatctcaagtttttgatcaaaccaatccattgacacaaacggttcatgggcgaaaagtgagttgtttgggtcctggaggattgacggggagaactgcaagttttcggagccgagatatccatccgagtcactatgggcgtatttgtccaattgacacgtccgaaggaatcaacgttggacttactggatctttagctattcatgcgagaattgatcattggtggggatccgtagagagtcctttttatgaaatatctgagaaagcaaagaaaaaaaaagagagacaggtggtttatttatcaccaaatagagatgagtattatatgatagcagcaggaaattctttgtccttgaatcggggtattcaggaagaacaggttgttccagctagataccgtcaagaattcctgactattgcatgggaacagattcatgttagaagtatttttcctttccaatatttttctattgggggttctctcattccttttattgagcataatgatgcgaatcgagctttaatgagttctaatatgcagcgccaagcagttccgctttctcggtccgagaagtgcattgttggaactggattggaacgccaaacagctctagattcgagggtttctgttatagccgaacgcgagggaaagatcatttctactaatagtcacaagatccttttatcaagtagtgggaagactataagtattcctttagttacccatcggcgctctaacaaaaatacttgtatgcaccaaaaacctcgggttccgcggggtaaatccattaaaaaaggacaaattttagcggagggggctgctacggttggtggggaacttgctttaggaaaaaacgtattagtagcttatatgccatgggaaggttacaattttgaagacgcagtattaattagcgaacgtttggtatatgaggatatttatacttcttttcacatccgaaaatatgaaattcagacggatacaacaagccaaggctccgctgaaaaaatcactaaagaaataccacatctagaagaacatttactccgcaatttggacagaaatggagttgtgaagttggggtcctgggtagaaacaggcgatattttagtaggtaaattaacgcctcagatagcgagcgaatcgtcctatatcgcggaagctggattattacgggccatatttggtcttgaggtatccacttcaaaagaaacttctctcaaactaccgataggtggaagaggacgcgttatcgatgtgaaatggatccagagggatcccctcgacataatggttcgtgtatatattttacaaaaacgcgaaatcaaagttggggataaagtagccggaagacacgggaataaggggatcatttccaaaattttgcctaggcaagatatgccctatttgcaagatggaacgcctgttgatatggttttcaatcccttaggagtaccctcccgaatgaatgtgggacaaatatttgaaagctcgctcggattagcaggggatctgctaaagaaacattatagaatagcaccctttgatgagagatatgagcaagaggcttcaagaaaacttgtgttttcagaattatatgaagccagtaaacaaacaaaaaatccgtgggtatttgaacccgagtacccgggaaaaagcagaatatttgatggaagaacaggagaccccttcgaacagcctgttctaatagggaagtcctatatcttaaaattaattcatcaagttgatgagaaaatccacggacgctctactgggccctattcacttgttacacaacaacccgttagaggaagagccaagcaagggggacaacgaataggagaaatggaagtttgggctttagaaggatttggtgttgctcatattttacaagagatacttacttataaatctgatcatcttatagctcgccaagaaatacttaacgctacgatctggggaaaacgagtacctaatcacgaggatcctccagaatcttttcgagtgcttgttcgagaactacgatctttggctctagaactgaaccatttccttgtatctcagaagaacttccaggttaatagggaagaagtttgatcggaataaatataaattcttttcttatttctattttatgattgaccaatataaacatcaacaacttcaaattggactcgtttcccctcaacaaataaaggcttgggctaacaaaacactacctaatggggaagtcgttggcgaagtcacaaggccctccacttttcattataaaaccgataaaccagaaaaagatggattgttttgcgaaagaatctttggacccataaaaagcagaatttgtgcttgtggaaattctcgagcgagcggagctgaaaacgaagacgaaagattttgccaaaaatgcggagtagaatttgttgattctcggatacgaagatatcaaatgggatacatcaaactcgcatgtcccgtgactcatgtgtggtatttaaaaggtcttcctagttatatcgcgaatcttttagataaaccccttaagaaattggagggcctagtatatggcgatttctcttttgctaggcccagtgctaaaaaaccaactttcttacgattacgaggtttattcgaggatgaaatttcatcctgtaaccatagcatttccccctttttttctaccccaggctttacaacatttcgaaatcgggaaattgcgacaggagcaggtgctattagagaacaattagcagatttggatttgcgaattattttagagaattcctcggtcgaatggaaggaattagaagacgaggggtatagtggagatgaatgggaagatagaaaaagacgaataagaaaagtttttttgattagacgcatgcaattggcgaaacattttattcaaacaaatgtagaaccagaatggatggttttgtgcttattaccagttcttcctcccgaattaagacccattgtttataggtctggggataaagtagtgacttcggatattaatgaactttataagagagttatccgtcggaacaacaatcttgcctatctattaaaaagaagtgaattagcgccagcagatttagtaatgtgccaggaaaaattggtacaagaagccgtggatacacttcttgatagtgggtcccgcgggcaaccaacgagggatggtcacaataaagtatacaaatcactttcagatgtaattgaaggtaaagaggggaggtttcgcgaaactctgcttgggaaacgggtcgattactcggggcgttctgtcattgttgtgggtccttcactttcattacatcaatgtgggttacctctagagatagcaataaagctttttcagctatttgtaattcgcgatttaatcacgaaacgtgctacttctaatgttaggattgctaaaaggaaaatttgggaaaaggaacccattgtatgggaaatacttcaagaagttatgaggggacatcctgtactgttgaatagagcacctaccctgcatagattaggcatacaggctttccaacccactttagtagaggggcgtactatttgtttacacccattagtgtgtaaaggtttcaatgcagactttgatggggatcaaatggctgttcatctacctttatccttggaagctcaggcggaagctcgtttacttatgttttctcatatgaatctcctatctcccgctattggggatcctatttgcgtaccaacccaagacatgcttatcggactttatgtattaacgattggaaaccgtcgaggtatttgtgcaaatagatataatagttgcggaaactatccaaaccaaaaagtaaattacaataataataatcctaagtatacgaaagataaagaatctcttttttctagttcctatgatgcactgggagcttatagacagaaacaaatctgtttagacagtcccttgtggctccgatggaaactagatcaacgcgtcattgggttaagagaagttccgattgaagttcaatatgaatctttggggacttatcgtgagatttatgcccactatctagtagtgggaaatagaaaaaaggaaatccgttctatatacattcgcaccactcttggtcatatttctttttatagagaaatagaggaagccatacaaggatttagtcaggcctattcatacactatctaaacaaggaagttagattcggggatgcccctttcgaggggcattccgatttcgctagtatcatcatttttgccgcacgaatccagattgagattgaggaaaggaagttaactaagttttcgaatcactgactcaggcccattgtcgaatcctactcagcaattgtcgaattatactcagccgaaaaagggggtacttatttatggcggaacgggccaatctggtctttcagaataaagagatagatggaactgctatgaaacgacttattagcagattaatagatcatttcggaatgggatatacatcccatatactggatcaaataaaaacgctgggcttccatcaagccactactacatcgatttcattaggaatcgaggatcttttaacaataccctctaagggatggttagtccaagatgcggaacaacagagttttcttttggaaaaacactattattatggggctgtacacgcggtagaaaaattacgccaatccgttgaaatctggtatgctacaagtgaatatttgaaacacgaaatgaattcgaattttcggataacagatccttctaatccagtctatctaatgtctttttcaggagctagaggaaatgcatcgcaggtacaccaattagtaggtatgcgaggattaatggcggatcctcaaggacaaatgatt

SEQ ID NO: 13583 - DNA, 13265 bp, Oryza sativa
  unsure (1)..(13265): unsure at all n locations
ctatccaagctatttctgtgagtcctcaaaatgggatgacggaaaaactttttgtacaaacattaattggtcgtgtattagcaaacgatatatatatcggttcacggtgcattgccactcgaaatcaagatattggaattgggttagtcaatcgattcataaccacctttcgagcacagccatttcgagcacaaccaatatatattagaaccccctttacttgccggagcacatcttggatctgtcaattatgttatggtcggagttccactcatggcgatctggtcgaattgggggaagctgtaggtgttattgcgggtcaatctattggggagccagggactcaactaacattaagaacttttcatactggtggggtattcacagggggtactgccgaccttgtacgatccccttcaaatggaaaaatccaattcaatggggatttggttcaccccacacgtacccgtcatgggcagcctgcttttctatgttatatagacttgcatataactattcagagtcaggatattctacatagtgtgactattccttcaaaaagcttgattctagtgcaaaatgatcaatatgtagaatccgaacaagtaattgcggagattcgtgccggaacgtccgctttgcattttaaagaaaaggtacaaaaacatatttattccgaatcagatggggaaatgcactggagtaccgatgtttatcatgcgcccgaatatcaatatggtaatcttcgtcgattaccaaaaacaagccatttatggatattgtcagtaagtatgtgcagatctagtatagcttctttttcgctccacaaggatcaagatcaaatgaatacttattccttttctgttgacggaaggtatatctttggcctctcgatggctgatgatgaggtaagacatagactgttggatacttttggtaaaaaagatagggaaattcttgattattcaacgccggatcgaatcatgtccaatggtcattggaattttgtctatccttctattcttcaaaataattttgatttgttagcgaaaaagcgaagaaataggttcgccattccattacagtatcatcaagaacaagagaaagaaccaatatcctgttttgggatttcgattgaaataccctttatgggtgttttacgtagaaatactatagttgcttattttgacgacccacgatacaaaaaagataaaaagggttcaggaattgttaaatttagatataggaccctagaggacgaatataggactcgagagaaagactcagagaacgaatacgggagcccagaaaacgaatataggacccgagaggaagaatgtaaaaccctagaagacgaatataggactcgagaggaggagtatgaaaccctagaagatgaatatgggatcccagagaacgaatatgaaaccctagaagatgaatatggaatcctagaggacgaatataggactcgagaggaggaatccgaggacgaatatgggagtccagagaacaaatataggccccgagaggataaatatggcactttagaggaagactcagaggacgaacatgggactttagaggaagactcagaggaagactcagaggacgaatatgggaacccggaggaagattccgtcttaaaaaagggggttttgattgagcatcgaggaacaaaagaatttagtctaaaataccaaaaagaagtagatcggttttttttcattctccaagaactgcatatcttgccgagatcctcatccctaaaggtacttgacaatagtattattggagtggatacacaactcacaaaaaatacaagaagtcggctgggtggattggttcgagtgaagagaaaaaaaagccatacggaactaaaaatcttttctggagatattcattttcctgaagaggcggataagatattaggtggcagtttgataccactagaaagagaaaaaaaagattcgaaggaatcaaaaaaaagggaaaattgggtctatgttcagtggaaaaaaattctcaagagcaaggaaaagtattttgttttggttcgacctgcagtcgcgtatgaaatgaacgaagggagaaatttagcaacacttttcccacaggatctcttgcaggaagagggtaatctccaacttcgacttgtcaattttatttctcatgaaaatagcaagttaactcaaagaatttatcatacgaatagtcaattcgttcgaacttgcttagtattgaattgggaacaagaagaaaaaaggaggctcgtgcttcccttgttgagataagagcaaatggtctgattcgcgatttcctaagaattgggttaatcaaatccactatttcgtatacacgaaaaaggtatgatagcagaagtgcaggactgattctccataataggttagatcgcaccaataccaattccttttattccaaggcgaagattcaatcacttagccaacatcaagaagctattggtaccttgttgaatcgaaataaagaataccaatctttgatggttttgtcggcatccaactgttctcgaattggtttttttaagaattcaaaaaatcccaatggggtaaaagaatcgaatcctagaattcctattccaaaattttgggggctctttcgaaatttttcgggactcttaggtactattgcacctagtatatcgaatttttcttcatcttactatttactaacgtataatcagatcctgttaaaaaagcatttgctccttgacaatttgaaacaaaacttcaaagtacttcaaggacttaaacactctttaataaatgaaaatcaaaggacttcaaatttcgatagtaacatcatgttggatccattccagttaaattggcactttctccctcatgattcttgggaagagacatcagcaaaaattcaccttggacaatttatttgcgaaaatgtatgtctatttaaatcgcacataaaaaaatcaggtcaaattttcattgtaaatatagattcctttgttataagagcagctaagccttatttggccactacaggagcaactgttcatggtcattatggagaaatcctttacaaaggggataggttagttacgtttatatacgaaaaagcgagatctagtgacataacgcaaggtcttccaaaagtagaacaaatcttcgaagcgcgttcaattgattcactatcgccgaatctcgaaaggagaattgaggattggaatgagcgtataccaagaattcttgggggtccttggggattcttgattggagctgagttaaccatagcccaaagtcgtatctctttggttaataagatccaaaaggtttatcgatcccaaggggtacagatccataatagacatatagagattattatacgccaagtaacatcaaaagtgcgggtttccgaagatggaatgtctaatgttttttcacctggggaattaattggactattgcgagcagagcgagcagggcgggctttggatgaatcgatctattatcgggcaatcttattgggaataacaagggtttccctgaatacccaaagtttcatatctgaagcaagttttcaagaaactgctcgagttttagcaaaagctgccttacgaggtcgtattgattggttgaaaggcctgaaagaaaacgtagttctgggggggattatacctgttggtaccggattccaaaaatttgtgcaccgttacccacaaaacaagaacctttatttcgaaattcaaaaaaaaaaactatttgcgtcggaaatgagagatattttgtttctccatacagaattagtttcttctgattctgacgtaacaaacaatttctatgagacatcagaatcaccatttaccccatttatatgatttaaggatacataaagcagattttttactttaaactagatttttgaccttagaacgctaagaggttagattttctatttttattttaatttaaaaagaagtttagttaattcattaaggttatgcttataccatgtagaaggttccatcggaacaattattatttatttcaagctatttcggctctttcttaatcttcgaaaagaaagaaatttcgtaatggaaaggtaggatgaaaaaaaagaaaaaatcaaaaggaagtgtggaaaaaatgacaagaagatattggaacatcaatttgaaagagatgatagaagcgggagttcattttggtcatggtattaagaaatggaatcctaaaatggccccttacatctcggcaaagcgtaaaggtactcatattacaaatctcgctagaaccacccgttttttatcagaagcttgtgatttagtttttgatgcagcaagtcagggaaaaagcttcttaattgttggtaccaaaaaaagagcagcggatttagtagcatcagctgcaataagggctcgttgtcattatgttaataaaaagtggttcagtggtatgttaacgaattggtcgattactaaaactagactttctcaatttagagacttaagagcagaagaaaagatggaaaaattccaccatctcccaaaaagagatgtggcaatcttgaagagaaaattatctaccttgcaaagatatctcggcgggatcaaatatatgacgaggttgcctgacattgtgatcgtcctcgatcagcaaaaagagtatatagctcttcgggaatgtgccattttggggattcctactatttctttagccgatacaaattgtgacccagatctcgcgaatatatcgattccagccaacgatgacactatgacttcaattcgattgattcttaacaaattagtatttgcaatttgtgagggccgttctctctatataagaaatcattgattaagaagaatagttaattcttgggcaactgcgtagatttatggaatcacttactattcttttttgttttgcatagaaaaaagacggggaatattgatatatattagagggtattgatatatattatcatctgatgtgatttcttgatatcctaaatataagattaatacttcacgttgctgagttgagaaaaagatggttgaatcaaaagaattctttttttgaagttcattttttatcaggggacaatatgaatattataccgtgttccattaaaacactcaaggggttatacgatatatcgggcgtagaagtaggccaacacttctattggcaaataggaggtttccaaattcatgcccaagtacttatcacttcttgggtcgtaattactatcttgctaggttcagttatcatagctgttcgcaatccacaaaccatcccaaccgatggtcagaatttcttcgaatatgtccttgagtttattcgagacttaagcaaaactcagattgagaagaatacggtccctgggttccctttattggaactatgttcctttttatttttgtttcgaactggtcgggtgctcttttaccttggaaaattatacagttaccccatggagaattagcagcgcccacgaatgatataaatactactgttgctttagctttactcacgtcagcggcatatttttatgcgggtcttagcaaaaaaggattgagttatttcgagaaatatattaaaccaactccaatccttttaccaattaacatattagaagatttcacaaaaccattatcgcttagtttcggacttttcgggaatatattggcggatgaattagtcgttgttgttcttgtttctttagtccccttagtagttcctataccggtcatgtttcttggattatttacaagcggtattcaagctcttatttttgcaacgttagccgcagcctatataggtgaatccatggagggtcatcattgaattgactagttttcaaaatagtcttttttttagcttaactcaattcatgcatggttgcggaaaattcgcttggttggaaaacaaaatagttagaattgcgtatgaatatacaatctagagttgtagaagagagaataggctatattacggaattgccaaacaaagtatataggcattagggaggggcggagtcaggctagatctatatcctttatgtctataagttcagtcatcttttgtatgggtttccactttaaggaattttttttgaatccgattcaatagaaaatgagaaaatacacaaacaaaatagaagaaacaaattgatatgggatattatatattcccaagttagattcattatctaatccgatatatggaatcggattccatatccaattcgatgcagcatattgttatcaattggatatcttgatttaattcctattggatctggattaggtcgatttccataggggttcttcctctatttcaccttttattatgaattagatgataggggaaaaaatagaaactcaaggatatcgaagaggaaagaaagaaggatggaatgaaagatcagttggttggaaagaaagagaaatagaataatgagtacacaaacctctaatgattagaaactaaaaaggagatctcgaagcagttcggagaattcagattatcgtttcaatttgtactttttagttacttctgtccaatagagcttagaaatatgaatttcttggttgattgtatccttaaccatttcttttttttgacacgaggaactcatcatgaatccactaattgctgctgcttccgttattgctgctggattggccgtaggtcttgcttctattgggcctggagttggtcaaggtactgctgcaggacaagctgtagaaggtattgcgagacagccagaagcagaaggtaaaatacgcggtactttattgcttagtctagcttttatggaagctttaacaatttatggactagttgtggcactggcgcttttatttgcgaacccttttgtttaatcctaaaaaagaaaacgagtcctttagattagatactttcttctttttttagtaaattggtatttgcttctgcaattccaattatatcaatactttactcctaatttattactcctagagttttctatttatggggacagacaataccccaccccaggaatagctgatttgaggatgatcaatttagaggatatgttcgccgtcttgcttcccgccctttgtttagggcagtggaaagtatttttccttttattttaggaattttgggaacatttcaacaaaggaggtctttcacaggtcaaacgagatctaagacttaatctaaaagaaattactaaattgaatctatttctattaaaaaaaattgcattaaaaaaaccgatcaaaaagggcgagcgaagtaagtgatcgaaaaactttgttctttgttcgtcctatctataagaggagagcatatgaaaaatgtaacccattctttcgtttttttagctcactggccatccgctgggagtttcgggcttaataccgatattttagcaacaaatctaataaatctaactgtagtggttggtgtattgatttattttggaaagggagtgtgtgcgagttgtctatttcaagaatagattggatctatccggctgcactttagaatattttttagtatttttcgaataaataagaaaagggtgcacgatctcgacgaattacttctgaataaatgcagaaatcatatgaaagaaccatagcatttcgcgacctattggtaaatcaaatcaactttgattctctatagaccaataatatgagaccattaacacggttaaagctaaactgcttgaagtctaggcaaaagggggtactctttctacaactatattagtattagtaccaaatgctttaaacaggaaatagctaatgtagaatttatctgatatagaacactcatatcgataaaatggtttgaactatttactagaaggggcaccctgcccttttttatccaatgccgaatcgacgacctatgtataaaaaaggagaaagtttttggatttgaagaaaaaagtaggaattctatccattttcattttccatttttctatttagtttttcttaatgaaattgaaaattttaactaaagggcaaatacaaataaaaaaacaactttgctgcccacgatagatttttatctaggcggaagagtcctcttaatatttatctagtcttatatgggtttcggtatattgaaatataaacagaaaagagagggtagaggataggctcattacattaaaaaaaatatggaagtagccatagcaaaaaaagaaaaaagggagcgtgagagccaaatgaatcgaaagattcatgtttggttcgggaagagatcataaaagttgtaaacttaatagcaaggtaatctactttcattaaaagatttattagataatcgaaaacagaggatcttgagtactattcgaaattcggaagaattgcgtagaggaaccattgagcagctcgaaaaagctcgaattcgattacagaaagtcgaactagaagcggatgagtatcgaatgaatggatactctgagatagaacgagaaaaagcaaatttgattaatgccacttctattagtttggaacaattagaaaagtctaaaaacgaaaccctttattttgaaaaacaaagggcgatgaatcaggtccgacaacgggttttccaacaagccgtacaaggagctctaggaactctgaatagttgtttgaataccgagttacatttccgtacgattcgtgctaatattagcattctcggggccatggaatggaagagttaaattaattaggccttgaacttctactttcctttagaatttaggcattatttttccccttgcttccgaaaaaaaaatagtaaagaaacactaatggcaacccttcgagtcgacgaaattcataaaattctccgcgaacgtattgaacaatataatagaaaagtagggattgagaatatcggtcgcgtagttcaagtgggggatgggattgctcgtattataggtcttggtgaaataatgtcaggcgaattagtcgaatttgcagaagggactaggggtattgctctgaatttggaatccaaaaatgttgggattgtattaatgggcgatgggttgatgatacaagagggcagttttgtaaaagcaacaggaagaattgctcagatacccgtgagcgaggcttacttgggtcgtgttataaatgctctggctaaacctattgatgggagaggcgaaattgtagcttcggaatctcgcttaattgaatctcctgctccgggtataatttccaggcgttctgtatatgaaccccttcaaacggggcttattgctatcgattcgatgattcctattgggcgcggtcagcgagagttaattattggggacagacaaaccggcaaaacagcagtagctacagatacaattctcaatcaaaaagggcaagatgtaatatgtgtttatgtagctatcggtcaaagagcatcctccgtagctcaagtagtaactactttccatgaagagggggccatggaatacactattgtagtagctgaaatggcggattcccctgctacattacaatacctcgctccttatacgggagcagccctggctgagtattttatgtaccgcgaacggcatactttaataatttatgatgatctctccaaacaggcacaagcttatcgccaaatgtcccttctattaagaagaccccccggccgcgaagcttacccaggggatgttttttatttgcattcacgccttttagaaagagccgctaaattaaattctcttttaggggaaggaagtatgactgctttaccaatagttgagactcaatctggagacgtttccgcctatattcctactaatgtaatctccattacagaatggacaaatattcttatccgcagatctattcaatgccggaattcggcctgctattaatgtgggtatttccgtttccagagtaggatccgcggctcaaattaaagccatgaaacaagtagctggcaaatcaaaattggaattagctcgattcggggagttacaagcctttgcacaattcgcctctgctctcgataaaacaagtcagaatcaattggcaaggggccgacgattacgagaattgcttaaacaatcccaagcaaatcctcttccagtggaagagcagatagctactatttatatcggaacaagaggatatcttgattccttagaaattggacaggtaaagaaatttctggatgagttacgtaaacacctaaaagatactaaacctcaattccaagaaattatatcttctagcaagacattcaccgaggaagcggaaatccttttgaaggaagctattcaggaacaactcgaacggttttcccttcaggaacaaacataaattttgcacgtctactcttgttagtagaagtagtagaggagaaatcgttgagaaagatttttcatttgaatcatgcaaaaaagttttcttagtttttagtatagttatttaaagaatagatagaaataagattgcgtccaataggatttgaacctataccaaaggtttagaagacctctgtcctatccattagacaatggacgcttttttcatattttcttctttcttttcattttttatcggaccaagagaaaaaactgttagaccaaaactcttttaggaaagaaaaacaaatgcatatacaaatgtatgatgcatatatcataaagaaggaatannnnnnnnnnnnnnnnnnnnnnnnnnnnnaccccacggttatgagccttgtcagctaccaaactgttctatcctgttaaactaaagagaggggaactagtggataaaaggggggttgaatacgcccctctaccatatctatacaaatagaatagtccatttatacagaatggtaaagagggctcttctacgatcatcaattccagaaatccatacaaatacgaaagggtattttatccttaccaatggatcttgttgcaccggtaacaaacatgcataaaccatttctcgaagtatgtgtccggatagcccaaagtctcgatagttagctctaggtcttccggtcaaaaaacaacgtcgatgaaggcgtgtcggtgcactattacgtggcagggattgcaatttttctcgcattttcgttttttcactcaaactcaaagggtaaactttgcttcttatctttttttttgaagatcgacgaatcaaatgatatttctgttctaatttctgccgcttcctctctctctgaatcaaacttttttttgccataatgtgccgttcctactatctaccaagtatacggttctaatcctagatggaaaataaatagaaaaagaaatctaagaaggcggatcctccccctccatcaagagtaatgaactaggtgctgatacagtacaacaaaattaactaaattaaccaaacttgcctgatgttgaggcaatcaagaaagcggcataagtgaatatataacccacggaaaagtgagctaatcccaccaatcttgcttgcacaatggaaagagccacgggcttatctctccagcgaattaaattagccaaaggtgtccgttcatgagcccatgctaaagtctcaattaattcctgccaatatccacgccaggaaattaagaacataaatccagtcgcccaaacaagatgtccaaataagaacatccacgcccataccgataaactattcatcccaaaaggattatatccattgataagttgtgaagagtttaaccataggtaatctcttaaccatcccatcaaataagtggaggattcattaaattgtgaaacgttgccctgccataatgtgatgtgtttccaatgccaataaaaagtaacccatccaatggtatttaacatccagaaaactgccaaataaaacgcgtcccaagcagaaatatcacaagtaccgccgcgaccagggccgtcgcaaggaaaactatatccaaaatcttttttatccggcattaatttggaaccgcgtgcatctaaagcaccctttactaaaatcaatgtagttgtatgcaaacctaaagcaatagcatgatgaaccaagaaatctccaggtcctattgttaagaaaagcgaattactattctcgttaacagcattcaaccatccgggtaaccatagggttcgacccgcattgaaagcgggaccgctcgttgaagataagagtatatcgaacccatatgtcgtcttaccatgagccgattgtatccattgagcaaatataggttcgatcaagatttgcttttctggagtaccaaaagcaagcatgacgtcattatgaacataaaggcccaaggtatggaatcctaggaagagactagcccaacttaaatgagatatgatagcttctttatggtctaacattcttgccaatacattatcctcattctgttccggattgtaatctctaatgaaaaaaatagctccatgagcaaaagcccctgtcatgatgaaccctgcaatgtattggtgatgagtatataaagctgcttgagtagtaaagtcttgtgctatgaatgcataagaaggtaaagagtacatatgttgagctactaaggaagtaataacccctaaagaagctagagcaagacctaattgaaaatgaatcgaattattgattgtgtcgtaaaggcccttatgcccacgccctaatcgaccccccggaggagtatgtgcttctaaaagatctttgatactgtgcccaattccgaagttagttcgatacatatgaccggcaatgagaaaaataaatgcaatagctaaatgatgatgagcaatatcggtcagccacaaactttgtgtttgtggatggaatcccccaagaagagttagaatagcagttcccgctccttgagtggtaccaaataaatgattactcgaatcggggttttgggcataaagattccactgacccgtcatctatctctgaggtgtttgggttttgcaaaactccatagatatgcagaagagaaatgctatccccactccgaccaagacagaacttttaccaaaagtttattgtgatctttttgttcaaataacaattaaggtgaagcagggtcaggaacaacgaatctctttatgataaacagatccattttgcaagctcgttattacgggtagttcctacaaagaatcggactaatgacgtatacaatgcttgaattatcgacgtagatgctacatagtgggttctcatccttcagagactacgagtgtaataggagcatccgttgacaaaaggatcaccctaagatgatcatctcatggctattgggaac

SEQ ID NO: 13584 - DNA, 1071 bp, Oryza sativa
ttccacagcgggttgagcaaaatgaggatcccaaatcgcatgagcaataggtcttacgtgtaaaggatcctgtatccatgattcaaaatttccttgccaagggacatgaaacagatttccggacgtccatagaaagattattgctaattgcccaaagtgagaagcaaaaatgttctgataaagacgttcctcagtaatatcatcatgactttggaaatcatgtgcggtagcaataccaaaccaaatacgacgagtagtggggtcctgagctaagccttggctaaacctgggaaatcttaattccataatgcctttcaaatcctcctagccactatcatctgcaataattctcgctaagaagaatgcccatgttgtggcaattccacccagaaggtaatgggttactcctacagcacgtccatgtataatgctcaaggctctaggctgagtagcaggagcaacttttaatttgttatgagcccaacgatagattcaatcagttcttgccaataaccacggccgctgaataaaaacattaaactgaaggcccagacaaaatgagcacctaagaaaaaaagaccatatgcggataatgaagaaccataagactgaattacttgggatgcctgtgcccacaagaaatctcggagccacccattaatcgtaatggaactctgtgcaaagtttccccctgtgatatgagttaccaccccttgatcacttatagtaccccaaacatccgactgcattttccaactgaaatggaaaatgactaccgaaatggaattgtacatccagaatagacctaagaaaacatgatcccaggcggatacttgacatgttccccctcgcccaggcccatcgcaagggaagcgaaaaccaagatttgctttatcgggtatcaaacgggaactgcgagcaataaaacacctttcaaaagtattaatacagtcacatggattgtaaatgcgtgaatgtgatggactaaaaaatctgcggttcctaatggaataggtaacaaagcaactttgccgcctactgctactaactcgccacctccccacgttaagc

SEQ ID NO: 13585 - DNA, 1475 bp, Oryza sativa
ctcacattgggtttagggataatcaggctcgaactgatgacttccaccacgtcaaggtgacactctaccgctgagttatatcccttccccgtcccctcgagaaagagaattaacgaatcgtaaggcaaaggggcgagaaactcaaggccacccttcctccgggctttctttccacactattatggatagtcaaataatgggaaaaattggattcaattgtcaaccggtcctatcgaaaataggattgactatggattcgagccatagcacatggtttcataaaatctgtacgattttcccgatctaaatcgagcaggtttccatgaagaagatcttgttcagcatgttctattcgatactggtaggagaagaacccgactcggtattcttaaaaaaagaggggaagcagaaccaagtcaagatgatatgggtcgccccttcttcttgcgccaaagatcttaccatttccgaaggaactggggctacatttcttttcaatttccattcaagagtttctatctgtttccacgcccttttttgagacctcgaaacatgaaatggacaaattccttctcttaggaacacatacaagaaaaaggataatggtagccctcccattaactacttcattttcatttatgaatttcatagtaatagaaatccatgtcctaccgagacagaatttcgaacttgctatcctcttgcctaataggcaaagattgacctctgtagaaagactgattcattcggatcgatatgaggacccaactacgttgcattgccagaatccatgttccatatttgaagagggttgacctctgtgcttctctcatggtacaatcctcttcctgctgagccccctttctcctcggtccacagagaaaaaatggaggactggtgccgacagttcatcacgaagaaagaactcacagagccgggatcgctaactaatagaatagtactactaactaatactaatatatagaaatagatatctagaaatagaaacgaactaatatatagataatcgaaattgaaaagaactgtcttttctgtatactttccccgttctattgctaccgcgggtcttatgcaatcgatcggatcatatagatatcccttcaacacaacataggtcatcgaaaggatctcggacgactcaccaaagcacgaaagccagttagaaaatggattcctatttgaagagtgcctaaccgcatggataagctcacattaacccgtcaattttggatccaattcgggatttttcttgggaagtttcgggaagaaattggaatggaataatatagattcatacagaggaaaaggttctctattgatgcaaacgctgtacctagaggatagggatagaggaagagggaaaaatcgaaatgaaataaataaagaataaagcaaaaaaaaaataagtcgaagatagaagagcccagattccaaatgaagaaatggaaactcga

SEQ ID NO: 13586 - DNA, 734 bp, Oryza sativa
tagaatggcagaggcaaatagagctcttgcacattttcgttaatccatgaacagaatctaggtatgtagacacatggatccatacatctcgatcggaaaagaatcaatagaaggagaatcggacgatatctttctcgaaacaaacaaaaaggaaaagaaagagaaaacagaaatcatgatcaactaagccctctcgggggcttgcttaagaataagaaagaggaatcttatggaaatagcatggaataaggtttgatcctattcatggggattccgtaaatatcccattccaaaaatcgaaacaatcgggacttttcggagattggatgcagttactaattcatgatctggcatgtacagaatgaaaacttcattctcgattctacgagaatttttatgaaagcgtttcatttgcttctcttccagggaagtttcattttcccagaatgtatcctaatttttggcctaattcttcttctgatgatcgatttaacctctgatcaaaaagatagaccttggttctatttcatctcttcaacaagtttagtaataagcataacggccctattgttccgatggagagaagaacctataattagcttttcgggaaatttccaaacgaacaatttcaacgaaatctttcaatttcttattttattatgttcaactttatgtattcctctatccgtagagtacattgaatgtacagaaatggctataacagagtttctgtt

SEQ ID NO: 13587 - DNA, 968 bp, Oryza sativa
atgaatataccataccacttcgttatgtatggatgatggatgagattccatggatagagagccagttccaatagacttatggaacgttccggttcgcgtgcatccagcaggaattgaacccgcaaatttaccaattatgagttgggcgctttaaccattcagccatggatgcttaacagggatcatcgtacatcgtaaataaccaattttcatatagaaagacatatcatagaaaaatgaaatcgaaaatattcggagatggcaaatattcggagatgactatgaaaacacctctctggatcctcgaattgaaagagagattgagagggatccagaatcctaattctcgctatttggaatggatccaattctattgagtctgactcatagtgatcatttctctttagcaaagaatgaccttggttatcaaaggattgaacaaccgggatccgtttacttatgatacctagttgacattgataacaaggatctaatgaattatgagtttaatagatcctctttagcagaaagacgtatattccttgctcatcacttattcccaaacctcgtatggggctaatcgttttcatttaccatctcagggaaaatccttttcgttccgcttagccctatcgggtattttagtgataggttctataggaactggacgatcctatttggtcaaatacctaatgaaaaattcctattttcctttcattaaggtacgagggcttcttattccacaagaaaagaacgaaagcaccttttcattctttcatatactgggggtttttacttggaaaagacaatgttccatactaaaggattcgggtccataaccacgagttccagtgcactagatcttgtagcacttagcaacgaggccctatgaatagacatatagaatttttggtcgggaaattcgaatgaatcattgagtgaaaaaggagcaaagaatgacaaaagac

SEQ ID NO: 13588 - DNA, 8037 bp, Oryza sativa
  unsure (1)..(8037): unsure at all n locations
tatatgagcaaatgcctgaaccaaaatacgtcattgctatgggagcttgtactattactggtggaatgttcagtacggattcctatagtactgttcggggagttgataagttaattcctgtggacgtctacttgccgggttgcccacctaaaccagaggctgttatagatgccctaacaaaacttcgtaagaagatatcgcgagaaatagttgaggatcgaactctatctcaaaagaaaaatcgatgttttactaccagccacaagctttatgttcggcgcagtactaatactggaacttatgagcaagaattgctctatcaatcaccatctactttagacatatcttctgaaacttttttcaaatccaaaagtccagtatcttcctacaaattagtgaattaggaggagctctttgtgccgaaaaagaaagagcagggcaatatttcaaacttgcattcgaactgcgaaatatttatacaaaggaggagagatcaagataatgcagcagggttggttatctaattggctagtcaaacatgaggtggttcatagatctttgggcttcgatcatcgaggaatagagactttgcaaataaaagcagaggattgggattccattgctgtcattttatatgtatatggttacaattatttacgttcccaatgtgcttatgacgttgcacccggtggatctttagctagcgtgtatcatcttacgagaatacagtatggtatagataacccagaagaagtatgcataaaagtctttgcccaaaaggataatcctagaatcccatctgtcttctggatttggagaagttccgattttcaagaacgcgaatcttttgatatggtgggaatctcttatgataatcatccacgccttaaacgtatcctaatgcctgaaagttggataggctggcccttacgtaaggactatataacccccaatttctatgaaatacaagatgctcattgaatgataagaaattcatgctcacttatacaacacaactccagattttatgcaagtcaaggaatatttttacgctctgttcctagatgaaacagaatacctattacattctaattaattccaattatacaaaaggttcagatagactaagcaaaaaagggcttcatttcgttggaaaatcacatattcatttccttcgtatgaacagaaaaatatgatgactcaaagaagttccctaccacgaactttgtaccgcgtgcattacttagaacaactagtaaagtaagataagataagcaagaataaaaaaatatttgtcggaatagcggaatagaaaattaagaaatgcaaaaatgcagaaaaagaagtgcctctatttagagatttatctacttagatgaaaaaatcatactctatctatattattaacgaatatgtatcccaacccatctcgaggtatttgtatcaatacctattcggaagatccctttttctgtgccaggaaccagatttgaactggtnnnnnnnnnnnnnnnnnnnnnnnnnnnnnnnnnnnnnnnnnnnntgaccttttcttgtgcatcatcctagtagagtatttgtatctatgtcaatatccaaaatttggaaatggggagggggcagtcctatgcattgtacaaagaaagcctatttaataatatttaaatatcgagttaataatcgacattccttgccgatactataataaaaaagaaatgtattccattgaatcttaaacctattaataaaaaaacaggataaatactagagttagggaataaaagagggtttggggatagagggacttgaaccctcacgacttagaaagtcgacggattttccttttactagaaatttcattgttgtcagtattgacatgtagaatgggactctctctttatcctcgtccgattaatccgcttttaaaaagatttcgaaaactatgaattgaaggatttgattactcaatattcgattggaatggattcacaacaattctaaaaaaattatgaattttctatttcataatcattcctattttcattttaaaaaagaattaaagaacctatattatgatatgagttctgtgattaatcgtttgctatgccagtatctatacgtgtgtattagatttcgaaagcccttctttccctaatttagaagggagttccgctagcaacacaacgtaattaactcgattcgttagaacagcttccattgagtctctgcacctatccttttcctttgggttctagttcgagaaccgcttgttttctcaaaacatggatttggctcaggattgccccttttttaattccagggtttctctgaatttggaagttgccacttagcaggtttccataccaaggctcaatacaatcaagtccgtagcgtctaccgatttcgccatatccccattttctttttctttgagaccaggattccttgtgcaatttcctccatctgttagttttttttgaatcgttgaattcattactctatgtagtctagcggttcgtctctagttgagagactccgcttattgcaattcagcattgaattgattctatcgttgatgtatttgcaattcaatgcgaatcaatatatcccaaggtttttctctcccccacctaccgcgttccttttttagagtattcaaaatcatactataacgcttgatattcattctttttttttgctaatcagaattagcaatttcatttgctatgattctatgttctccttagtgaaatattaatcattaaattattagcaaataacaaaaaaaaacaaaatatctcaaaaaatgtctataatgatggactgaaaatacaagaaattcgcatgttctctttattatgttttcgtatataatatatattatttattcttttccatgtattagattattcgtccgagccatatcaaattaaaaatatctaaaatcaaattcaatatagaaattggaatagattctattagaaaaatagatttgcgaattagagaaaaaagaaagttcaaaaaaatctatctaactttattttatgaagttctagtatttttttctaagtagaacttccaatttcgaactagttaatagctaagattaataattaagatctgacattttacggatttcctatactatacatatttctatttgttacactatttctgttatgtaagcccacttagctcagaggttagagcatcgcatttgtaatgcgagggtcatcggttcaaatccgatagtcggcttttttctctatcaatgttccatgaacaaaaatacctctttttctccgaattaaatggagaagccaggatctattatgtcgttctaccctacaattttgctagatacaaaacaataaaataaataatatatatacaaaaattcagatgttgatgaaattccatttttttgtggtacttttagtagattttactctgtttatcctttactttaattcagttttaatttcgatgtattctgtaatgtaaatacaatgaaattaattgtgtaaaatgaaatttcaataaaaaaaggagtcttcatgtcccgttatcgaggacctcgttttaaaaaaatacgccgtctgggagctttaccaggactcactagaaaaacacctaaatccggaagtaatctgaaaaagaaattccattctgggaaaaaagaacaatatcgtattcgtcttcaagaaaaacagaaattgcgttttcattatggtctgacagaacgacaattacttagatatgtacatatcgctggaaaagcaaaaagttcaacaggtcaggttttactacaattacttgaaatgcgtttggataatatcctttttcgattaggtatggcttcaaccattcccgaggcccggcaattagttaaccatagacatattttagttaatggtcgtatagtcgatataccaagttttcgttgcaaaccccgagatattattactacgaaggataaccaaagatcaaaacgtctggttcaaaattctattgcttcatccgacccggggaaattgccaaagcatttgacgattgacacattgcaatataaaggactagtaaaaaaaatcctggataggaagtgggtcggtctcaaaataaatgagttgttagttgtagaatattactctcgtcaaacttgaacttaaggaaaaacggaaaggttcatagaattttcttccccttcccctttccccgaactaaatcgacctaaggctcttaattcgtattttcccattcacctaacagaaatggattaaccctaggattcctttttgttttttgttctttcctctatgtgtattttacataccatagtaatttggtatagagaatttctattaaataaaggtattgtattattgctggaataaattgtcatttgatttgatacattgtaatcattaacgttgctgaattaagaaaaacggaaagagagggattcgaaccctcggtaaacaaaagtctacatagcagttccaatgctacgccttgaaccgctcggccatctctcctccataatcttattatggaaaaaaaactgagtgaatagcgagttttcctattcctgcagtacaggtacaaccacaaccgcgcgagagttccattgttctattagatagaaaaattccttttcatctaagtggacgggtccaggatttttttactaggaattccgctccctcgaaaagttttagtttgggttttccccaaaccaaagaaaaagagaatggaagaattcttcttattcgataaaaaaggaaccctagaattctgtttgcataaggtatcctaccccatacaatcaaatagaaaatagggtatgggacgattaatgactttgaaaatgcgaaatagttgatgagagaagttgttgttgagaaaagaaataggaaagtggaatgaaatccaatcttagtcaaatattttctatctcttcttgttcaaacagaaggaaaaagagagaatttgggctgagcagaaatacctctcttatccatttggagcatagggatcgatttataagaattgaatggatttgttttttttttatgttattttgtgaaggaatgaaaagaattctatatagaatgatagaatgggttgggaattatgcctagatcccgtataaatggaaatttcattgataagaccttctcaattgtagccaatattttattgcgaataattccgacaacctccggggaaaaaagggcatttacttattatagagatggtgcgatttgactcttttttttgtttttttagccctacctacaccccggttttacgagaaagagtgggggttcgcggagagaaaaccaaattagtaagggaaacccacgcttagggaaggtgaggtgaactaacaactccttctgtcgtgtatcctcgactgacgcggcctcggatgcttcaattgtagattttagtattgagcgaaaggttacacctacaggataggttctgtattacaggctaatcctactctactagtactaataggtagcataggggataaaagcactacacctagaaataggaatcaacaagagaaaaactttgttagaaattaaccctttcctgattggtatcagggctgggaagaatggttgggataacaaacaaccatcaagtttgtactttggatacccctataaccatcaaagatcgttgaagtggctaattcctctaaataggaggcgttgagaacaaagaaattcttggagctatcgttttcctctagcattaatagaattcattggtgttaagaaaaacctcttgtgggaaggttggctagagatttcttggaaaaataccagcccctttcggtccataatgagatggaactaattctatttttattctctagattttttcgcttagtactatgtacagaagggaggagccgtatgaggtgaaaacctcatgtacggttttggaacggagattttttgaatagaacgaacgaccgtaacggatgttggctcaatccgaaggaaattatgcggaagctttgcaaaattattatgaagctacgcgactagaaattgatccctatgatcgaagttatatactctataacataggccttatacacacaagcaatggagagcatacaaaggctttggaatattatttccgggcactagaacgaaaccccttcttaccacaagcttttaataatatggccgtgatctgtcattacgtgcgactatctccactatagaaagaaaaataagaaaggatcaaattttctagtatttactagaaaagggggctttctacatagggatcgtcaaaacaacgattttgccctatcagctgtaggaagaaaggacacttcacgagaatcaaaataggaagaaagaaagtatggcctatactactctatggatagagttctcaaattgatagagaaagcaccgtaaagatcaattagtgaccgactgggtcgatacaactaaaaaaaactgcttacttatcccatgatatggggcaaaatttaggaatccgcttatgtaatagagccgatccactaagggattaagcagcggtgtagtatcagatcccaaagatagtaagttcttttttcttgcttatggggaaaaagtctttttcaaggattctatagaaatttcatatatgaaaccgagatagttacctttcagaaaattcggacgaaggatataggtctatctatgcttcatttttctgcaggtgggagaaaagatcaaactgattattgatcaaaatttagggtttgaaacttaggtaattaacttcttctgcgtaacccaagaagaaattggatcgatttttgagaaatcgaattcagttaagacaagggaaattaagatagcaatttctgagccgtatgaggtaggaaactctcaagtacggttctaggggaaggaactacctattccgaccggggagaacaggccattctacagggtgattcagaaattgcagaagcttggtttgatcaagctgctgagtattggaaacaagctatagcgcttactccgggaaattatattgaagcacagaactggttgaagattacgaagcgctttgaatttgaataagaccactctcctttttcagaaaatgggggtttggttgttgatccattaatcaaataaattaggtcggaagatcgaatcaagaatttcattatatctctttcctctgccttctattttatattatatttcataaggataaacgatagggtctagaatagaagtaataaagcgaataaaaaggggcaatataaatattgctaatatatcaggaccatcttattaataattctaatgagttatcttggaatttggaatcgaataaaaaaatctatattatgctcaaggaaagtagatatagatagggacttatactcttaaaaaaaatagactagctttttaaattaaaaaaaggtttttttgttacgtggagaaatccaagataaaaaaagtccgttaggcacccaatccttatgtcataatagatccgaacacttgcctcagattgacttcaatatataattgctccagtgaataactaaaaaaaaatagaaggacggtagatagtaaagaaaaggactaatcataatatctatctttcaaaggttcactaaaaagttggcgggtctctttgtatgtcttgtccggaaagaggaggacttaatgatgattcgttcgccggaaccagaagtaaaaattgttgtggatagggatcctgtaaaaacatcttttgaggaatgggccagacccggccatttctcaagaacaatagctaagggccctgatactaccacttggatctggaacctacatgctgatgctcacgatttcgatagtcatacaggtgatttggaggagatctctcgaaaagtctttagtgctcatttcggtcaactctccattatctttctttggttgagtggcatgtacttccatggtgcccgtttttccaattatgaagcatggctaagtgatcctactcacattg

SEQ ID NO: 13589 - DNA, 450 bp, Oryza sativa
gcacacgcaagggaaccatagataggcaagtgaaatccaatccacgaaataatttgatccatggacggcaccgttgtggtaaaggtcgtaattccagaggaatcattaccgcaaggcatagagggggaggtcataagcgcctataccgtaaaatcgattttcgacggaatcaaaaagacatatctggtagaatcgtaaccatagaatacgaccctaatcgaaatgcgtacatttgtctcatacactatggggatggtgagaagggatatattttacatcccagaggggctataattggagatactattgtttctggtacaaaagttcctatatcaatgggaaatgccctacctttgagtgcggttggaactattgatttacgtaattggaagtaaccaattatgtttactacgaaacctagaaatcgatcactgatccaatttgactacc

SEQ ID NO: 13590 - DNA, 1766 bp, Oryza sativa
tttttccattcatcattattctatttattctgacctccatacttcgatcgagatattggacatcgaatgccactctttaaaatggaaaaaaaggagtaatcagctgtgacacgaaaaaaaacgaatccttttgtagctcatcatttattggcaaaaatagaaaaggtcaatatgaaggaggagaaagaaacaatagtaacgtggtcccgggcatctagcattctacccgcaatggttggccatacaatcgcgattcataatggaaaggaacatatacctatttacataacaaatcctatggtaggtcgcaaattgggggaattcgtaccaactcggcatttcacgagttatgaaagtgcaagaaaggatactaaatctcgtcgttaactgaattcagaatagaaagattcaaaataaaaaaaaaagaaataggtaagcggggaataaccttatttatgacaagtttcaaactggtaaagtatacccctaggataaagaagaagaagagtgggctaaggaaactcgcaagaaaagtaccaaccgatcgtctacttaagttcgaacgggttttcaaagcacaaaaacgcatccacatgtccgttttcaaagtacaaagagttctggatgagattcgttggcgttactacgaagaaactgttatgataatcactgtcatgctatatcgagcatcttataccatcttaatagctggtttattcggcaacagcgtaatagtactcattatagggatttgactaaagcaaatttattcatccataaagcccaagtcagtaggagtactattatgaatcaattcagacctagggttatagcatgtagttctcccataaaaaaaccatgtgtctataacaattgtactaaatatagtaaagaaatcgaaataatctttagatccatctaagatttgattcccggtaaaaaaaatagaatagaaaaatatgggacaaaaaataaatccacttggtttcagacttggtacaacccaaaatcaccattccttttggttcgcacaaccaaaaaattattctgaaggtctacaggaagataaaaaaatacggaattgtatcaagaactatatacaaaagaataggaaaaagggctcgaatagaaaaatagaagcagactcaagtttcgaagtaattacacataataaaaaaatggactcaggctcaagttccgaagtaattacacatatagaaattcaaaaagaaatcgatacaatccacgtcataatccatattggattccccaatttattaaagaaaaaaggagcaatcgaagaattagagaaagatctacaaaaagaagttaattctgtaaaccagagacttaatattgggatcgaaaaagtgaaagaaccttatagacaacctaacattcttgcagaatatatagctttccaattaaaaaatagagtttcattccgaaaggcaatgaaaaaagccattgaattaactaaaaaaacagatataaagggagtaaaagtaaaaattgcaggccgtctcgcgggaaaagaaattgcgcgtgccgagtgcatcaaaaaaggtagacttcccctccaaacaattcgcgctaaaattgattattgctgctatccaattcgaactatctatggagtattaggagttaaaatttggatattcgtagacgaagaataaccaaccctgtcttcccattctgttcagtaatagaataaaaaatgacaagagccttattttccctaaaatccctgaaaaaaagaagaa

SEQ ID NO: 13591 - DNA, 2284 bp, Oryza sativa
ccaacctattgcttcgtatgtcgagatcctaactaagaaacagtcactatatgaataaatacatctatcataaatgagtaaatctatcatatacgtgtagcaactgcaattttttctttaaaaaaaaataggattctaagttgtgaagcaaaactaaaggggatgtagataaaaggaaggatgatagaaagaaggaagagaaataagaaagatataggattccaatatgtatggtctatgaattacatcataaaaagcaatgtgataaagcatcaatataataaaaataacagagaattcgaaatcgtaatttgattgaaacaagaaatacaaatttcaaggaataacaaagagcgtcccgagttaataaaactgagaaattgactcggaaagaaattttttggaagctccattgcgagattcaaacctaaccattaaaggagaagcagtgggaacgacagaacctatgactggataggattttcttgaaaagaatcccaatacttcattgggtgggatggcggaacaaaccaaaaaaattgtcttatttgataaggttatgaattaacaaataagacaggaaagagtaaatattcgcccgcgaaatttttattgaattagaatactttaccgcgattcaataagagtaaaataaaaaaaggagattaaaaaaaaaaaaaaagaattacattaaatatagaatatagataaataaacaacacatctagatatattctagatcctctttcttgactatatattttagtattttaataaattcaatattaaaaaccctaacctttcctattaatgtgtatctatccgtaatattttagaatattgtggaattagagaaatttgcacactttctcatttgattcgcgaggagctggatgagaagaaactctcatgtccagttttgcagtagagatggaactaagagagaaccatcgactataaccccaaaagaaccagatttcgtaaacaacatagaggaagaatgaagggaaaatcctaccgaggcaattgtatttgttttggtagatatgctcttcaagcacttgaacccacttggattacggcgaggcagatagaagcaggacgaagagcaatgacacgatatgcacgtcgtggtggaaaaatctgggtacgtatatttcccgacaaaccggttacaataagaccgaccgaaacacgtatgggttcgggaaagggatcccccgaatattgggtagccgttgttaaaccaggtcgaatactttatgaaatgggcggagtatccgaaacggtagctagagcagctatttccatagctgccagcaaaatgcccatacgaagtcaatttcttcggttagaaatataaccccccaaaaaaagtagtattgaaaataaaaaaccaggttcttctttctggaaagacaatatttctttcatccttttgcattgaaataacaaattgaaatcaaaataatatgattcaacctcagacccttttaaatgtagcagataacagtggagctcgaaaattgatgtgtattcgagtcataggagctgctagtaatcagcgatatgctcgtattggtgatgttattgttgctgtaatcaaagacgcagtgccccaaatgcctctagaaagatccgaagtaattcgagctgtaattgtacgtacatgtaaagagttcaaatgcgaagacggtataataatacgctatgacgacaatgcagcggttatcattgatcaaaaaggaaatccaaaaggaactcgcgtttttggcgcgatcgccgaggaattgagagaattgaattttactaaaatagtttcattagctcctgaagtattataaatactagtagacaagatatagatcaaataaaaaattagtagattgtgtttcacgtatatgctttagaatccaaaacgaaaagaaaaaagagaacatgttgattatagaaaaattaggaggaacctagaattagagtcttatgggcaaggacactattgctgatttactaacctctataagaaacgcggacatgaataaaaaaggaactgttcgggtagtatctacaaatattaccgaaaacattgttaaaatacttctacgagagggttttattgaaagtgttcggaaacatcaggaaagtaacagatatttcttggtttcaactttgcgacatcaaaagagaaagactagaaagggaatatatagaactagaacctttttaaagcgtatcagccgacctggcttacgaatttatgccaactatcaaggaattcctaaag

SEQ ID NO: 13592 - DNA, 3357 bp, Oryza sativa
cctgggctatatttcaggaaagatccggctagttgttacgaatactgatgggggatagggtcaaaattgaagtaagtcgttatgattcaagcaaggggcgtataatttatagacttccccataaggattcgaagcgtaccgaagactcgaaggataccgaagatttgaaggataccaaagattcaaagggttaggtttttcttttttttttctagggtaaaaaattcaaagttctaaaattcaaacaaagagacttattttttccaaaagagtaaattcatagtttaagaaaggaatacggaaatatgaaaataagagcttctgttcgtaaaatttgtacaaaatgtcgactgattcgtaggcgtggacgaattagagtcatttgttccaatccgaagcataaacaaagacaggggtaatctttcgaaaaaagaacttgactttctaaaaagtaaaaaaaaaagtacccgcgaaaatgtccaaattccaaataaaaaaattcaagtaaaggatatattttaccctgaaacggatatctttgtatctttttttctttttgttatttctaactcatatttatgagataataaaatatgacaaaagctataccaaaaattggttcacgtaggaaagtacgtattggtttgcgtaggaatgcgcgttttagtttacggaagagtgcacgtagaataacaaaaggagttattcatgttcaagctagtttcaacaatactattataactgttacagatccgcaaggtcgggtggttttctggtcctccgcgggtacttgtggattcaaaagctcaagaaaagcatcaccctatgctggtcaaagaacagctgtagatgctattcgtacagtgggtttgcaacgagcagaagttatggtaaagggtgctggtagtggaagagatgccgcattacgagccattgctaaaagtggtgtacgattaagttgtatacgcgatgtaacacctatgccgcataatgggtgtcgacctcctaaaaaaagacgtctgtaaaagaattaaacccctttcaagagaaataaacgattcaatgatcaaataataatactagtctatatggttcgagaggaggtagcaggatccactcaaacactacagtggaagtgtgttgaatcaagagtagatagtaagcgtctttattatggtcgtttcattctgtcccgcttagaaaaggtcaagcggataccgttggtattgccttgcgaagagctttacttggagaaacagaaggaacatgtatcacacatgcaaaatttgggagcgtgccgcacgaatattctacaatagcaggtattgaagaatcggtacaagaaattttactaaatttgaaagaaattgtattgagaagtaatctctatggagttagaaccgcatcaatttgcgtcaaaggtcctagatacataactgcccaagatattatcttaccgccttccgtagaaatcgttgatacggcacaacctatagctaacttgacagaacccacggatttccgtattgagttacggatcaagagagatcgcggatatcacacggaagtcagaaagaacactcaagatggaagttatcctatagatgctgtatccatgcctgttcgaaatgtgaattatagtatttttgcttgtgggaatggaaatgcaaaatatgagatactttttctagaaatatggaccaatggaagtttaacccctaaggaagcgctttatgaggcttctcgtaatttgattgatttatttcttccttttcttcacacggaggaagagggtactcgtttccaagaaaataaaaacaggtttacttccccccttttaagctttcaaaaaagattaactaatctaaagaaaaacaaaaaaagaattccattgaattgtatttttattgatcaattagaactgccttctagaacgtataattgtctcaaaagggccaatatccatacactattggaccttttgagtaagacggaagaagatctgatgagaattgacagttttcgtatgcaagatggaaaacagatatgggacactctagagaagcatctcccaatggatttacctaagaataagttctagttttaaatccattgcaattttttcctcttcttctttttcgagttagaataaaaagaaaaaataaaacaattttgcatctttgggacaatctatattttcgcgaaatggatcataataaaatagattataggtatctagggaagattcacttggaagtaactatttcctagatacctatgcacggtacttcacgattgaatgaatcaaactgaaaaatccctaaaaaagacctaaagttaaggatttttcaatgggtaatgttgctccaatacctaaccaaagagctactgcagtaccgattaaaaaaacggttgtagctactgggcgacgaaatggattttggaatttattgacattctctagaaaaggtactgtcaataagcccgtcggcacagaaaccattaagagaacgcccaataacttattaggtactgtacggagtatttgaaacacgggaaagaagtaccactcgggtaatatttccagaggagttgcaaacggatccgccggttcaccaatcattgacggctcgagaaccgctaaacctacattacatgcaatagtacctagaattactactggaaaaatatataaaagatcgttgggccacgcgggttccccgtaataattatgtcccatccctttagctaattttgctcttaatacaggatcgtttaagtcaggtttctttgttattgggataggtgaattctttaagatccagcccccaaaggaaccggacatgagaatttttcatcatccggctcgagcaagaatgaaagaaataaaaccgtagaagatccataatagaataaggtatataatggctcaatggctctaagtaagaaaagctttatcagattctattttccgaagttgcacctacaactattcattgaaaagaatcctactcttatgggtaaatgctcaatatccaagtgggcttacaaatttgatcatgatcaattgctttgtggattgtctcgcgtctcttgattagttggtatttatcccccccaatattgcaagtttcttacgtccaaacaaagtatttacttgttactaataaaaaatcaaaaagtttagcctacgttcttccttagatcccttcttttactccgatagtattgcagatcgcaatcgatgcaaagaaaatgaatgcatttccatactataataaaaagtaagtgtaataaatagagaattggatcatgtcacatgacttattccatttctactctatgggatcttacgga

SEQ ID NO: 13593 - DNA, 1702 bp, Oryza sativa
attttttaataacccatgtttgttacaatgaaataccacaacctacccgatatgatatatgagaattagaactctctatgagatgccttccttataaagggcccgaaataccttgcttacgtatcattagaaagtgcattaacataaatacggcagtaagcagaggaagtacaaaggtatgtaaactataaaaacgagtcaaagtggattgacccacactagcacttccacgtaataactccactaaaggtgatcctattaccggaatcgcgtcaggcacacctgtcacaattttgactgcccaataaccaatttgatcccaaggtaaagaataaccagttacaccaaacgatgcagttaatacagctaaaaccacaccagtgacccaagttaattcgcggggttttttaaacccacctgtgagatacacacgaaatacgtgcaggatcatcattagaaccatcatacttgctgaccatcgatgaactgatcggattaaccaaccaaagttggcctcggtcattatgtattgaaccgaggaaaaagcctctgtaacggttgggcgatagtaaaaagtcatagcaaaaccggtagcaacttgtactagaaaacaagtaagtgtaattccccctaaacaataaaatatgttgacatgaggaggaacatatttactagttatatcatctgcaattgcctgaatctcaagacgttcctcaaaccaatcatatactttattgagataggtaactaacccgaacccccctccgagaaccgtatatgagaatttcatctcgtacggctcaaacagaaacacacaaattttcaacggatattagaaaaaaggttcaaaacttcatcagccactgggttgggtcgatttgccttgaagatatgaaataagaaaaatccagaatttcttctttgtgatgataatgccaaaaaatctcaagttggctcgtctatctttctttcccaaatgttgatcattagaggcctcttgatttttctcttccctattttggatttcttttttttgtgcgtaatgcagatttactcttgttttactagataaataaataaagcaaaaattggagtagttttctggtagaaattatcttgttgcgatcctatgaatcagttcaattaaaaccttagattcatactagagccacgatgattgagtctcaagctaaacaaaaggcaagggttcttcgaataagaaccgcttgatgatcatttattgaatcggtgtaatgactcgacaaaatcgagagaaaaaaagttgttttttgggcaaacaaaattggaaggaagaaattttctttttttatttttattaagaactacttgaatttttttcagtctggttgcgaggtctgaatagttaatatgaatcatagtttcatttttttttcttgatccactctatctatttcgtgttccagatactagaataaataatatccgacgaattagaatcatcttgatagagataacaggtgctttctatgtattatcaataggagcaaattctaacaagtcacacactcatattccagagataccgaaaccaaaaaattccacggtcgaactaccagaatgtctagaaatgtagagcttaaagtagaaaggctcttttggatggaaaaactatgacttcgtagttttcgttagtagaaacctaattcattaaaattccgtc

SEQ ID NO: 13594 - DNA, 2309 bp, Oryza sativa
ctcctggtagtaggatctccgactttttggaatggtccaaattccacttgagcatccaagtctggatcaataccagcaaaaacatctcggaacaaggttctagccccatgccaaatgtgtccgaaaaagaagagcaaagcaaaggtagcatgaccaaaagtgaaccaaccccttggactgctgcgaaaaacaccatctgatttcaaagtagcccgatctaattcaaaaatttcccctaattgggaacgcctcgcatatttttttacagtagcaggatcagaataacttactccattaagttcgccaccatagaactccaccgttacgcctacttgttcaacactatatttggattctgctcttctaaaaggaacgtccgctctcacaattccctcttcatctaccaaaacaaccggaaatgtttcaaaaaaagtaggcatacggcgtacaaaaagttcgcgcccttctttatctctaaagataggatgtcctaaccatccaacagctattccatccccattgtccattgagcctgctctgaataatcccccctttgccggattattaccaatataatcataaaaggctaatttttcgggaattttagaccaagcttctgataaactgagattttcggctaacccatcactaactcttcgatatatttcttgctgaaagtatccctgatcccactgataacgagtaggcccaaacaattcaattggggtagttgctgacccataccacatagttccggcaactacgaaagctgcaaaaaaaacagcagcgatactactggaaagtacagtttcaatatgcccatacgtaatcctttgtatagacgttgaggtggacggacactaagatggaataggcccctaatatgcccaatgtacccgcagcaatatgatgagaagctattccccccggaacaaaaggatcaaaaccttctgcaccccacgccggatttacagcttgtacttttccagttagtccataaggatcagacacccatatcccaggaccatacaaacccgttacatgaaatgcgccaaagccaaagcaagccacccctgcaagaaataaatgaattccaaagatcttgggcaaatccaaagaaggttttcccgtccgctcatcacagaatatttcgaggtcccaatatacccaatgccagatagctgccaagaaacacaagccagaaaacacaatatgcgcccctgccacgccttcataactccaaatacccggattcgttacagttcctcctgaaatactccaaccaccccacgaattggttattcctaaacgagtcatgaaaggaatgacgaacataccttgtctccacattggatccagaacaggatcagagggatcaaaaaccgctaattcgtataaagccatcgagccagcccaaccagaaactagagctgtgtgcattatatgcaccgaaagcaatcgacccggatcattcaatacgacagtatgaacacgataccaaggcaaacccatggaaatacccctttagcaaagaaaaatagacacgatgtcactttattttatcgcattggcaaagactatccatatcctatgtacctaacccttctaggggattctgtgtcagaaagcgtgaatatttatttcattccattaaaaataagaagccaattctgttcgtaagaagaaagagaagcagatctattctatactcgataagtgccaatatgcaatgggcagcttggcttatttggaaaaaacgaagaatagatccctatctctttttgtttagtattcgaatcacccattcttttttctttattcaatctgtcttatcctacttatatgtataatctttcaatctatgtattatttcaatctacgtattaatagaatctatagtattcatatagaataagaaaaaaagtgaaaacaataaactgcggattctttctttctcttccattcttacgtttccatattaaagtgtagttttcttacttaaatttaataatattaatctaatatgcccattggtgttccaaaagtaccttaccggattcccggagatgaagaagcgacttgggttgacttatacaatgttatgtatcgagaaaggacactttttttaggtcaagagattcgttgcgaggtcacgaatcatattacaggtctcatggtatatctcagtatagaagatggaattagcgatatttttttgtttataaactcccccggcgggtggttaatctcaggaatggcgatttttgatacgatgcaaacggtgacaccagatatatatacaatatgcc

SEQ ID NO: 13595 - DNA, 5299 bp, Oryza sativa
acttattagaaacgcaagacagccaatacgaaatgctagaaaatcggccgcgcttaagggatgtcctcagcgtcgaggaacatgtgctagggtgtatgtgcgactcgttcggatcatgggttcaaacaaataagacaatttttgaagtatccatgatcggtaccaatgaataggatagagcttctctatcctagatttctacggtatatggaatttctggtttcctttggtgcaaatccaatcatctagattggaaataagaagcaattcccccattggtagcaaacggctattcattaagcggaggaaatagtaataaaaagataaaggcttatgctcctttatcttaaaaaaacggactaagagggtcagctacttagccaactttcataattaaatgccgtcactgtatggataactcttattgtgaaaagagctatttactctataatggataggtagagccaaagaatgtgaactatacaagttcacaataccctttgatgaaatgaaagaaagggctccggtgtatagagagggcctcgccgtttaaaagggaaccatagaaacgatggaacccactattttttagtatcgtgcgaaataactgaagggagtagaagagaaaattgtggttgggaaggttatagtagcaaaagccattggaactaatattttatatatgggaataattcgttttgttattaatgggaaaaaggatggctaaaagaagagaaatcattagttattcattaaggttaatttgattcaatgaccagagttccgcgaggatatatagctcggagacgacgggcaaaaatgcgttcatttgcctcaaactttagaggggctcatttaagacttaatcgaatgattactcaacaggtaagaagagcgtttgtttcctctcatcgagatagagtcaggcaaaagagggattttcggcgtttgtggatcagtcggataaacgcagcaacgcggatacataaagtattcgataattatagtaaattaatacacaatctttacaagaaagaattgattcttaatcgtaaaatccttgcacaagtagctgtattaaattcaaataatctttacacgatttccaataaaataaagattatcaattaaagggataaaaaagtaatatacaggaataattaaaaaagaattcccggagaggtaactccgggaagatacaataaattaagattaagtggtaggaatcaacgagcatgttgcaataaataaaaaaactattttttcttccccattgttctttcttataacaaacccaagaatctaaattggattactttctttatatatagtctggccctttcgaataaaacatcaacaatcggaacttaagttccgattgttgtttcttaaagtctggttggagtttcttaagtttcgattggaattgaacttttgtgttaatggaggaatatgtctattttttctgggtctagcacctgtaattattgccattgactgggcttgaaattgtttctcattctcatagttacgaaatggtaagaaagataaaatacgagcctgttttatagcaagagtaattaatcgttgttgtttcaaggttaatctatttattcgtctcgataatatttttccttgttcactaataaatcgattaattaaactcatgtttctataatcaattcgatcccccgggccaatccgaggacgcctacgaaaaggttgtttgggtttgcgaaaaggttgtttgaatttacgaaaagtttgcttggatttacgaaaagtttgcttggatttatgaaaagtttgtttggatttatgaaagggttgtttagatgtatacatgatttattccttattttaaaattgaaaaaaaaattgatttgtttattttattaattttggatccagaagaaatagtctctctttggtccatatattagatgaataccctcgatacatatgaaataatatctaatggaaatcagacaagttgatttgtattttgtattctatctatgctctatatattaaataggaagttcttattctttttgatctttggaaagatcgaacacaagatgctcctatttctttatttcggcatgaatcgtatgcttacgacaataacgacaaaattttcttaattctaattgtccgggtgtattgtggcgattcttttgagtactatatctagaaatccctgccgactcctcattggccccttttcgaacacaactcacacattgcaaaataactctgattctaacatctttccccttggccatgaacctcctttcctttttggattgacttaacttaattcttctacttattcttttattcctctattttgaaaccgaagaggaagaagaaaatccattagaataaaaatttttggaaatttttcaattaagtaataaaaaatagagaaataattaaggaatacaatccttgtcaaattagcaaggattttgaagcaaaatcctttcattttagtagccaacccagcctctttctatgctctgatttctgaggcctgacttagcttggatactgcttttaattgaatttcttttttcaaaaatgagatttaccaaatttttcatgactctaaggtccaacccaatctatcttttctttctttttctttcctatactaaaaagggattgaaaagtgggaattttttatcatgtcacgaagaactctattcctcacatagcaacaactagaatgaaaaaaaggggaatgacaaagcatctggaaataaacgattaatttctatcaataaacctgctaaagccccaaaccatagagtacttagcacgggtgctacagagagatatgtttttatatcccgcattgaaaatcctccttccttattggaatacgtatatgatcagatattattgcccaagatcatttgtatttcttttgtttaggcgaaattccgaactaaaaacgaaaaagacaatcccttcctatagattaccaaggaatagtaatctttcttttataggtgaaattagattggatttagatatataccattccttgattatatgagaccaaaaagaagaaatgacacgaggattctctatagatagaaaaagacaagaaaattaggatgtggaaaacaagataggaattgtgtacaatgacattgtacaacaatttggaaaagggatgtagcgcagcttggtagcgcgtttgttttgggtacaaaatgtcacaggttcaaatcctgtcatccctacctattacttctttcttctttataggcagtagtgaggaggtcgattaaagcgggtataacttgaatttgtggatactatacgtacgtgagacacattaggagtagaaaaggatttgatttttgaaagcgctcttagttcagttcggtagaacgcgggtctccaaaacccgatgtcgtaggttcaaatcctacagagcgtgattccatctatcttatgtcgaagcagggcaaaataacttaacaaaacaaattgcaattccaatttgacctcctccagaccagagaggagggcaatcaaaaaagaaatattactcaatcaaagatccaactgatccccacgtctgtattgcaaatacgcagtcacgaataatcccgctaaagtaataggaattaggcctaagacgattccaaatagaaaaacttcaatcatttcgatttgttcgaggggataaaaaaaagaggtacgatttatccctaaatagtagtctaaattatccacgaatctcaatgaccaagaaaaaaagaattggtaattagtgcgtagaataccaggaatccaaaagagagattttttcttttctgccttattcattcaattcatttcaaataagacgtatcttgttcaagccaataaatagagctagggttagagttaaagcagccaatagaaaaccgaaataactagttatagtaagcatgaaagggttaaattccattttttttactacactacatatgttggtaaagcacttacctaagttatggaaaattcataattcatcggttattttagataatactaaaaaacaagatagagtgagatacagaagtgtaaaagaaaatggattcatcagatggggcatgagtccctaattccgaatcaagagatttgctgtgtaatctgtcaattgagtaaagtaaaaatattaagaactagatcagctaaccccagtgaaaaataaagaattgaatttgaaaaagttctttctattttggtctttttcaataggatgatttaaccttctttttggagcgaacagtcgaatattcccctattccttcttattttaattgattgtattccatatggaataagaggagaagaaaagcattccacgacccctcgagggtctcctaaaaaaaggaaatctttcctgaatttacttttttttaattcctttttcgaaccccaatcaaagtcgattcgaagcacttctttttccattacactatttcggaaacctaagaactggcaaagttccacgcttgcagtttggtcaagaaagttagtaaacaaggcaagggttgattacgaatcttgattcttcaaagaatgttttctctctttcataacagattatctactatttgattttctatttattagatattatattatgctaaccaattaaattctttaaggggaaaggttggattcgaagggatagctttcgcatctacttctctttgtattgtgtcagtataagaatatctttcctaaattctttatccaaacctgttgatcattaacttagattttcccaagatcttgagccctattccgaattattctactattccgaagccggtgaaaattaagtaggaccctcaaaattgaggttttctattgatgccttgaataccatatagcttaccctatagacaaggaacaaagaagagaaaaaaagaattctgtttcgagaccaagcgaaacaggattgctgtgccataggaaggatagctatactaatttggtatactcaaaatacacctttggtacaaaattgacaatctcacaaggatgaaatatcagtaattttctatttactggttgatcccatcttttacggaatcaattccttttttgaatgtacaaaaatttggggagctcagcatgtctggaagcacgggagaacgttcttttgctgatattattaccagtattcgatactgggttattcatagcattactataccttccctattcattgcgggttggttatttgtcagtacgggtttagcttatgacgtgtttggaagtc

SEQ ID NO: 13596 - DNA, 1443 bp, Oryza sativa
gattccaactatagaactatgacacaatcaacccgaatgaacaaaatgttgaattgaatcgtaccagtctatactggggtttattactcatttttgtacttgctgttttattttccaattacttcttcaattgagagaaagaaagagagtagtaagaattctcttatccccatttggaaggataccatccttataactatccatgactgtttttgtctctagcatgaccacttgataaaatgtggaggaaagtaggggaaatggccgatactactggaagaattcctctttggctgataggtactgtaaccggtattgctgtgattggtttaataggtgttttcttttacggttcatattctggattgggttcatctctatagtaattggagggaccaggttgtaaacatgaaaaaataggaacttagcgggtccttacccccttttatctgattagagcggaaaggacccgcggaattcttactcttataacccgacttttttaatctattccataacctacaaacgggtttcctattttgatttgtaaaaataacaaagagaaagcctttgctctgatggtcagaatccctctatttattcgttttgtttgttaattttgtttgttaataatgttagtgaagtaatccatcagttgatttataaccccctcgccaatgaaattaattcacttttatgaagcgaggagaaagaaaggatcaatcgaggatccaatattttattccccggaggaagtctcttgtaaatcattgatttaatttagagtaataaactaataaaaccttaattaaaactactcaactagcctaaaaataaaaaacagccttcaatggaagagtatccgttttttttgcaaaatttctgtaagttctaaattgaacttaattgaacaagtcaagcaattctatttggtcacaaaaaatttgtcccacgccatattttctttccctctttttgtccactacatcgcctgaacctaagcaaaagaggttcaagagacagacccaaataaagaagaaatagtaatctttgccgaataggaagaaaaaagattcatatttcgatacaagaagaatcgacacaagaaaaaggcaaaaaagcctttttcttgtgcccaatagaggattaagaagaccagcaatccctcctaaaaggatttgttccttttattgttctcgcccttgccttgcattctcctcgttttgcatgagatgatagaaataaggaattgcagacaagacatctcgcaaacaaaaaatagtctaaacaaaaaaaagatttccaaaatggatcatagagaattctagcaatcgccaataaatcgcggctttttaccaacttgatggtaagaaatcccgggacctagaaattcatttcgtacaattgaaccttttcaactgtttctttttgagaaccaaaaaa

SEQ ID NO: 13597 - DNA, 1429 bp, Oryza sativa
cttggcgtccatccgatgcatcgactatggatatttcatatccccccttttctttacgcagtatttttcttactacacctgtagacgttgcattatagaccgtattgttactcttgctaccatcaggatagatctgtccccttcctcggtttccccccacatatatgggatattttaagaaatgaacgtctttcttcatagcagggtcgggggaaagaatgggaaagacgatttcactatatttcttaccgggaacagggcctatcacaagaatattttttttattgggacgataactctgaaaagagagatttcctatcttttctttcaactcaggagaaatacggtcgggcggcgctaattcgaatccctcgggcaaaataagaacagcacccacattcaaccctccctttttcccattagcaagaacttgtttcagttgcatatcataaggaattcgaagaactgcttcaaatacagtatcgggaagcactgcttggggaacttcaatatccacaggcttattcgctaaatggcaattggcacatacaattcgtccagttgcttctcgtgggttttcataaccttgctgcgcaaaaatgggatatgcatttgaaatagatgtccgagttattacgtatatcatgatcgatacagaaatcgatcgagtcatctgttcctttacccaagaaaaagtatttctattttccatgtccaatcacagatcccggaatttctacaataaattagataggtagctaagctaatctagttccctatacacgaatctgttgtcattctactgcaacagttgtactggaatgatgaataccttgagcaggtagaaatagaaaaaaagaattttgctaaaatggaaaaaggctttctttctaaaggaaaaaggatgctaattttgattaatatcaggagatcaaatgagtttatgcttcactaattgaatgataaatgactacaagcgaaggagataggcggtttaaacaaaaaaagacccaaaatttcaaacatgtatctagaatcacaggaaaactacaaacaaaaatagtgaaaattagctcgttaggaacccatccaagatcgttatagacccaacgaattagtagttcccaaccgcgggtggagtgaaatccaacaaaaaaatcagtaactaaaagaataaaaaaagcttttactgagtcatttaagttatagaagaattcctgaacccaagaattcaaaataacaagttcctctttacccagaaaaaaagaaccacttagaatagccaaacagattatatttgtcgagaaatgcaaaatgatatggagatgaccctcattatctattttggccaattgtattatttccttgcgtattcctataggggggttttgtacatgtgtattcggtttctcttttatcatttcgtcca

SEQ ID NO: 13598 - DNA, 2922 bp, Oryza sativa
tttagataaatactcaaaatccccttacaataatgcaatttcgaagggaccttttccctcgtgttgagaaaacttttcttcttccaattcttcttcattcaattcatttcaaaaaattcaattggtactcaaaatacttccattggtatgcgcaagaaataagccaattcggcagctttttgttcaatttctcgtggagtaaaaaacttctcatcagtacgagtcaagggaatggccccctggccccggatttccatataaaggatacgacgaggaaaaagaccttctttaacctgaattctaattgattggatatcccgcataaggaatcgaaggaagacgcgacgttttattccagggaatccccaacgaaaaatgcacactactccctcttttctatcgaatcggtcataaccactgcctacattccacaaaatagtgcaccacaagtaagcgctaatgaataggcctgcgattccgtagaaagacatcacgaccccctgtggaaaaaaaagaatttgttgagatggaagtacagatataatattcttaccaagataactggaagccccaaccgctaagaatcctagtgaacctagaaaaagaatacaggcccagaaaaaattacctctttttcgagaaccttttagaagttctatccatatgtgttctgatcgccaattcatattagatatactaacagcggtcgattgaaattgagagaataagctaaatgattttgactttactttttttgattctgaaatcgccttcgccaactagatactcctgtaaaataattggttagatacattgactttctattcaaaaagtatttgttgatccacttaaaaaaactcgctatacccggttccgcatatgcatgcatttatgctcgtagcctatatccgcatccataatccccatccatagcgggtttgcatttgtgtgtagaaagagccacataacataccatattatattacttacactacaaaagatccgtattatgatcctgtgtggaaatacattgagaaaattcggtcccgtcggttctagacaatcttatttttctgcacataaagaaataaagaagccattgcaattgccggaaatactaagcctactaaaggcacgaaaatagagggtaagttaaaatccatcatagaataggtgtctccattcaaatttactatttctatctattcgatttgatctattcaaaaaatatcttaagattcttatgatataattaagtatatctattataacgaatattgactattgtatttttgagtttgcaaaaaaagattttttatagaatactttttttttagaatactttagtattctaaaaaaaaagtattctaaaaaaaaagaatcgaatggattatataaataataagaaaatagcaaaaaaggagaagcaattaaaaagatttgatttttcttttccgatcctcgcggcctttctatccttctaatcgaacttgaaattggattcaaagtacgacttagtcgaatgcgcctatttcgaatccaaaatctttttcgtctacttccttccacatgcaatacttattcaaccactctcggaccccacaaatccgctgtaaggattgatacataggacttttagttgattgatattgccgtaaagttgaaacttttttaggcttttttattaaactgtaatttcctctctgcatacgtgctcttctagaagcatatacaataatgcgcggtaaaggagggaaaatagcatactcaatcaagggacaaattcttttacctactacagatctcatactaccccttagactttgtaaggccatataccacccccaaagggtatgaaaataccggatgaccttagcttttcgacgaatcctcgtctcgtgcagcgaagtcctgttagtaagaccccgcgcaaaaatggattatataagaatataattccgaatattcctccgggtgcgtatagtagcattgcgattccgaatcttttttctttgtgaatagaaaaaattcattgtatcgttgggtcggaggtttgctccagaaaaattcggaacaaaacgtctaccgcgttgaagcccatagccccatggagttccgcgaaagtatgattcttatcatcaggagccttttgaacgtctctacgatgggtccagattctatagcagtccaatctgaaatgaaagacttctcgctcttgatcggagtcgtaaactaaaactacctcttcatcaaggttatagaaaacttcgtcatctagttctaccattttgaaaatcaattctcttttcttacgagcatttcgagtcacttgttgactcacgattgtgcctgttaaaagtttcaaaatgtcctcttttttgaaagagagtcttagaaaggggtctaacttccaaactctgtcttttttcattcattctcctttagtttttttctctatctagaagtggaatagaataacccggttaaagggtaatgatcatacgtctgtaatgcattgtatgtcattgattctttcccaataaatgaaaactttttctgtaaatactgcgtatttgattccattatcatatgataatactctatttgtatttatttattgtattatacctttatatcttctaaatatatagaatagaggaatcccgatttgtcaagtctcatgatcgtatcaaaatctatttaaactcggctcaatcttttttcagattgagccgagtttaattgcaatcaattagaagaaaaaagaagaattactgcattttcgtaactgatttttgatctttctatttctcttcttttttatttagaccttttttctatctaattttatccacttagtctagctatctagtttatctaccggctcgaactcaaatttgatcgctttccatatttcacaag

SEQ ID NO: 13599 - DNA, 2393 bp, Oryza sativa
ccatttgcaagctgatcggataatttcattaccttcaagagcaagatcgcgcccttcgttacgagcttgtacacaggcttctaaagccacccgattagctgctgcaccaggtgcattaccccaaggatgtcctaaagttcctccaccaaattgcaatacagaatcatctccaaagatttcggtcagagctggcatatgccaaacatgaataccccctgaagccaccggtataacacctggcatggatacccagtcctgagtgaaaaagataccgcgagcacgatctttttcaataaaatcatcgcgcaataaatcaacaaaacctaaagtcatttcgcgttccccttctaacttacctactactgtaccagcgtggatatgatctcccccagacatacgcaatgctttagctaatacacggaaatgcataccatgatttttctgtctatcaataactgcatgcattgctcggtgaatgtgaagaagtaggccgttgtcgcggcaataatgagccaaactagtatttgcggtgaaccccccggttaagtagtcatgcattacaataggaacccctaattccctcgcaaatacagctcttttaatcatttcttcgcatgtacctgcagtcgcattcaagtaatgccccttaatttcaccggtttcggcctgtgatttataaatagcttcggcacaaaagacaaaacggtccctccaacgcataaatggttgtgagtttacgttttcatcatctttggtaaaatcaagtccaccgcgtagacactcataacatgctctaccataattttttgcagataatcccaattttggtttaatagtacatcccaataaaggacgaccgtatttgttcaacttatccctttcaacttggataccatgaggcggaccttggaaagtttttgaataagtagggggaattcgcagatcctccagacgtagagcgcgtagggctttgaaaccaaatacgttacccacaatggaagtaaacatgttagtaacagaaccctcttcaaataggtctaatggataagctacataagcgatatattgattatcctccccaacaacgggctcgatgtgatagcatcggcctttgtaacgatcaagactggtaagtccatcagtccaaacagttgtccatgtaccagtagaagattcggcagctactgcagcccctgcttcttcgggcggaacccccggctgaggagttactcggaatgctgccaagatatcagtgtccttggtttcgtactccggggtgtagtaagtcaatttataatccttaacaccagctttaaatccaacacttgctttagtttctgtttgtggtgacatacgtccctccctacaactcatgaattaagaattctcacaacgacagggtctactcgatatggattaggcgtaaatgaaacctttgcaaaaatcttaaaaaaaagatattcaattaatatcaactcattaaagaaaatggggggcatgcttaagttaatgaatatgtttcattcatataatatgtttcattcatatataatgggtacaccctgtgtacattctatgctataggaattctactataggaattcgataagaattgagttgttgttatggtaagttaacatgcttcgttattaaaccatggatttgattcaccaaatccatctttattgtatactctttaatagatatagcgcaaccccaaatcaacttctaatccttattaagttcttaatagacccccttttcttattttgagtggaaatacctaaatactacgaaaattctctgttgacagcaatctatgcttcacagtagtatatattttgtatatcgaagtcctagataagaaagtagagtaggcacaaatcgtttacaaaaggcaaaatgtatatgaaaaaaagattgattgaactttccgacgggctcattccatgagtaaacgattgaatgggattcgtttgggcaacgaaatcaagtgctggtccccttttctctcttattgaattaactaattcatttccttttgacttttggatttttggatatttttttggtgttgatttggcattattcaacaagaaaaaaatcaaaatttcgataaattccttttttttgaaaattatgtgataattatgagaaccaatcctactacttctcgtcccggggtttctacaattgaagaaaaaagtacagggcgtatcgatcaaattattggacccgtgctggatgtcacttttcccccgggcaagttaccttatatttataatgctttggtagtcaagagtcgagacactgacggtaagcaaattaatgtaacttgtgaggtacaacaattattaggaaataatcgagttagagctgtagctatgagtgct

SEQ ID NO: 13600 - DNA, 1780 bp, Oryza sativa
  unsure (1)..(1780): unsure at all n locations
gtgaaggaaatgatctttatatggaaatgaaggaatctggagtaattaatgaaaaaaatcttgaggaatcaaaggtagctctagtctatggccaaatgaatgaaccgccaggagctcgtatgagagttggtttgactgccctaactatggcagaatatttccgagatgttaataagcaagacgtgcttctattcatcgataatatctttcgttttgttcaagcaggatcggaggtatctgccttattagggagaatgccctctgcagtgggttatcaacctactcttagtacagaaatgggttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatttggatgctactaccgtactttccagaggattagcttccaaagggatttatcctgcagtagatcctttagattcaacctcaactatgttacaacctcggatcgttggcaacgaacattatgaaactgcgcaaagagttaagcaaactttacaacgttacaaagaacttcaggacattatcgcaattcttgggttggatgaattatcggaggaggatcgtttaactgtagcaagagcacgaaaaattgnnnnnnnnnnnnnnnnnnnnnnnnnnnnnnnnnnnnnnnnnnnnnnnnnnnnnnnaaagtatgttggtcttgcagaaactattaggggatttcaactaatcctttccggagaattagacggcctacccgaacaggctttttatttggtgggtaacatcgatgaagctagcacgaaagctataaacttagaagaggagaacaaattgaagaaatgaaattaaatctttatgtactgactcctaagcgaattatttgggattgtgaagtgaaagaaatcattttatctactaatagtggccaaattggcgtattaccaaaccacgcccccattaacacagctgtagatatgggtcccttgagaatacgcctcctcaacgatcaatggttaacggcggttctgtggagcggttttgccagaatagttaataatgagatcatcattttaggaaatgatgcggaactgggtagtgacattgatccggaagaagctcaacaggcacttgaaatagccgaagctaacgtgagtagagctgagggtacgaaagaattggttgaagcgaaggtagctctcagacgagctaggatacgagtcgaggctgttaattggattcccccatctaattgaagacaacccaacggtttagttgatacaaagaaaaagggaagaggggtagaaaaaattattagatagcgaagcgaagtagggccaatgctatctagtaatttttctacctacctacctactattggatttgaaccaatgactcccgccgtatgaaagcaatactctaaccactgagttaagtaggcaatttatcaccacaaaggaagaccctttacttcgatcgattatagatcgaatcctttttataagcaaataccgcttcgttattggtatgttattatagtaaacagatcaaaggatatcctctactattagagaatattcatcttgacaagaaattctctatatattaagatatctctgacaagggctatagctcagttcggtagagcaactcgtttacacgtgcgccaatgcttttcaagggagcttattatgcaatgaacatagtggatcttcttgcaaaatcgatgtcttacttcatggattcga

SEQ ID NO: 13601 - DNA, 1173 bp, Oryza sativa
tttaccgagaaggtctacggttcgaatccgtatagccctaatatgtccttttttagattttaggagagatatcctacgtttcctttagtatagttttcatttccctattagtacttgtttatagactggacaggcgcctgcgccataaaatagagataaaaggattaccagaggctcattcatcgaaaattatagagacaggaaaagaaaaatgaatttctatcaaatcaactgcaagatgttctccatcttgcaaattcctactttgtttgaagtatattactttgcttatctatatctatagattacctaaatctaaatcaatctacgttctgaaatagagttctttatttttatagaattactcctcattaggctgcatacattagtcatcctatcttaattaggctctaattcgtagtattttcgtttttattcctttttctagagattctagagaaaatgagacaaagtgaagcgagagagttttgtttctataagaattatgtctccaccatacctaaatagaaaggaaatcaaaaagaaagggggtcgggattccattggatgaatctttaaagaagacgtggcaaagaggaaacaaaggctaaactaagccctttggtttgagaaaaaccgatccttgtttcaccgaggaaaagagagaaattctgtataaattgacaatgctgacttgaattgactaattcagttccgcctattccacattaatgggagtacatttatgtttctgcttcacgaatatgatattttttgggcatttctaataatagcaagccttattcctattttagcattttggatttcagcacttttagctccggttcgtgaaggaccagagaagctttctagttatgaatcgggtatagaacccatggggggggcttggttacaattccgaatacgctattacatgtttgcgctagtttttgttgtttttgatgtggaaacggtctttctctacccttgggcaatgagtttcgacgtattgggtatatccgtttttatcgaagctttcattttcgtgcttatcctagttgttggtttagtttatgcatggcgaaaaggaagccttggaatggtcttaactgaatattcagactaaaaaaaaaaagaaggaaaagattccattaagacagttatgagtttgat

SEQ ID NO: 13602 - DNA, 688 bp, Oryza sativa
  unsure (1)..(688): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatgaactacttcatcagagggttctgttactaacatgtttacttccattgtgggtaacgtatttggtttcaaagccctacgcgctctacgtctggaggatctgcgaattccccctacttattcaaaaactttccaaggtccgcctcatggtatccaagttgaaagggataagttgaacaaatacggtcgtcctttattgggatgtactattaaaccaaaattgggattatctgcaaaaaattatggtagagcatgttatgagtgtctacgcggtggacttgattttaccaaagatgatgaaaacgtaaactcacaaccatttatgcgttggagggaccgttttgtcttttgtgccgaagctatttataaatcacaggccgaaaccggtgaaattaaggggcattacttgaatgcgactgcaggtacatgcgaagaaatgattaaaagagctgtatttgcgagggaattaggggttcctattgtaatgcatgactacttaaccgg

SEQ ID NO: 13603 - DNA, 615 bp, Oryza sativa
gagtaggtaacccgttcgctatccttgtttctattgcattttatctcatcgtatcacattctgttctacgattccacttcgacaaaaggaaagagcatacccaagttcaatagctttacgtccgctatcccgatcatggttttcctaccctcagggggaaagtaaaggcccttcccctttggaaggctgtgggcgaggagggattcgaacccccgacaccgtggttcgtagccacgtgctctaatcctctgagctacaggcccaccccgtctccactggatctcttcccgggggtaccccccaaaaggaacctccctctcctcagccatttcatttcgggttaagaagatgggaaagcccctttctctctataagaacagtgcgttccgaggtgtgaagtgggagagaggggatgtgatgattgaggttttgaataagacgacctttgcattttggatttggatctttttcgtatttcaaaatagtgaaaaagtcaaataagaggtgttaagctttttatcattctggcatcgagctattttgccgcaggacctcccctacagtatcgtcaccgcagtagagtttaaccaccaaattcgggatggattggtgtgg

SEQ ID NO: 13604 - DNA, 534 bp, Oryza sativa
attgtattccaggcagagcataacatccttatgcatccatttcacatgttaggtgtagctggtgtattcggcggttccctattcagtgctatgcatggttccttggtaacctctagtttgatcagggaaaccactgaaacgaatctgctaatgagggttacagatttggtcaagaggaagaaacttataatattgtggccgctcatggttattttggccgattaatcttccaatatgctagttttaacaactctcgttctttacacttcttcttggctgcttggcctgtagtagggatttggttcactgctttaggtattagtactatggctttcaatctaaacggattcaatttcaaccaatctgtagttgatagccaaggtcgcgttattaatacttgggctgatatcatcaaccgtgctaatcttggtatggaagtaatgcacgaacgtaatgctcacaacttccctctagacctagctgctcttgaagttccatctcttaatggataaggcttttctgctaacatatagc

SEQ ID NO: 13605 - DNA, 894 bp, Oryza sativa
cctatagaaattcaggggattccttttccctcggacctgattcttctagacacaaagaacttggatgtgatccttgggatgaattggctggcacaattccaaggagtagtggattgcgcgagacgcactgttactatgtaccgaggaccagaacaaccggttgttttctttgcacctccaacctctgtcagaagttcagaactgcatcagataggtctgtcagaaatccccatcgtcagagagttcggagacgtgtttccggaagaactacctggtatgccgcccaagcgagagattgagttccggatagatcttgctccaggaaccactcctctgcacaagcgaccctaccgtatggcagcaaatgaactggccgaagtaaagaaacagttggaagagttgaaagaaaaggggtacatacgtccgagtacttccccatggggtgctcctgtgatttttgtagagaagaaagacaagacgaagaggatgtgcgtcgactacagagctctcaatgaagtcaccatcaaaaacaagtaccctcttccccggatcgatgatctgttcgatcagcttaaaggtgccactgtattctccaagattgatcttcgttccggatatcaccaattacgtattcgggaagaagatattccgaagaccgcattcaccacgcgatacgggctgtatgaattcacggtgatgtcgttcggcttgaccaatgctcctgccttcttcatgaacttgatgaacaaagtgttcatggaatacttggataagttcgttgtggttttcatcgatgacattctgatatactcacaatcagaggaagaccatcagcaccatctccgtctggtgttgggaaagttgcgggaacatcaattgtatgccaagcttgca

SEQ ID NO: 13606 - DNA, 6604 bp, Oryza sativa
attaatactgcttaatttttacaactgtttaaatccttcaatctctatttataaatgctcgctttatgcaaatgaaccactttagctcttctttgatgattccctgcatcatacctctattccggtatgacttgctgagtacagtgggtagtactcatttttgctctacttttcccaaccccagagttcgagttcgggtcagatgaaggtttctctgaggagtaggcttcgtccgtgccgtcgaggatgcctgtggagtggtgttcccgctgcagtttagtcaaggattagctccagtttcttctgttttccgctgcatttatgtaagactttacgatgtttgtaagacgtggatctgtatgtcaacattgtcgtttgtgtaccccggctggtcctggacggggattttaatgcacattctgcttggaattctattcgggaatttctgggcgtgacaagttggtatcagagccgaccttgaccgtaggacaagccaaatggaaaaacctaagagccctctgaatccttttcattgcatatgttctttgcaattggatttgttccgggaaaattgggatctgttcttgtggttcaagggaaaaaatcttggtcgctcgtttaagcggggttttttcaaaacaagtcagtctagggttttagtaaaattattgggatttattcgtcagtcagttggggtttgatgggtgaaatgcattaggtcctagctcaggaatatgagttgcaaggtgtttatgctcttatcgttattattagtatgtatctaatttctcattattttatcgttatgtgggtctgtcttgtttattcgctctcatgcaaaatgatctatgcataaaaatttcgctcttgttcgtttcccttatttgggtcttttattgctttatttaaatttggatttgagcatgcattgatcctactcctttgtcttctctagatggccggtcacccacccaaccaccgcggagaaggcatgatcgatttcgtggcagagttggcacgtatgacactggtggtgggctaccccaatgcgccggagtacacgacgattccgctgcttagtggcgagcttcctcaccgtgtccgcttggaggtccatggctacgtggggacttgcctcgctaacatggcggtcgaggcatctggaggcacagcagatcacgcctgtcaggaggcagcctacttgatgatggccagactacgggagcgccacaactacatcttccacgacacggcgtaccgctaccacccccgtcgagccaacggtgatggcgtcagctccttccgtccgacagctggcgagaacgacaccacctttggtcacatgtgtgctgtgatgaggggattggacaggatgcactcggacttgcacaaggcgaccaaggctttgaacgatgggaagctcatgaggatcgtcgctctgaaggacgagatagcgcgcctgaagaaggagaacgctcagctaaagggtcttccagcgccagaaggagtccggatccgcaccacgccccgcaagacgacgactgcacctgtgcgcatccagcttgcgcccaggaacccacctccagcagcagctcccgcagcacctccagttccgcccgcagttcctgcagctccagttccagctcccgcgttcactctctccttcgctccagcatcagccgccaggggtccagccagtggcaccggaggttggttgtctgctactcccagtggcagcggcgagactgatctgtcaggctccaggagtcgctcagagggaccgggtgacgagcaggaggacgccttcgactccaccgaccgcaggagccgttccgagcattaggctcgttttcccattagtttatcgatggtctagcttctggttgttagtttgcgtgtttaggttgcttgtttggggtcagttgacggtcgatatcatgtgcctatgatatggctgtcttaataaggatttttgcttgctttttaagtgttttaattcagatcagaacaattgcagttttaattcctttgtaataaagcttagttcttgagcatctgtttttcttcttttcccccgtctgcttttccctccagatggtctacaccaggactggcagtcgcgcgacaggcgagggcagcaacggcgaagagcgcactgatggtgtgcaccccaacagcgattctggcaatggtccgccaccacttcccgagaatccgacgcttgcccaagttatggcacatcagactcagatgatggcagccatgatgcagcagatgcagcagcagcaccagcagatgcaccagaggatgatgcagcacgccgaacagcagcatcaacagtttggtccccctccccctcagtccaagttgccagagtttctacgcgtcaggccacccaccttctccagcaccaccaaccctatggaggcgaacgactggctccatgcaatagagaagaagctgaatctcctgcagtgtaatgatcaggagaaggtcgcttttgccacacaccagcttcagggtcccgcgtcagcttggtgggacaaccacatggccacccgcccaccgggtactgaagtcacatgggcagagttctgccgtagcttcaggaaggcacaggtgccagatggggtcgtggcacaaaagaagagggaatttcgtgcactccatcagggcaataggactgtgacagagtacctccatgagttcaatcgcctcgcgcgatatgcaccagaggatgtccgcaccgacgccgagaagcaggagaagttcatggcgggtctggatgacgagctgaccaaccaactgatatctggggactacgccgactttgagaggctggttgacaaggcaatccgtcaggaggaccaacgcaacaagatggacaggaagaggaaggccgctcagttcagggcacatcagggaagtcaccagaggccgcgcttcactcccggacagcagggtggacctaccaccatgatcgtccgccagcaccgcccgttcaaccctagcaacttccaccagggcaccagtggcagtcagaaccaccatggaggtcagcccaaccgcggtgcagctccacgcccatcagtggcaccggcacagtcaggccagcccgcgcaagccaagaaggagactggagcaaaaccagggtcctgcttcaactgtggcgagcttggccacttcgctgacaaatgcccgaagcccaggcgtgccgggccaaggtttatccaggctcgtgtcaaccacgcatctgcgcaggaggcacaaacagcaccggaggtcgtactgggtacgttccctgttaactcaatccctgcaacagtacttttgattctggtgcaacacattctttcatctcaaagaaatttgtcgggatgcatgggttaataagagaggaacttagcacaccgatgcgggttcataccccagggaatagctccacttcggttcaattcagcccttctataacaatagaaattcaaaggtcaccatttctagccaacctcattcttctcgaatccaaagacctagatgtcattcttgggatggattggctgaccaagtttaagggagtcatcgattgtgcgagtcgcacagtcaccttgaccaacgagaagggagaaaccgtggtgtacaaatctctagtctcgccaaagaaaggggtctcgttgaatcagattgagacggaaatcccagtggacaccgtagagaagaacttgagaaaattggaagatatacccatagtctgcgagtatccagaagtgttccccgaagacctcactaccatgccacccaagagagagattgaattccggattgacttggcaccgggaactgctccaatctataagagaccgtacagaatggcggccaacgaattagcagaggtcaagaagcaagttgatgagcagctgcagaaagggtacatacgaccaagcacttcaccttggggcgctccggtcatttttgtggagaaaaaggataagacgaagaggatgtgcgtcgattatcgcgcacttaacgaggtcacaatcaagaataaatatcctttaccgcgaatcgacgatttatttgatcaactgaaaggaactaaagtgttttctaagatagacctgcgatcaggctaccaccagttgagaatccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttgttgtggtgttcatcgacgacatacttatctactcaaaatccgaggaagaacatgagcaacatctccgtctggtactcgaaaagttgaaggagcaccagctatacgccaagttcagcaagtgtgacttctggttgacggaagtcaaatttctgggccatgtcattacagctcagggtgtggcagttgatccatcgaacgtggagtcagttaccaaatggaccccacctaagaccgtgtcgcagattcgaagtttccttggacttgcgggttattaccgccgattcatcgaaaatttctccaggatcgcccgacccatgactcagttgcttaagaaggatgagaagtttaaatggacagctgagtgcgataagagctttgaggagctcaagaagaaattagtatccgcaccggttttgatcctgcccgaccagatgaaagacttccaggtctattgcgatgcatcccgtcacggacttggatgtgtcctaatgcaagagggcagagtggttgcatatgcctcgcggcagttgcgtccacacgaaggaaattatccaactcatgacttggaattggcagcagtggttcatgctttgaagatctggaggcactatctgattggcaaccgctgcgaagtatatacggaccataagagtctgaaatacatcttcacccaaccggatctaaaccttcgacaacgaagatggttggaactaatcaaagactatgacatgagtattcactaccacccgggtaaagccaatgtggtggcagacgctttaagccggaaaagttactgcactgccctatgcatcgagggcatgtgtgaggaattgcggcaggagtttgaacatctcaacatgggaattgttgaacacgggttcgtagccgctctggaggcacggcctacgctcgtggatcaagttagagccgctcaagtaaatgatccggaaatagcagagctgaaaaagaacatgagagtcggaaaggctcgggatttctttgaggatgagcatggcacaatctggatgggagaaagattgtgtgtacctgacgacaaggaactgaaggatctgatactcaccgaggctcatcagacccagtactccattcatccaggcagcactaaaatgtatcaagacctcaaagaaaggttttggtgggtcagcatgaggagagaaatagctgaattcgtcgcactctgcgatgtttgccaacgagtgaaagcagagcaccaaagaccagcaggtttactccaacctcttcaaatcccggaatggaaatggaaggagattggaatggactttataacaggactgccccggacatcatcgggtcacgattcaatctgggtagtcgtggatcgactcactaaggttgctcactttatactagtacataccacctatacgggaaagagattggcagaattgtacctcgcaaggatcatgtgtttgcatggggtacccaggaagatagtatccgaccgaggtagtcagttcacctcaaagttttggcagaaactgcaggaagaattggggacccgtttaaacttcagcacggcctatcacccgcaaactgatggtcagaccgagcgagtcaatcaaatcttggaggatatgttgagagcttgcgctcttgattttggtggagcttgggacaaaagcttgccatatgcggaattctcgtacaacaacagctaccaggccagtctgcagatggcaccgtgtcgcgtcccaaatcgactctaaaatctatcctcgaaattgtgcaaagaataattaaaattcatgtgaaagcctccaacaattaaaatgtgcaaagataaaagtcaaatgaggcttggaggatttttgtatatttcctaaaagcctaaaatgcttaaacaaattttagtggaattttcagagcacaaataataattgaaaagaaataaacaaagttaaaaaggttttataaaaagaaaaccctaaaagaagttctttttttccccctccttccctcttgggccggctcggcccacttccctctccctctctctctcctctcccgcggcccatcggcctccccgcgcgcgcgcaccgctgacaggcgggcccgcccgccactctcgctgacgggtggggcccacctgtcatctccctcctcgcgccgcgcccgccgccgcgcccgtgccctagcgccgccgccgccgcggattgcgccgcatcccgccgtccccgcacgcattaaagagaggggaatcactccccgtgattccctctcccgtttcccccgtttcccctctctctctccctcggattcgccaggatttaat

SEQ ID NO: 13607 - DNA, 2431 bp, Oryza sativa
aagaccgccgttcgccttcccccttccctcctctctctcgggcgccgctccgccgcgccggtggtcgccggcggtgaccatcggggcgcgggcgcgccgctcccgtcgccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccacttcccgtggacccggtccgcgcgcccgctccctcggctgacgcaataaataggatttttaattgaaaattaaatgaagaaattcgcaaatatccatttaaagagcatataaacttcaaatggccatatcttggccatttgaactcggaattggaccgttcaagtctctaatttttccttaagatataaagaacccatttttgtgctttgtttctgctgttatgtggagttatttagtgttaaagcctttttcttttccgttggtcgtgtagacgctgcagcttcggaagatccgctcttcgtggaagtcgaagccgtcgattgggaaaacgagcaaggcaagacacatcatcttgatcatattgaatcccagtttataaaattatgttgatttaaattattgcattatcgctttatttaaattcccgcgttatcactgttttacttagccatgcctatttacctttgttatgaccatattattattgttattgttattattattaccttgttcaccctagacaaacaaaacctcaactagtggacactctactcatggtatccctagtataaattttaggtagatgcttcgcaatctaattaggtaaccttaggtggttttacaactttagactttgggaaatattcatatcacttggatactctggaattgttggtttattgtggaattggcttcacaccgccccctctattcaaaatcccctaaaatggttttaggctgggctcggggtgcgtggttttgatggtagcacctcggccgtataaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaaaagcacagggttggtgccctgctgcgaggggctcagttccgtctgcctgtcccgggggttccggccgtaggcgggattgggtcggtactcttgtctaaggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgagccctcggttatgggcaagccgagcaatgtacccaagttagtgttttaattcttaaaacctgcttaacaactaaaatatggaatggttggcctgggttggcttaggacgagctgggacccagggtcgggttgccagttcggtctgaatcatcataggccttgggttaaggcaggttcgtgtgggttcacggccttgattaataatattggatagttctaggatcgtgtttacaaaatggccttgagcaactaaatgtctttaaatgctgtttactgcaaccctaaccctttatgttataattcccttgtactcccttgcatttattttgcatttgtgggtgtgtcttgttgagtacggtggttgtactcagtcttgcttaattttcccaagcccagatgaggagttccttgaagatgaaggctttggtgtctagctcgtgcctgccgtcaagcgcctgtggtcgtcgccctagtcttccgctgtttctcgtttgtctttgtgtgttgggccttcgctgcccgtgtaataattttatatacgcttccgcttgttaaactctgaattgtatcaacttttggtgtaccttgcctcctgggacaaggaataatgcacgcacgtcaggaacgcctgttgggtgatttccggtcgtgacaagttggtatcagagcctcccttgaccctaggacgagccgtagatcccaagccttggctatattttccaaaaaaataaaaatcctttattatttgtgaaaacccgctattctctctttgtcttgctgcttcatttatcgtcaaaatctgatcttttaaatgttgcttttcttttgtttttgtttgtagatggccggcagcgttacccgtcgtggtttggacatgactggcttcgtcttggagctgcggggcatgtgcgtggtcttggggtatccacat

SEQ ID NO: 13608 - DNA, 1055 bp, Oryza sativa
ctaaacctacatatagtacctcgtggacagataaacaccctagacattcaacctcttttgagaacccaaatagaagaagcccagaaggacaacgaagaaatccaagaggtgaaggaacgcctagctgcagggtttgcaaaggaattttcgaccgatgagaaagatgtcttatggtataaaaagaggatctatgtacccgaaaagggcggactgagaggattaatcctaaaggaagctcacgaatcagcatattcattgcaccccggaagtatgaaaatgtaccaggatctgaaggaaggatactggtggcccaacatgaagagagatgtagcagaatacgtagcactctgtgacatatgccagaaggtgaaggctgagcaccagcgtccagcaggtttgctgcaaccccttaggattcccgagtggaaatgggatgagataggtatggattttattgttggattgcccaagaccgcaacagggtataattccatttgggtgatcgtggatcgacttaccaagacggcaagattcattcccgtcaagaccaattattgcggtgccaagctcgccgagttgtacatgaccaggatagtatgtcttcatggtgtgcctaagagaattatatccgattgaggcacgcagtttacttcgcatttctgggagaaagtacatgaagccctaggaagttaccttgcttttagcacagcttatcatccacagacagatggccagacagagagaacaaaccaggtcttggaggacatgttgagagcttgtgccttgcattttagcaaagattgggagaaatgtttgccctacgccgaattctcctacaacaacagttttcaagcaagcctaaagatgtcgcccaatgaggcattgtttggtcgacgatgtcgtactccactgatgtggtccgagactggagaacgggcggtatttggatgtcacgcccagaaatttagcccaaatttccagactattttgtgtattaaatccctgtccaggaccagccagggtacacaaaacgacaagtaatatacagttccaaa

SEQ ID NO: 13609 - DNA, 17284 bp, Oryza sativa
cggcatgtcaccgcgtcatcatgtgcccatgatgcacacgtcaccatgtcgagtaattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcgcattttagttggataattacgaccatgaaacatggccagatgtctcgagcacgcagctcactctgatactaaaaaggtctaatactgtaattatcccatcaactgagctagtggtaattaagcatggctaagcatacagttctagctaggtcacataagtaacatgagctagtcgattcattacccaaggttgacaaagaacagatatcaagtaaacatggcacaagcgagcagataggtaatgcccggatcccatgtaattagcaaaacatgcatatttatttgtaaacggtaaaacatttataaattgggatcaacatgctcaaggggaatgtgtgacttgccttgcttcttcaaaacgatcttccgaactcttttcctcgcgaccgcgaacttccgaaacgacggattctacacgctggcacgcaaaacgaggaaaaaacctaataaaaaccaagaaaatagtacataaaaactaaacaaacatgtagagctcaattttagatgaattttgcaagttgaatggctcaattcggagttcgaatgaattagatatgaattttagaagttttgagccatttaaatgaatttctagaattattaacgaattatgacgcaattattatttatttttacaaaggaaaagagggttgctgacgtcagcaaggggcgccggcgccgacaggcgggccccacacgtcagcgagacgaggtggcggtccaccgtggaccgggaccacaatggacggtccaccgccggtccacgggttggacggcccagatcggccaaggccgatcggacggctggggacggctcggcggcgcggcctggccagcgcgcacacaaggctggcggcggcggcggcagggaccaaagcgacggcggcacatgggctgggcggccaccggcggcggcggcacggcgcgtgcaagcacgggaggcggccggccaaggggagaaacagggaagagggaggagtgctcaccgagggcggcgacgaggggcggggagaggcgggggagggagctcggcgtcggcgctcctcgggatgaaggcggaacggcggcccggcggcgttccgtgagcaggaaccggcagacggcggccggaaggacctggggaggatgggggagaggttaggagggggagagagggttctcaacggcatgaatcgctggtcggaggggagaacgggcggcggatgctcaccggcgcgaggggaaccgtgttccggcgggatcccggccgtgaaaagcggcggccgaggtgctcctcggcgctgcgaagtgagcggcagcgacagcgcgacttggggtggctaggagcggcgccaagcggcggctggagtcggtggcttcggtgcaaggaggcggtgcgcgtggcgatggtgcttcggaggcggggaggggaaatggagcggacgccgggaggtggcacgacgcggcgaagccactggtggcggtcgcgcggaacgacggtggtgggagcggctgtggcgaccggctggagggtcgtcggcgagcggcggcgggaggtgcgacggtggcggggtggttttcgtgcacgggagggctcgagagagagggggaaatggagaggggggtgcggggaatgtttttataggggaggggaggcgggatcgagcccgagagaggtagaaaccggccggcgacgtgggaggagagagagatgcgggaggcagcgacgtggccggattttgcggggagagtgggggaaaacggcgccgacgtgggcgacgaccgcgtccacgcacgcgcgggagagggagtcgcgcgggagaggcggcgacgtgggaggatttggcggccatggcggcggttggtacgacgggaggttggggaagaagatgacaggtggggcctcgggtcccacctgtcggggagagagagagaggagaaaacgggcgagggaggtaaagcagacttgagggagcgagagagagagccgagcgggccgagggaggaggccggcccgagagggagagaaagggggcgcgcaggccgcgggagagaaaggaggggttgggccgaaaggggcccaaagagaggaaggaggattttaattgttttctttttattttaattgatgcaatgatctttgtgctattaaaactatttctcgagctccgaaaattcacggaaaatttcggagagtattttagggcacaaagaatactccaaaatattcccggccaatgatttttaaagggaaaattttaattctcccattaattcgctcgaataaattgctttaacttttagtataatttcttgaaatgcattattaaatgattttaaaacccgaacgaaaatcggggcgttacattggacctgacattatcaaagaggccgaagacaaggttcgcctgatccgtgaccgtttaaaagtggcacaatcacgataaaagagttacgctgacacccaaagaagaaacctggagtttaaggaaggggattacgtttatctgaaggtttctccgatgagaggcacgaaaaggtttaaggtcaaagggaaactagcgccaagatatgtgggaccttttcaaatcatggctagacgaggagaagtcgcatatcagttacagctaccagaaaatatcgccgatgtgcacccagtcttccatgtgtctcaattaaagaagtgcttacgagtgccggaggaacaagctccgttggaagaaattcatattagcaatgatctcacgtatccagaacacccagtccggatattggatgaagcagaaaaaaggactaggaccaaagtgtggcgtatgtataaggtacaatggagtaatcacactgaggatgaagccacttggaaagcgaagaattcttgaagacggaatacccgcatctattcgaaaaccggtaagaaatctcgggacgagatttatttaagggggtaggtttgtaacaccctgaaaattcgaccaacgaaaatcaaaactctaaaaatatgggccttcaaaaactttttaaataaattgcatcatgccgattttattcacctatttcattggaatttggtttcggagttcatagatcgcgaatagagaataattaatgaggaataaagcctaaaattaaacgggaaaaataaataattgaaatataatttaaaataaagattaggtgaggttggaaataaataaaatattatcgcgaccatattagtaacaattaaattttagtgcgatggaataagaattaattctgattaaattcaagaaaattatataaaaataaaatatgggtaatgttaatctagagtgaatcttttggttgaaacaacacaaatattatgtaaacttcatttgtggaaaaattaggaattaaagaataagatttataaagagaataggttaaattagggttaaataagagctagcactgttcattgcgcactaggtgctcgatgaggttccctagccccgtcccctcccctgccgcgcgcgcctcgcgcccctagccgtcgccatcgccacctgccgccgcgcgccgtctcatcgcgctgccgcgccgcgcctccgtcccgtcgcctcgcgccgcgcgctcgccgcctcgcgccccgcgccgctgccacgccgcaccatcgtcgcatcgcctgtcgccgtcacgccgagccccgtgccaaaccgcgccgagccccgcgccgcgccgcccgcccgtcgcgttgccgctaccgcctgccgcgccgcgcgccgcccgtcgcgtcgccgtcgctgccttgcgcccctcgcgcgtcaccgcgcgccgtcgctgttgcgtctcgtcgccgctgtcacgccgcgcgccgtcgccgtcacgtcccgagccccgtgccaccgcacgcgtcgcgtcgccaatgccacttgccgcgcgccgctcgcccgtcgccacctcgagccccacgcgccgcccgtcgcgtcgccattagggccggccacccctcccccgcgctctataaaaccccggcccccccttctccaccccacacccatcccccttcatttccccctccttctccacgtgccgccgccttcgtaccgccgcgccgttgcctcgaagccgccgcgccgcgccgagtgccacgccgtgcgtcgccgccttgcgccaccgccgccggtaagccgccccccccctcgtccggttgccgtcgccgcccgggtaggccgtgagccgagagagagaggtggggagaagccgggagagagagagagaaagaaagaagaggaagagaaaaagaaagaaagaggaagaaaaataaaagaaagaaaggaaagaaaaagaaagaaagaagagagaaaaaggaaagggaaaaagaatagaaaatttgagagaaattgaggaggtttagaaaatttaaaataattagaatttaattatagattaattaaagtgtaggattgcaaaatattaatataattatagattatttttggtaatctctataagtaatcaattcgcggtaggaatttagatttatttaagaactaaataattatgttgaattcttaggaatgtacttctaaatcacaaaatgacttaggttgaatgacccaaaaatttgaataacgtggtttcgcaaactttgtagtcgatatagaatgatcgattcgcgttcgacttctatttgagtttatttggattttatttgaattctaattgaattcaaatcatttcttcgcacgtaattctagagcccgagggagttgtggatccgagcgagggtcaagacccgcaggactacgagcaagacaagtcatcactattcttgaacatgttgatcccaattgcgaaattaatttgtttacaaataagattgcatgcaatgatgaacatcctacttgtgattatgccatgccttgattattgtttacctttaaatccttgtaaccataattacgtatgggtccttagtcaactatgacacatgcttaagaaatgctacactagattcatgcatgctcataatttatcaaatgctatatgcttgggcaattacctttgggaaggtaattgaaatgcggcatgtggagacatgagcgccacattgccatgataatgatgacatgatttgtgcaagtaggaatgaaattaaacactttttttagaccggggcggacggaggatttgggtggtatatgggaaaggctagtaccgtccccggtcaattaaggaccgagccatgaagttaagcatgaaacgacccttgtacaaacgcacttctcgtatgggtatagacctagcggattagatagccgagcggaggcagtatctctgcatagatggttcaccccctgagtgaggcaggtgcgctaccgtgggacagccgttgaggtagggccgagaggcgtgccctacatcggtgtcgccattggtaggactgccatgagtgtgtgagagagagaacttaacttgaaccataatttaatatgtgtgtgagacttctcttttccgggagcgccataactcctctcactgctagaaacatggacgcctagagtgcatgaggatttaagttcatggagcggatactaccaatgcgaagttatcgaaaagctttgccgtgacgcgtctcatgtgttgggacgaggctcatgagttaggcagtcgcggagtgcgggtaaagtgtacatccactgcagtgtgagtagaccaaatctattcgaatacccgtgctcgcggttattgagcaccaggacgtgtattacacttggctagactctaaatccttaacttgtgtgggatgggatattgcatgatgatttttatgctgctggagccacttcctgagaggcgggaaggtggacatcctcagaaaatcatgacgattcaatggcgggaagctatccttgggatcacaatggatggtggacagaaccgtcattatttaaatatgaacactggtactaaaatttgatcagtctatgctaggtcttaggcttgtgaaaagaattacaaaactggctttgcgcaaagaaccatagccatcctttgaatacccctatcatgtgcattgttgctgtgatggcttgttgagtacggttggtactcacccttacaatatataaacttaatcagaggccggagatgaagcttcggaggatccctacgcgtactaccaggagggtgatgaagacgacggcgctcagtacgtcttagttacggtcgttgcctgtggcaatggcgtgccgctgccttaactccgctgccttacctacttctgcttttggaatgtattccggaccgctcggtctgatgatctaagactatgcctgctggcttatgatgtaataatttgcactagactctcgtgtatgtgcatttggtgtttcagctatgaactcgtgtgtaccagactacttgatccagggaaatggtactgtttacacgattgattcctgttataaaaacgggggtccacaccaatagagggggaaccaagcaaagcggacgagggaggtgaggtcgatcagctgcgcatagacaacgtctccacagcttgtgccgagggcagggagctggagaagagctacgagagcgtgatgacgtggtccagtgagaggggctgggcgaagaaggcgttgtaggctgcgaccgccaaccaagacaggaccctcctgaagcaccaacccgagcttgcgcatcaagttgcgttgtgcgtgcgagacagtgtgacttggcctggcgagcgtgagcttggcaacaatcccgttgctgcgcttcgaaactacccccacaggtgcggcgaggggtgccgaaggcgggcgcagtgggaggagtgccggggtcagaggtttggagcagctagcgaggaaggagcacagtgaggcattgtctgcgactgaagtcggcaacaagcgtgccattggccaaccatcaaggtcgaggacgaccaccggcacgtcgaacaagaccccgtcaggcacgcaatccactgtcatcgaacttagtgacagaggtgtgcagacacctgcaacagttgccaccggccttggcgagaagtgggccaatggtctcggcagaggaggcaagcgctacggcaacggcggcggcagcgattgcggtgggagagaccacggcgcatcggctgccgtcaccggcctcggcgaggagatgcccgacagcttcgaatgtggaagggagagcgatggcggtgttgatggcggcaacaacacgcagggcagtgttggtatttcttacaatcacgcacgtaataccattgttgcacttcccattagagtttccaagggtatcgaacacaaggaacgtgtgtgtatcatcaacgatcaagattcgatcaaggacaacaacttaggagaaattgactctagaggattcttatatcttttaattaattaattaagttcaaggtaaaactctaccggatacttcgggcatcggccctcctctggcctgccagcatgaatattgcatccattttatgaatactcgacgaaattcaccccccctgcgttgtccgcgaagcagtggtgtcggcgcaagggcgggatagggttgagcgggggatttagattgggtgacatagggtaggcatagagtgaatcttggccctccaaaacaaaaccaatgggtgaaattcatccacgtctcgcagaagttaaaattttactgggagtaaaatttcaggagttaaaattttactttcaggagttaaaaatttactggagttaaatattaactcgtgttgatgtagatgaatctcagccgttggatttgttttagagggccaatatccaccctatgtcaccgcgtgtctaccctatgtcacccgatctgaatcctgagtgggacgtgtttgtcgactgtcgcgatgccacgaccaatggtgggagccctacctgtgtcgaggcgtggagtctctcggcgggagctccgtctcgtcgaagcccttttgtcttgagttaacaaatttcagactagcatgataagtcgtcaactacatcctggtaaggacatattggattggaggagacacgctttggttcaacggttggcttatcttctcagacttcttcgtgtaattttccactggtaagaagccaagaatgcgtcgtacatgtcgatatccctttttctcttccaatttttactgacatgtggtgcaaaaaactctcttgtgcagtttgggggtgggttccgatggcatccgtcggcacgagtacaggctttgttgaaatgtcaagccgaaatgaacacggcaaaggcttctggaatcaggagccctggatgcctggtctctcatgtcatgtgtgaacaacgtgcacacacaaaaaggatttatgatttctacctagtttcaaaaaggtcagcgtatgtgtaggacctcttttggacgactgactgacttgagtgttttttttttttactaaatcaccggagggggagagcttccccacctgaattttgtcgttgcatgaaaggagtgaaaaagttcattacaacaggtttagagatcttaagggggaggagaaaatgtttttccaaacagagattacatgtctatcctcaatttttaatttctctgcccagagagctgcctcattgatgcatcgatgtaggcaggatcgaatcgatggagtttgtcccctgaatacaacgtcatgccgatgattccagatcacccacatacatagcaagaagaagacgtgatggtgaagctcagggacaattagagagggttttatttgatgaagtagccgcacatcttggattatcggctgcactctaatacgttcccagaaactctacactgactgagtgtattaccttttgtctggactggtatctcttaatatatattggccggcttttcgccggcccggcaaaaaaggtatttcaatcaatcatctcaaagatgagatccactccggtgccttctacttgtagtagaaaataatctgaaccgttgatctcatttgatcatagggttcagatctatttctactaccatcacacttaatggtagtagaattgtagagggatatttttgtccataaaaaattatttgcagagggatattttcgtctttcccgggctccagctggcgccgccccgcgtgctgctcctcctgctggccatccatgtcgccaccgccacccgctcgccaccgcgacgactcgcaaggggaagcttcatgaactggatcgctggaatgggtttcacgcagaattccagcgagatgggcctattcacgttacattagctcgggtaaagaggaagcaaagcacaaatttaatggaccaggctcacggaagttgagctacttcttttcatagcaaattcaggttcttgattctggtatagcaatagagcatactgtccatgtccaaattaaattcttattcagattcagaatcagattcttgattctggtgaagtcatccacgaaaattaacattaacgtgccctgctgatgctgaggctacagaaattcctactctcccgcaccagcctcctcaacagccggctccacgcacgcctgtagctgtcgtcgcagttgccgccgccgccggcggcgtcgcgcgagaggaggtagaaccacgcggggctcctctgcaccgccgcccctgtgcgcacgccggaagtcatcagggcggcgccagaagctcctgcggcggggaagcggacgccggcagagaagggaacagaacaagagggggcgccggagagtattgccgccggcggaagggaacgtgatgcacaagcgccggcagcggaaggagtcgctctctccacctccgctcgaatgcgatggatgaggaagcggtggcagcgctgcttttcctgaaacatccgagcgatccacgacgagaaataaattaagtgccaaatttatcccaaatctatctcagaactttactaatctacccttaaaaataaacggttcagattagttctactcgtagtataatactaacagtagaaagcaccggagcattgctcctcaaagataggtttcaacaaaaaataatacaatctggtgttggaattggttggggaacttgggatgtccaaagtgcttgtagaaaccgactcgctggaggttcgaagatgatttctcaattagagttcaattgttcggtctacagtccgttggtatatgaatggaaagggatgctaaacaactttttggcggctaaggtggtttggtttcagcattcggcaaatacagtactagctcataggctaactaaagaaggtatctcggttcccccggattttatacgatcgttcgttgaggatgattgtaagcaggcttctttagatcatctaaaggatcagtatagttccactaaaaaacaaaaaataataatctcgtaatacaaaacagttatgtttatattttaattaagagaaaatatcttgtgtacccctgaaagttcacctaatcccttctgtacccctgaattttgctcaatcccttacatacccctgaattttagtttggatcccttccatgccctttccgctagttgaccgttagttgaccgttaaattcttatgaaaaagtccattttgcctttggtataaagaagcatatatataaattaatagagtatattgttgaagtatagaaatttgttatatgaaactattatgtttatgagatagttatgcaccatattatttgcgagaaatataattttagatatgacataaaaaattaatacttatttattagttattaaaatattttttagcatatgtattctgatagtaataaacaaatctgttgtattactatgaaaatacatatgctacgtaaaagaacttttaataactaataaataagtattaactttttatatcatatgtaaaagtaaatttgtcacaaataatatggtgcatcacatactcataaatataatagtctcatccaataaatttttacattccaacaatatacttaattaatttattatgttttttcatagcaaagggaaaaatggactttttcaaaagaatttaacggtcaactaacggtcaactagcggaaagggcatggaagggatccaaactaaaattcaggggtatgtaagggattgagcaaaattcatagaagggattaggtgaactttcatgggtacataggggattttctctttaattaacatgtactctctccgtaaaaaaaaatcatcccctcctaattaacaaatctggagattcattgtactaggagaggtgtctttttttcctgacggagggagtataagcgaaactgatgttcgaactagagacacatgtcagaggggtccagatcccctagagttgagtacaactccaccgggtgaattttactaaatctgtgacatctattgcttcctacggctgagatgaagccatctattcttcctatggtttgaatgggaattactttatttttttcatgttagtaatggttaagtttatgcctaccaaagtaacaaagtatacacgttatcttctttcccaaacacaagaagctacgttcatgtacagaaaaaaagtgttaattaaccacatggtacatgcaaacatacataaaccatatacatgcaaaaatagaggcacatgctcagtacggtctttataccatggatgaatcaaaaaatttgggttatgcaagtaaaatttatattctcagattctctaaatatatatattgtagtcggtgatttgttattgttacaagattatgaggacttatttttctttttcaaaaaagactagtgggaagtgggaactaatggcttcatcccaactgttgataaaaaaatagaccgtaaagattttatcaaattcacccgatggagttgtagtgaactccaggggatccggacaccatgtcagagccttcatatttttgaattttgtacagagcaacgatagtttgtttgtaacggttactgtatcaaatcgattttgagtctctagtgggccgtatcttttgtttgggctcgcacaactgggcctcctctctggagcccaaccgttcgttttccttggttagtgtaaatcatgggcacgtgtaattcattcgcacagagagagagagagagagagagagagagagttcatagctgccgggatggtcgccggcggcgactggagctcgccgcccgccgaacagccaaaatgttccccatttttccttcttcaggagccaatctgcttccaccatggcaacgcccttgaggtttccgtatgatttagctttcctactcctactttcgaggatcgccgggaaggtggaggagccgcgcgccctggtggtgcggtggcggtgtctacccctcgtcagcacgaggtgtttgtggaattgtccgtaagcgcgcggtctcttccccgcgaagcaaggatgtggatgttctttttggagaaaaaggatctggcccgccgccttttctgtgtgcatatgggacacgagcggaaggtgttcgtgcaaatgcggcagacagcacaggtaggcagttcttgctttggatgtggtgggatcggagtactggatttcacacaagtttgatgatgctgcacgattgcagtcaacaaggtcattttactagatctctgtcaacaatatgggaatacagagttctccctgtaactgaaatctagcggttaaagatgctgatgatcctaaaatcaagtcaaatgcggctgttgtatctactttctcaggtaacttcttccctcaaatgcatgaacatggaatctttcccatgaagttaacttaaaactatacgtgtctcccaaaaggcagcccctcccatggagatttaatatatacttataagtagttcaagcatgaactagcaggagtgcaagacattaattagtgggtgcattgttggcatcacctcaaagtgtcatttagcttaccactttttcaatcttcttattcctgctcctttttcttttatttttttttaaagacaaagacaatgggggcctggacctggatagtcttgaactcttgatggcaaggtttttcttttggtcctagttcatcaacacatcagtatatattttttcttgttgtgaacttgcgatgattgtgcgggcagttcagaccttcaagcagcctgtcatccatgtggcagataattggtgacctgctgagaagctgcaggcctgagaaatgaagcaacaaccagatatcagggaacaaactgaacaaacaaaattctttaacctgttccggtgggaaacaactaggattcatcatatcatatggcgttagttgagatatcaaggtcagagtgatcaaaattctatcaaataaattttattctacgtgtgttaacacatcacaagaagaaattggagctgctaattgatgtctgcatgtcgtttcagctggactggctccaaaactagttaattaaaataatccacaaggcaagttaattcacttaattcttcttctctctcgttttatacaagacctggaccttgatagtcttgatgccaggtctttgtttttttaggtcccccttcctcggatcaacacctcatctatataatgctgaaaccagcgttggctgaggtgagtggatcatcaaatatccttcatccttcctaagttgctgctgctagagtaaactgatcaaaggcttgtcaaagtaagttggagtggcaaaaagaagttgagctagctagaaattaaggcttgagttttcttttttgatccatatgtgatgatgtaatgtaatatgtagttatgcactgtcattcgtatacatataatacgtatctagctaggatatgatttacatgttctgtaatctgacaggaccttcttgttctgttcacacatgaatcatgatcgtggtatattggcatgcaggaaattaatcaggtatggttatagaggtgtgttgctgcctggggctggctgcgaatgtagcgcagctggctggcctggacgtcatcacgcttgtcaaggtaatcaagagtcgcgtcgagacagtccgccagaacaaggaggactgcgagctgctcgccgaacgcgcggacatgatccttgatctgctacggcgggttcaggcatccaaggtcatcgaggaccctgacatgtggaagcccacagaagggctcaagtcgacactttgcagggcaggtgcaatcgttaaatcctgtcaggaggagtggagctatgcgtaccgtttctgcaagggcggacgcatcgccagagagctgcgcaaggtactcaaggatctcaagttttacatcctccacctgataggaatgatcaccatcatcaaccacgatcaaaacactcgttactattatatcccggagactgatgttgttaagccgcaggtacgtacctgcatacctacaacatctcattaagagctaattctttttgctaattaatttctgtgcaaactgctaaaacctccatttcatgattctgaagtttgttctaacaatatgagaggtaatgtatgtaagtggacaaatgcctgcttaattactcacttgagcctaactttggtatttcaggatgctacagcttccaacgctggaaagcctgttgctctagaagaaacaggtaggagtaatagtgaatgatttataatattcccaaaattagcatgtaaaacaaggccttcttttccaattccctttgtaatgctgacacgaagtttgaaggtaataatcaattttccatgttacttaaaataacaggccttaaaaagttcactttgtctgagttggaggttgctacagataatttctctctggaaaaacaaatcggtataggtgctttcagcatcgtgtacaaggtaatgctttgctcttggccgacctttgcattcaacagaatggttaatgtttaggcagtgaagtcgtttgaaacatcttctcttgtactcagaaaaatattagattttgtttttttctgtaagtatcatgatcgatttgcatttggtgtttacttcttccagggccaactaaatgaaatgcccgaagttgctgtgaaaagagcatcgtatgttaacagaattccatttgaccagctcgaaaatgaggctaaaataatttcaaagcttcagcatacaaatatagttaaacttctaggatattgcagccaagagagagagaagatactggtcttcgagtatatgccaggcagaatcttagattcattcataactggtagggggttcaattcaactagctttatgcctttatctactcagtttcgagaccaaattctattgttcatgttcactcaatgatgcagtacatacatgtttgtcgcatttgattacaggtgagcgagcagaagagttgcctttggactggtctaagcgctcccaaatagttaaagggatagctgatggagctgtatatctacacaagcaatgtgagccacgtattattcatggcgatctgaaaccaggcaacatactcctggatgctgccttgaaacccaagatttgtgactttggtacatcgaaagcacttaggccaggtcaggatatggactgcaccggcattgtggtgggatcacggtaagactgagtttttcactgcaaaatgtttatccatccacctcctgcgtcacgtttgatctgttgataacttgatatttaaattttgttttcatcttctcagtggatatatggcccctgaatataaacagggagggtgtgtctctctcaagacagatgtgtacagctttggcgctacgcttctcgagatcattagaggaagtcgcatccctccgtctacattggagctttctgatgaatcgcgcgattttgggcctctaaataagtgggtaagtgcacacctctctgaacttcacaggccaaccacagtatactcagagttggtcactgattaaccagtagcaattttcctttgctcaggcgtgggaattgtggagaggaggaaacctgatggagttcatcgacccttcgctgcgcggagagactcattctgcagccgagatacaggggtgggttcagatagcgctgctgtgcgttcagcgtgttgaaattataagcacataatgatttaatttattccataaataaatcatgacattgcatatgtgaactagattgaacgcatcattagatctacacatgtaaactaagcagtaaaacatgaacagatcaaatatgcgcaacatgtcgaacgcgtaccgaggtggcggaaagaccggttgctcggcaggaactactcgcggttgcgagcgtcgacgaagtcgcgaagcacgcgagcggagaggaagacgagccggtgcaggatgtcgaaggcagaggttccggagacctgctctcccgatcgccggtgcacgggatggagtagtctacgagcgacggcgcagtacagagtaggaggcaaaccctagattgatgagccggtgcacgggatggagtagtctacgagcgacggcgcagtacagagtaggaggcaaactctagattgatttcgcgtgtgttgcgtgaaggcggcggctcggtttatatagagatatctgcgcaatgttgaggagccaattttgcggaccattcgacgcgtacgtcgtgcacgcgccgcctgccaggcgaggcgacgcgagcgagcgcgcacgtgtgtttcccctcttctctccaccacacatgcttcaagtggttaggagggcatcctcccttttaaggaggtccccctctcctagaataagcaaggtggtactaaactccacatgcatgccatcccatgaggtgggcttttgtgattttccaaagaattaatcttcgaatgggccttagcctatctattaattccaacaatcccccaccaaatctcaaaatcccaatgagatttgccttttctaatgtactgtttatataccagcggttcgatggagaccgattaaggttgaaca

SEQ ID NO: 13610 - DNA, 4884 bp, Oryza sativa
tcttcccaggttctaattcacgggatctccgatcacatagactgggttaccaccatggtataactcacatgggtctcaaacccatctccttcgatgcattatctatcacatttcgtgatagtcccttcgtgaagggatctgccaggtttctagctgtttggatgtaatccaacgttataacttcggagtttctcaatttcctgacagacttcaatcgtcttttcacatgtctagacgatttcatattatccttagaactattcactttgacaattaccgtttaattgtcacagttcataaggatagccggcaccgttttttcaacaataggcagatccattaatagatcacacagccattctgcctcaacagtagcagtatctagtgccgtcagttctgcttccatggttgaactcgtcaaaatggtctgtttgcaagacctccacgaaacagcaccaccacccaatgtgaagatatatccactagtggctttgatctcatccacattagagatccagttagaatcactataaccctccagtaccgcaggatacccaatatagtgaagccccaattccatagtacctttcagatagcgcattattcgctcaagcgcacgccagtgatcatctcccggattagaggtaaaccggctcaacttgctcacagcaaaggagatattaggcctagttgcactagccaggtacatcagcgagccaatgatttgggagtattccagttgattcctagcaattcttttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaagggttgtcccaaatatcagtatgtcgtcaacatacaagcacagaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaagctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggttcacacccatagggtcgctctgtcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaggacttagccgtcctttgtctcttactccttcgaggagcttcacagacatcctcctcagagacatgttcatgtgtatgttcaatttgttctggtggtgtgattgaactgggaattatttcagagggttggctcgaaccactatgtgtatccttcattgggaaaaagctctcaaagaaggtagcatcaagggactccataattgtaccaacatgcatgtcaggtacctcggatttaactattaaaaatctataggcaatgctgtgatgagcatatcccagaaagacacagtccacagtcttaggtccaagtttgcgcttctgcgttattggtacattgactttcgccaagcacccccatgtgcgcaaataagaaagtgatggttttctcccaatccatatctcatatggtgttttgtccttatttctgttaggaactctgtttaatacatgattcgaggtcaacaatgcctccccccaccatgccttaggtagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactcttcaccacgatcagacctaagcctttttatctttctgtcaagttaattttcaacttctgccttataaattttaaaatagtctagagcctcgtctttcgttttcaacaagtacacatagcaatatctagtagcatcatcaatcaacgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaaaccaaaattaatatgacataaacgtgagtgccaaacattagcctcattatccacactgccacaaatatggttcacagacttattgcagaaatcagaaagggaaaagcggaacaggcctccgcactcataacctttaccaataaaatatccatgtttacacacgactactttattagactcaaaaaccaacttaaatccgtctctagtcagacgggagccactaacatgattcctgtcgatagaagggacatgctgcacgttcttcagctgcacgatctttcccgaagtaaacttcagatctaccgtgccaacaccatgaacagaagcatgtgacccattccccattaggacagtggaaccccgtgcgacctgataagaagaaaacaatgagatgtcagcacaaacatgtacattggcctcagtatcaacccaccaattagtagactgattaactgaaaaaacagtaggtaaattaccatacccgcttccatctctagtgttgccaatggtcacattagcaaacttagaagtctgccctgcaggtgccttcatccccttgcgctgtggacacttcctagccagatgaccaggttgcccacacacaaagcaagtcctctcatcctggttaggattgttgttgttcttctctgcctcttgaagttggtggtctgttgagctttgtatttccccttgctcttgttctgggccttgtgcacaacattggcactggactgcccaccatcgccctcagacgcggcgtctttttcccgagctttctcctcaacatcaagggacgctatcaacccctcaacggggaattcatgtctcttgtgtttaagtgcagtaccaaaacttctccatgatggaggtagtttcgcaataatgcacccggccataaatttatcgggtaagacacacttaaggagttcgagttacttagccatggtttgtatctcatgagcctgttcgactacaaaatggttgtcagccatcttgtagtcatgaaactgctacatgatatactacgaactgcattgtgtgttccctcagtgtactacgagtagcgaaataacgagacttttgcgaatgcctcttccttgatggatcttagcagtgtataaagtacagctacagtgtttcagcaatggattagctagttgtcaaaaactatgatgtattgcataactgtgttgactattgttgacttgtgtatcgagggatagtagtagtagtatcaaacgatactgtagcaattggcatagtgggctagtgggcattgatatctgctggcccattcggttgacgggtgacttatttgggctggaccaagaactaccgttgactttggttgggccacatcttcagaggtcaaccacaagtgacctgtggcacatgcatccgtggcattgcattgcatacttatcctacaaatgcagcatgccagcatcattaaccaaaacaacgcggttcaagcaagtggatttgggaaggcaatactgaaacacaatgatactaatgataattgaggatttgaggtggccaaatgaagtacttccctgatttattttttcgcggagcttttctagcggagactttgcggagcccattttttggctgaattgcaaatcatatgcgtttgagaggattaggtagtaggagatcacaaggtttcattttcacttttgtttgctactccactatttgtcagaaaaattatactactcctgtactatttttctcgtttgccgtgtcaccgcgtgagttgcgcggggtggagtgtggagtcgacttgactcccaagtccacttccctccataaagcgagctcggagcgcagccacagcagtgtagagcgcaagcacagcgacggcgagcaaccgcggtgaccggagaagcgtactacgtgtataccggcgtcggtcgatcgacggcaatcggccggattccggtgtgattggctcaccggcgatatgcacacgaagcgtccgctgccggcacaggcgccaccagctgggcttgtcctggtgcccgcgcccaagcgcccgcatgtggatgctgctgccggcggcggcggcggcgtggcgtcgccgcgggggaagcggcagcttcgctccggcatgctcgtcctcttcttcgtcgcgcaagtgtatggcctcgatccattcgcctttggcttgatttctttatgggcgccaatatggactccggtccaatgaaaagtattcgaggtatcggttcctgaca

SEQ ID NO: 13611 - DNA, 3717 bp, Oryza sativa
gacttcgtcgagtggtgagcagagcagctctgcatctctccatccgtgatctgtctcaccaccacagcgtcgtcttgaatcgatctaaatcattttccccatcattttatactacgatctttttggtagctcattgcatagttatgtgtttgtctactgtagatacgtggagagaatgctatttcccagcaaagggcaatcgaaacatttgattgtgtctttcagaaagcatttgacaatgccttccagaagcatcttgatccaatttaccggtaagcaagattgatctctcactccctgcaacttggactgaagaattacatacttccattcatggactagtagagtggttaaatatgataacagattaacagttcacctgtcttcttgctcagataatatatctttccactcctttctaactttgttaaatccagaaaaccaaaaccaagagcacgcgcttgaaatttgatttaggatcctaatatagttatttttttatgatactccgttgtcttgtaactttttttttctagtaggtatgcaaatttcctgtttaattacactccttaaaaatttcatgcttaatactccttccggtaaaaaaaagcgtttaagacaagattaattcggtcaaacttttggagctttaaccatcatatttatattagaatatgtttaaaaaattcaataaattttatgatattacgatggtacttttcaagacgaatctatgcatactcttgaccatcattctcttgtttttaaaatgaacacttgagaagtagttaatggttacatttagaaatttgatcaaatcatgtcttaaatattaaatatttatgactagagggatacctctaaatcagacaaattgctccaaacatgggcaactactaatttgatcatttatagctcttctatgttgttatgttaacgttgagaagatgaaatattcatgttgttagaccatacatgagagaaatatgaactacgaaggtgctatgaaatatagtaaattgaatcaaacttattccattaatcttgaagtctccaattttgcgtgttcaccggtatcttatctttctatttgtaagagaatgatgaagttcgttatctatttaaactaacctttttttccacttctttggatttaaactaacccttttccttccacttctttggctgcagctcccttcaatcccttaacaagcgcactgatattctcagccatgaagtggttagatttcaaatgttccactgcttctttacagttcaacacttcaaacccttttctgataagggagtcccttttatcgagtttcattgcaagaagctacttggttgaatgcaactcaaactaaaaagttttatcctatttattttttctaaaaaaaacaaaaggtgtttgcctgacaaacttcaattcttagctcataatgattcttcacccaacgtgcaggaacaaatcaaacattcaaattctaaccatcatgctaatcagcaatacaggtatgatatttgaaattatcaaaaatatgcataaatgacttctattatttctagtaccaatgtttcactggttcttcatattgtttttcttttttcggcaaccagttcttatcaatcacttcaaatgacttgtgaactaccatgtatccatggtacactatctatttatggggcttgcctaaacaactttatgatgttcttttcatgctgttgtgagtctgtgacttgtgatgtactaaagttgtgatttttggaaaatcggaagtactgtcagatgttcaaatgacactagaattaatacacaggggtgtttcatactttttttaaaagagagaaaaagcttttcctcctatatgttgatagagaaggggtttcatactatttgtgtatgcattgtagatcaaaggcaaatcaagagtctgctgccatcactgaggaagtgaatcaagaacaaacagctgctagatttgtcgcgagtgaagctcaggaggggcaaagagttgagttgaggttcctcaataagttgaaccctcttgtttttacaaaggaaaaaattacagcggaggatggtacagctatcaaaattgccatagttagggataatcagataattacatctggtccactttcttctgcaagaattgaaattttggctctccatggtaacttttatgatgttgtccctgataattggaccgaatctgagtttgatcaccgcatagtaagtagttcacaaggtcccgcgttaggaggggtttgtcaagtcaagctgaagaatggggaggcctctccttctgatgtatttttcaatataccatcttcgaagactgaaagtggaaggctcattctagcagcaaaagttcatacaagtgacattggtgggcttcgaattaaggaagctgtgatgatgaatcctgttgtggtgcaggtttaccgaaacaaacgtaagttttccttcagaattgcaagctggttattctgtagtttgcatcattttttttggtcgggttagctgaaaaatcgaccaaccaaattgtattaagaagagagaaatgtgccagctacaaaacaacattatactgtcacagggcataagcccccctcccccctcccccccaaaaaaaaataaaaagagggaaaaaatacatatagtttgcatcatgtatttattatgtaagttttgtagtgtacattcatttttgatgtagaggccggtttaatctattattattatgtaagtattctccacatggcctgttaatacctcctagtgaccgtacaaaatctattctttcattggatttactttgaaattacatattgcataatcttcacgatatgatctattgtcatttactttgtttgcttttccccagtaaatagaagtagtgaccgtccgaagctaaaagatgaagtacatcgtttaaagggaatttcaggaaagggatgccgcaccaaatggcttaaagataatcaaatcaacactgtggaagagttcgtaaaggctttaaataaggatgaagaaaagatccgcaatgtaaggcctctgggattccaattctctctcatatgtgcacgaattaaatccatacagaaattctgtgtttatgttaattagagcctattattcatttcttcgtatatcagagcaaatttacctttcaatgccatgaaacagtacaagcataagtaaaagggtgtagctatatttatggcgccatatttttcatcaaaaaatagtcggcatgtatttacattgtaagtctctaaattacatatgtaattttagtgtatttacaatgtaagtctcaaaattacatatgtaagtactaaaattacatatgtaaattcgaaaattacatactaattacatatgtaagtggggtgtaaatgaggtgtaactactgtgtaagtggctgaaaaaaaatcgactgtagcatatggcgccatatttctagcaactccgtaagtaaaatattatttttgacaaacgaactataacatacgcattccttggagttcaggagtgtttcaagctaaagaaggataataagctttggaaagatacaattaaacatgctaaagagtgtgatcttgaagggaattgcaagctgaaattatatagagctgaagagcagcatgttgtactcttctttaactgcgtgcatgacctcgttggtgcgaaatttcgtgatcactatgttg

SEQ ID NO: 13612 - DNA, 14242 bp, Oryza sativa
ttcttttaaccagaactcacatttactaaactttgcatataatttatgcttccgaagtttctcgagtaccaactgcaagtgctccgcatgctcttcctcgtctttggagtagattaagatatcatcgatgaatactaccacaaatttgtccaagtaatccatgaacactttgttcataagattcataaagtatgccggggcgttggttaacccaaacgacattactgtgaactcatacaatccatagcgtgttgagaacgcggtcttgggtatatccccggtcctaattttcagttggtggtagcctgatcgaaggtaaatcttagagaacaccttagctcctttgagttgatcaaaaagatcatcaatccgtggtagtggatactttttgcctgttcaccttaagcctgaactttgaatattactttttgccctgttgttggtctgaggtgggggatgttacttgcctagcggaaagttgtctggtctattactgttaacaacggaattttgcatcaaattcagagaagaagaaggaagattgaaacagatttggtgttgaatcgagttggactcagtattggattgcgcatcggctggatactgtatcggctggaaatagaagttgaagactgaacaagttgagaagtctgatggccgatacggccgatacaacatgacttgggctcgacttgggcctagattgggataaacatcattgccagttagagatagagctcggataaggcaattgtatctattagttaggatattgagtaggtttgttagatatttggcaagagaccgtcgtatatggtcttgtttgtaccttaattttagaaaggtttgagtcgtgtccataatagactaagtttgtactcggggtataaatatgaaccccatagcattataatatgggggccaatccaatacaacttcggtgcatcgccacccttttacttttctcgtttttggcgagttcttcgcaagagataacccatctcaatggcccgttctatcgaggctaaaatgtcgctttagacgtgttaggctcgatatcgtgagtcattgcttcatatgttttagttaatctattattagcttctcaatttagctctatcggctgcttctcgctttaggatttatgctggttttggctaaattgtcttgctagattagattagctaaggcatctatcatcctgaaaagtgtttaattgcttgattatctagactgcatgtttcttttcatactttgagatgcatcatccctagtcgtgctttgaaccgtgcaaactagcctgcaattaggcataatgaggatagtatatcggggtttcagctgatcatacctaatatgcatgtttcaatacctgtttcatgtatattcgccacttatatagatagatcgttttatataagcatatcaagttttagtcagtatcagctagatccttgcaccctcatgccttatttctatttgatgtgtttatatggatcaatctatttagagtaaatttatatagatttgtactagagtattagctagtgcattatctctcttgctctaaacattgtcacatctattattttcataatattgtcttaaaccaatttattaaacttgatagatggtattacagccgattaggcatgtttagagcttaatattctttgatatactcaatccatagccgatttggtctgactccatcggctaagaccaccaacaatactctattggcatttcggccgatcggctatcggctgactgattctgcccttattttttcttgctgattgcaggatcaaatcagctagcacgccctggacacactcgaggctagccttggacctgcactggagttaagcagatctcccaggccgccgtgtttccacatcaatagttacggatgttcacctcgttgatttctctttaacagcactggttcgacaccactccgatgatactccctggtggctctccaaagtgtatgaaccaaaggaggatgcggagaaacttcggttccttgacgagctctggtcattgtgctcttctcgcataggaccgtgggtcctcgcatgcgatttcaatttaattattgaggctcaatacaagaacaggatgaacctcaattggcgcatgatgagccgcttccatctacttattgttgagttgggagtcaccgctccacggtcatcgtttcatttggagcaatgagcgtgattcccctacgctcgtcaagctcgactaagtctccttttttatcatcatttcttctatctctctttctcgtctctcgtccctcacgggcggcggcaggctcggcgggcgacgggcacggggcggccgacgacggctaaccccggccgagagcggcggcgggcagcggcagcgcggcctcatgctcccccggcggcgggttagggtttggagttcttttttgtgaggttttttagtgcaggcaacataagccacccgcacgcgagaaatagacccgcacgaaaaaaatcagatttttgcagacacttcggtgcagatgggcgggagatccgcacacgaaaaaaaatagaagtaactattcacagtattagaagtaactctttataatactagttgataccccgcgcattgctgcgggatagctatatcgtgaatttggaagatgtaattctagaacttttgactattggtatattatcattacacagaagggaacaaatagttgtaaatttatcaaaattgcatgatcaacatggttgaacgttcgatctttacattatattgctatatgaatagaaatgacatgattccaattgagatactcccaattcgaagaaccatgaacggtaagcaaagaggacactatttttattatgtactaaattgacttagcatctcattcagatattttaaacaactaataaaatatttctttttgcgagaaaacaaagagaaaatatggataaagctgcatgcatatgttggtatatgatcttaaaaaaaacaactattgggtgcatgaatctagtaatttcaagaaaaatgttcacctataagtaaatgggaggaactacggagaaacaaatttagtgattatcggtatgaaaagcacaaagatatggcatagccttttaatcaaatgtagatagtcaaatgtgagagtggaccaatccctcaatacttaaagttaccaaaaattgaagttaccatagttgtgttacattagcatatgaagcttggtgatgaacgaagaaatcagatataaaaagaagcaagatcatgatagagtaccaaaaaccaatcaccagaggagataaacatccttgcaattggtaaagatcatcgaatgttgtaatctgtacaaacaaatttctgatgtcatctatgacagtgacaaaccaaatttcattggaccattgacatttcctccttagatgattgaggaagcacgttcaagcataaatattccaagaaaatccattggatcaacctagatatggctagtagatgcattagaaaaattaaaaggaatgagaaagaggtacacacaaatatagtggtgtaggctttcgggtgggagatgtattagtggttagtgataaaggaagatataatgatgcatgaggtaattaagaggaagataaaaagcattggtcaagcattggtcctctcagatgccatcgaatgacaagaacttgatctaacggttgatttgcatagacgcgagatgatctaatggtcaatataatcttgatgatgtggcctcatagaatttgagctttatagcataaatgacttgtagtgggtaccaactatataggaagaaaggattagaagttgctacattcctataagaaagtaactgaaaaaatggaactagcattttatggtgttagaaataactgcactggtagagagaattaactcttcatcatagattttgaattaacaacactgctacacaagtaaatattctgaatatattcaatattggactcgttttgtcatatattttcagtagagtacgttggtttaatcagatcttaaaaacaatatattgtttaaaagatataagccatcaaaggttttaaaattactagtggaatgatgctcggctctgttagcatgtttactgtttactagtgcacacatcttttttttcaacgaagctacgtctgaggaagacatgatgctttatttttgtaagtacgtttgcgtatagctgtttaggcctgaagcgttaccacttgtagtcgcgtgtccttttccttaacaacttacagcactatattgcgtgagcagtcgcgactcgcgatcgatacttatctgtaccaattaatatatatatcgtcgcggttggttgccttccacgaaaatgcctggaaaactaccggaaggtgatgagaaaaacctaataaggttatgaatacgcggtttctcctcctttaaatccgcctgcttctcccctcggaagctaataatatatatatactcctatgttgcaacatcacttcaaacattattgatctctagagtaagtatgcgcgccctttcagatttgctttaagtattagtactacgttgtgctcgaacatgcaagatctcttccttaattaagtcattacatcctagcagattctacgtccatcggggcttgagaggacgattcatacataccggttcaaatcttccaaggtggagtaccttgcatgctttccctctttcaatttaagttgtctcatcatcttgccctaaaacgctttttgaatccgatggtctctcacttttcagttgggatcaaataattgtcgaattggataatcccatatgttttggtcagattttttattacccttttaactgatgaagggttttgttaaaaggttccgttatgtaggggttacatacatactttcctttcttaatttcatagactacaatcttttcttagcaaccacaaaatcttttccatcaactttattgacactagttacactttattggcaacaggattaggagatagaaaagtgattcagttttttttctatgctggttttccatgcatgatgattgggtttttagagttagcggtttttttagaggaaaaaggaggatgaatgcattaattagaaatcatgtcttactactcatgtttaaagtagatgtggcatatagatgagttaaatttacatatatatctcactttgattactttccatccttattattttatgctccgcatgcagacaaatggcttcagacgactaccgtctccaatttacttccaacctggagagtccccttttcaccggctgtcaaataaaactggaggttcggatgatcaactccgatggaaatgtgatcaaatccggtccactctcttcagcaaaaatcgagcttttggttctacgggacgatttcgcttgcgacgtcgttggtaactgcaccacggagcagttggacgaaaaggaagtgaagacccgagatggacatatttctgtattgaaaggagttgttgctcgcaggcttgtcgagggaacttgctccttccctggaatccagtttagggaagggagcttgagaagaaccttcaccattgcagcaagagttaataggaacgaggccactggaggccatcgggttcaagaagcattcatgggtcctgtcgttgtgcaaacaaaccgaaacaagcgtaagttttttgagaaattttacgattattgagaaagtatctctaggtaaaaatttttgatgtggaatatattgataattatatattaaatattataaaaataatggatagatatgttgatatattgtgaaaatgatgtgagctgtgttaattggatatacttacatgttgatttgtagaattcaataaattataaataatgttgcatgctcgtatgagatttgatatgtaattattcctagtgaataacgatgtggcatggtttgcatgttaagttttagattcagtgggttgtaactttatagaaagtatagatcatgggaacaccaatcttaaaaggtcactgcgtagcaaaagattccactgatccacgtgttattataagtttataactggtgttaaacacctttaattcttattatagtagtatatatatcttcagctacatattttttttcttgcagcaaatgcaaaaagtaacgccccaaaattcgatgatgagatatatagactgaagaaaattgcaaagaaaggaatatactacccgaagctccgatcatagaacatcacgactgtcgggcattttctaagggcttacaacaaaaatcctgaagagctcaatgatgtaaatatcccattttatgtttctctgcattcttatattatagtcggaatctaatgcatctactcttttaaagaaatgttagatctacaaccttttctacttatatatattgaaaaattttacagtttttaagaaagtgcctgctgatactaagattttacgctaaaaattttggtattaagttttacactagaaaatatgatgcctctcaataccttctcaaatatgataaaattatccatatatattacaaagaggacaagttttcctatgcggaagtatttttgtgctggtagtatatagacatcctcacataaaattattaattaatatgattaatattaaaccataatcaaaaagtaccccgtctccttcaatatagctttgcgaacaactaaaattccatgcttaattagaaaaagaaaaaaaaacttgttttcagataaccatgcgaataccctgtaggtcctatgtatatatttttgtcaatagagtaatttatacacttgttaattgttattcattggcatgaagttactaggtataaaggaagatcataaagactggaaaaccattatcgagcatgccagggagtgtgatctcaaagaaaatcattacctgaaagcatacaaggttgtaggtaaccaaattaatgatgtgatcttcttcaattgcgtacatgatattgtgggagcagaatttaatggcaagtacactgcaaaggagaatttcaatcgatatcaaaaggtttatgttaaactctaaatcttaccctacagttgctctggctacaattgcggttaactctgtcctgatgttatttggttgcaggccatagtagatagtcagagaaaggaagcatacaatgcattagagagcattccatttgactacataatgaatgaaaatggcgcccctactaaaatttcccctaatagaaatgtttctgaagacctatctttgtcaatgcaagacgcagcaccaccgccaaatccttctaatcacaatgcagcatatcaaggtcacaaagtgttttatcatagcttttttcttctatttacatcttaaaatagttttgacatttacaatttttttgtaacagtcaataattttatccccgggcttactcacgtctctcaaacatgtccttcacttgaaaactgcaacactgctgcacgtattccagttccaggaggtggcggatcaaatcctttgcttgctgactctgagaatgacctatctgtcagtgatggtaagctctcccataaactgctctttatacctgatttcttgacgggataaacccaaaaagtttatagaagtcactctcttaatttatcgcttaactcatattatataactataagcctaatatttttgagaatacaggtgttcatggggaaccatttgtaccaatgcaagaagcagaacaaccaccaaatcattctgattacaatgcagcgcatcaacaaggtcacagaatgttttatcgtatcttttctcttcattatctacgtcttgcaatagtttgacttttacaatgcattcatcccccatcctatataatatttctaaagaaattttacggtactttctacttgagaaagtacctaaaaattttgttacctgtaccaagatttacataccttctcaaagatagttaaattacccatgttactatgtacagcacccacaagcagtcaagaaccacttccacttgctgctgcgccaaacactagggagctgaatttctcaatgccactgaaattttactgttcttttgtttgctactcatcattccattaaaatcagtggcaaataataaatgactgtgtgaatttatcaagcagaggatgataaaagagaagatatgtatgacgccccacgataattagagaaaagaaaaggagaagaagataaaagctgctgagttagtgggcttgtgctgctttggtgggccaacctagctagcgtgcaggcagcaaggaaaaagtccaatttgactcccttaaatataggcaaaatctaattcgtacccctcaactggaaaaccgggtagaacgactcccctaactattgtaaccggtgcaatttgactccctcggcggtttcgggggcggttttgctgacgtggcgatgttgacccggttttcgtcccacgtggcgcttatgtggcattagaattaaaaaatatatgtgggtcccatctgtcattaaaaaaatttatattgtgggacccactgacatgtggggcccacatgtcatcctctcttctctaccttcttcatcctccccctctctttctcttcacgagagtgggacgagggccagcggcagcggcggcggtgggcgggagccggcggcggcggcggcggcgggaggacgggcgggcgagggccggagccaagccactgcgccgtcgacttcgcatcgtcctcctctccgtttcccctcaaaaatcccggagaatggcgcaccgaggagggagatcgacttcgtcttctccaactccggccgccggcgtaaatcttcgattcccgccgctccagtgagtctcgcgtcaattccttgcgcatgaaccaccctagggacctcactaataacatcagagcacatacatgtttattagatcggtggatcaagccgtcgccattcaccccggaggttcttgccgccgccaagcacgattccagcgacgagatggcgatggcgcgatggagaccggcccgccgtcactgccaacccgacccccgttcgtcgctgccgccaacccgacccccgtccgtcgccgccgccaatgcctatgtggcccctgctcctgtgaagacaaacgggggagaaagagatgagggagagagagggaggaggaagagctggccccgccgccgtccactccctcgaccgccgccgccgccctagtgtcgcctgcctgcctgccgccgcttgtctagctcccgtccctgcaaaccgatgaagggaagagatagagagagatgatgacatgtgggccccacatgtcagtgggtcccacaatatatttttttttctgtgaatgacagatgggtcccacatatattggtttaattcgaatgccacgtgggacgaagactgggtcaatttcgccacgtcagcgccacgtcagcaaaaccgctatccgaaaccgccgagggagtcaaattgcaccggttacaatagttgggggagtcgtcctacccggttttccagttgaggggtacgaattagattttacctatatttaagggagtcaaagtggactttttcccaggcagcaaacatcaattgcagcagcaggagcagtagtggtgcagcagcgggcattgggccttggcccatttcgcgagcagcagcagatcggcaacagccagcagcagaagtatattgtggcaaagtttagtaccacctcggtggtttgaggcgaggagtaatttataacggtgaatgcccgatcactagtacatcagatcaatttttttgacgaaaacaaaaagagtgttgcagtataggcatatatatggtccaagatttgataataaaatcttacagtaagttggctacagaattagaaagaacttatagggtacggtgcatttttggcggcaaatggtcctgtagagtggtaatgaacaaagatactaattgagaggtaaacgataatttataaagtacgtgcaaattcttgagcattgactcatagccatagggaagggacagagagtgactggagtttttgtttgttgttttcatttcaggattgtgtatggaagattcttggatttcagatagcaacttgcctttgttaagtaaaatttgtcctctttgtaatagctaataagtagtcctagtaattagttgttttcagtaactgagaattaatttagttatttcggtctatatcttaattagcatccagtatgcttcaagttcaatttatatcgcccgactcatttgcgtttaaatatttttttatgcatcaataatatctccacgtaatcttaaattcaacatgatttagtaagtgtagcctgctgagcccaaggttggcgcaccagcacagcttacgccgacgtcattttacgcagggaatttctaataaagcggcgatggcttcgtcagattgggagatgaatccacatgtacttcatccacacatggacatgccttttgtaatggataatggcatatcttttgaagaaggttggaatatgtatgaagcatcaacttctagccaagactggtgccctgatgaaatttacttactacccttgcccctaaagaagactggtcacggtcatggcccggcaaaaaggaacactggtcacaagccggtagacgcggacgagttctaattatgaatataagttagcaacgacttccttaatccagtaaaatggtgcagtataagttagctgtttatgacaaactgccccaatacagaacttttgagaaaaggtctggaggtcttcaggctagcaccagagatcagctagccagctcaagttcaagcctcgtttttctcaacaaattccgatatgagaacccctactttcatgttcagtgttttttcaatacataactcctaatatttgtgccataagtacataattaagctggtaatgcattctgttgtgtataattaattgttcatatacttggtgtgctttctccacgatttgcggtggagctcgatggcaatgttgacgatatatatataggacaccaaacaaatttaatatatatatatatatatatatatatatatatatatatatatatatatgtggaaccagacattctacatgtttccataattccattctccaactattatcatcttttgtttacctgtgtatgtcattttttataataaaaaaatcggtgtactagctggggctgtgctagtggctattggccccatcgtttggctttttccccaataaatcaaaacataaattattagggaataaaaataaatttgtagataaaacttttatatatgtgttcttggtgaattaaaagctaatattgaaaaagaaactacgttaaaaatatcacaaaatcaatttcaaaactaagtttgaaaatttaaaatttgcctttttttagctgattaggccatccgatgagagcctatgttgttcatatgtcgtcgtagccgatgtcgaatatatatgaggccgccggtggccggccgccatgacgcaggaggtaccacggtcggcgtgatcttcgcctcgaactccgtgcaggcggcggcgccgacgctgagaaccctcccgccggcatctgggccgcgcctccattctcccgcgcaagctcgctccggcgaactctgtgttcctcactagcagagaaaacaaagcaggagatcggagatagaggagcacacactgaatcacacgacaggtggacgtttcaaacaaatccgagcgtcacgatgaggccacgtcgcaacggaggccagagggatcgcgttatgggccccaccaccgggtcgacttggctccagtgtgggggcccagttgtgtgacgccgacaactaggcccaaacaaaggatgcggcccaccattaggttcaaaatcgattttgtcatcttagccaaaacaaaggctcggagggcctgtttggataggtgccacagtttgccgcgcctcaagttcggcgtgccacaggtagttagcatatgtttgtttgcttaccacacattagcctgccacaagaaattaggtgctcatgaactactttgccacaaatttcttagcctaagttgtggctctcaaatcattcgccaaacttgtggcacgagctagcttgtggcttggcaagttggagtagtcatccaaacaagccctgaatctctgatatggtgctctaattctgaatatcagtttggtttttatatgttagtaaaaaaaatataaatatgaatgcatagaattatgaaatagttattttttttgttggaaacctaactttgagatgatcaaattcaaatacggctaaacccaacgcacaacaattattatgcttataagcccaaatttgaatcaagagttggttttgtggttcttttatcattatttattttacataatttatttttgaattgctatggatacgcatataaaagtttacccacaaatcattttttttttgttgctaataagccactcaagatttgaagtacactttagttggtttccaagagacgaagttttgttgggtccgtcgaacggcgaacacggtagcacacatgctagcgcaggagggtgtttcttctagttgctttataacctgggtttctattcctccgagttttctccttatagagaaaatctaagaaattctatagacaagcactcaattccaaaaagaaattccatcgacgagtacgagttccatgaatgccattgtgcaagactttatcccagaaatatcatcgctactagggttttgttaatagccctccattaagtgctataggataaacaatgtatatacattaacgacgcgagatggatagaactctaatgacgatgttatttctagaaccaaatcgcttgtacaatagcattttatggaacttgcacttcatcgatgatatttcttggatttgggtgtttgtcaatagtatttcttagatttttctccttatgttacttttccttgatatttgtagtggaaaaaatccgtttacttaaaaaaaagataagtataagtataaatgaaatgatggggccacgtccagtgattcaggagatggtgatggaggcaaggcagccatgtgtagaaaagaacggaagaaatactttgtaatatgcttacagttgcttaaaaagttccagcgatgactaacaatttaatttatgaaaccattgtcagaaaattacagttcaaggtgtatatataaatatgctaatacacccgctgctcattagggtaaataacagggagaagataaatagccagcaagcgtactggctagaaacagatccttcagacttcagtaaaaacggtcctggatatgcagagcgacgagacttcagtaaaaacggtcctagagttgtgagcatgcgcccctgttctggttcagttaaatgatgtactgataaggatcaatgtcgttgtcaatcagttctgcaatattgctgccatcgctgccattctgtgacatattcatcagtccgatcaaggcattgcctccagaagaagtaccctacaaaaaaagaagactcgttagcatgcaatgagtgtgggcgtgataggagaaagatgcagaaatgcagtgatctcaataataagagacagacacagtctatcacgaatagattgatactgatggacccttggcgatgcaactgttttcttctctattcaatgaaaatggcacgatctcgtaccggttcgttaaaaaaataataatacttagagacagactcatattcatgggtatgccttacatatgttcaagctgtagaccttattggcatcaggaaaaataacttataacttatattgggatgaaaaagctagcaattggatgatttcaggagttatgttcaactagtagcatgacaaatcgacaataatttcatctctgttccagtaagaatgttacagttggctgtgtatgtctggtttcgatgtagaggctggcttttaatccattttctagaaagtgaggatgttacatactgagtggattgaacagaaacaacacttacttcagatgtctgaccaatatagcacccaatagggatgtcaacttcagaaaatccaccgtagatctgagccacagcacctgctcgataaccttcatctgaaatttttttacagacctcatcattatcaaaacaaaaatattcttcaaataaatcctgcagtatgcttctgttggaattaa

SEQ ID NO: 13613 - DNA, 5897 bp, Oryza sativa
tctaacttgatcaattagagtgggcttcgcttctaaggctgcaacgaaacctctaccgacaattcccaaatttaatctttcaaattccttgcctaattccaatggcaactgtcgtccttttgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtatatacctctgtacgagtaccgaaaagataatgacgccaaatcttcaacgcatgaactactgcagctaactcaagatcatgagtagggtagttcttttcatgcggacgtaactgtcgagatgcataggcaaccaccttcccatcttgcatcagaacacaacctaacccaagtttggatgcatcgcaatacacttggaaacccttctttggatcaggcaaagtcaaaataggagctgatactaagcgattcttcaactcttgaaaactctgctcacattcttccgaccacttgtacttcatatctttctgaagcagtcgtgtcatgggcttagcaatcttgaaaaaattctctataaaccttcgaacaacccatacctagtggtaaaagctgtcttaggtatatcctcctctttgattctcaactgatgataccctgatcgaagatctatcttggagaaaacagtggcacctttcagttgatcaaacaaatcatcaatcctgggtagtggatacttattcttaatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtctatcacacctttatgtctggctaaccagtccatccctaggatgacatcaaggtctttggattctaacaagataagattggccagaaatggtactcctttaatttctattctgacagaggggctacgttgcaaagagagtgcttgattacttggggtactaaccatcaaaggacgtctaagatcttccacttccatcccatgatttcccgcaaaactcatagataagaatgaatgtgtagcaccagaatcgaaaagcactgttgcaggaactgagttaacaaggaacgtacccaaaatcacatctggagcatcttgagcttctgcagcagcgacatgattgacacgggcctttgatgctggtacagcagagttactctgggcagggacaaccttcacgcgacggggcttcggacacttgtcagcataatgtcctgggtctccacagttgaaacacaccacgggcttgctgccttgctccctcttggcaggttgttgctgtactggagctgcaacaggacgtggagcttgattacggatgttgttgccagcattgttgttgaagaactgacgctgcggacgaacaacagacgaagaacctccctgtgacatgggctggggtcctaaagtaagacgcggcttctgattactcccctgttgtgccttgaagtgagcaatccgacgtttcctctgctccatgcaattgtacttgtcctcctgacgtatagccttatccactaatttctggaaatcaggataatctccaaccatgagtgggtaagaaagctcatcattaagtcctcccaaaaaacttctcctggcgctcttcatcattgcgcacatcttccggagcataacgagcaagacgattgaactcgtgcagttactccgtaactgagcgagatccctgagtaagcgacctgaactccttcttctcgagagacactactcctgatggtatatgcgtcttccggaaagcagcggtgaattcaagccaagtgataggttcagcagtaatcctattcaggcggaagtgatcccaccattcagaggcagggccatgcaactgatgtgatgcaaatgagaccttctcctgatcagtacactgaagcaaatccaacttcttctctatggcatgcagccaatcactagcttcaacaggattagtggtactagagaaaacaggcggcctcacacgaagaaattctgctaacttgttctggggaggtgcatgattatttccttggttttgctgattctgaaattgctgcatcatcatgttcataagctgtgtctgttgagcaagaacttgggccagagtgggattctctccattgttgttgttattggggttgttgggaccattcccattgctgcgagtgttcaccatctgacatggacagggcacaagaagagaaaccggggaaactacttaagatagagaattactttaacttttattgctcttaactgagtttcattattacaaactgaagactctcacaccactaaactctccaacttcctaacactcaaaaacaaacaaacgcatgcaattacatcccaccactgatgtaaatcacatgcgagccacacacaagcaaactttaagcaagcaaactaacacaacgatctaagacaacgacttaacaagtcactctagttcttccaagcatcgaaggtcgatggaaggctcattcgggtcgtcttcatcatcttgggttgcttcccactcaatcttggaattggtgcgcttgggttcttcttcttcatcactacttatgatgatgatcggaggatccacttgagctggggcaacttctttctccaccacacgaacctttggcgccagttgatagcgagggacaaataaagctctcttccttgcggtaagacgaatcctggccttctgcggcggtgcttctcccttcaatgcggctaattccttctccaaacgatccaccttgtcttctaacttgcaaatcttaccacgattccggtcttcacgatcttgagctgctagtacagtctccgcacgactttcatccatagcccacagcatctcaaccaaatgccttgtggtagcatcattctcaattccttcagtctcaagataactgccacggtcacttccctgtggttgacgaggatggtaacgatactcagtgtcggccaattgatcactgtagcgatcacggagctctcctatggcgatccttgccacctcctgacatgcatggatgtaatttcttcctccagcttcaaacatcactgaggggatatcttcactattactgttcaaagtgactttgactcggcacttttcttcatgacgatcatgaggaatctgggcataaaaaggggcagtcccgaatccaatgacaaaggacatcgtacgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcaaagtaaaaggtaagtaaataaagtaaaccaaacttgcaggataagttgaaacagttggaaacgaagttacaaattttgtaattttgaataactggtttcaaaagaaatgaaagaaaattataaaatcaacatgctaaatttattttattgcagcaagattaaataaaacaacattgtaaaacttttgctgataaaatgagccattagtacagtaatagatgtacagtactaataacactggaataaattttgaatgagaaccattaaaaaaaaattatgaagtgcatgtgccattagtttggtttaattaaaagagaaagggaggagaacagttctacttttccaatatttttagaaggcttctatgggtaaccatttggcataacctagggtcaagggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaaaatctaagcggaaaaaaaaaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttgataaaacagttaagtaattaaacaatattaatccaacgctatacaacataccctgttgtataggcccaaccattctgaacaaccatcccggctgcacagttctatctccaaaccaggaatgtaccattccaaaccaggagctaaacaaattattaccagtttaagcatcttttacaatgatgagaggtgtgagactaatcacgaaagacattgttagacccgcccataaccgcgggcacggctattcgaatagttttactctgatcagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctctgccacttctcagtctggtgccccgcaatgaaccatgctatacaaaagataaagccgttgcccatgctggcttgtggttggcacgataaatgtttcacaaccgaaactcgtgaaccggtccttaattgccatgagcacgaccatcaaaaccatgtgctcacaacccaccattactaggttttagttggcacattaattaattaactaatcacgattgaccatcgtgaactatcaataagccatcatgaaataatagtgagtcattagttatcccataaatgtactaatgtttctaagcatggctaagcaattatatctagtatctagttggaccaatataaataaagctcaactagtcaaattataataacccaaggtatcaaggaataaggtaatcaagtacgaaagggccataacaaaggataggtcaattccacccaatgacattcgaaaatagatgcaatagttgaatagaaacaatagctttaaataggatcaacatgctcaaagggttgtttgggatctgtgtgacttgccttgctggccttggaattcttcaaactcttcttctgcgaaaacggactctccggaaacgactaaatctaagcagaaaagagcaaaatcaccaaaacagcacataaacaagcatgaacagtacatgtggatatttttaatgtgtagatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggttttggtggaccgggcgcacgggcgggggttcacgcgaacggacgggcgagatctaa

SEQ ID NO: 13614 - DNA, 15379 bp, Oryza sativa
cggcgagaagagaagactccgggggtccttttaaaggggctcggaggcggcggcgaaggcccacggcgacggcaacggcgaaggaaactcgcggcttggagagaggaaagccgatccgattcgaactcgaatcaaactcattccaaaccgattgagccaaagattccaaaggagaaaaggtagaggagatcccggagattgtttcccctctaacaaatcggccggagaaggaaaggaacggccggattggaaggaaacagcggcggcggctcggcggcgccgcgctagggtttcggcccgaggaagacgacggctccgacaggcgggacccacctgtcagcgacagcgagggcgcgcgcgcgcggctgactgggccggctgggccgaggagagagaagagaggttttgggccgactttcggcccaaagccaaaagaagactttttaaaacctttttcaattaaaattatttcttaaatgcaattccatttattacaaatactttcttagctcaaataaatcccagaaaaatctaggaattatagaattaagcaaagtatttaatgaaattttatctggccccattttatattggaatttattaattaaacttagattttcttttcaagacttttaaaattatttctaaaaattccatttaaacaacaatttatatattttgaattttcagggtgtgacaaacctaccccccttaaacagaatctcgtcctcgagattcggaagaactggcgaacaggtgcggatgagctgacttcaattcatcttctcgttcccaagttgattcttcttccgagtgattactccactggactttgcaaaaacggataactcgattcctggttcttctctcacttgtttccaggatacggattggtttttcaacataggtcagatcctcttggacttctatctggtcaagattagcttcttcggtaggtacccttaaacactttttcaattgcgaaacatggaacacattatggactcctgccaaagattgaggtaactccaactgataagcgacctctcctcttctactgacaatcttataaggtcccacaaaacgcggtgccaattttcccttggtatgaaaacgatgaactcctcgaaaaggcgtgacacgaagatacacataatctccttcttcaaaactcaaatccctacggcgattgtcggcataactcttatgacgagactgagccacacgcaatctttcttgaatgatctttaccttttcttctgcttcccttaggatatccatcccgaaaacctgacgttctcccgtttgatcccacaaaagtggagtgcgacacttccgaccatacagtgcttcgtaaggagccatctgaagactagcttgataactgttgttgtatgaaaattctgcataaggtagattcttatcccaacttccaccgaaatctagagcacaagctctcaacatgtcttccaaaatctgattcaccctttcggtttgtccgtctgtctgcggatgataagcagtgctaaagttcagcttagaacccatctcttcctgaagtttcttccaaaaatttgaagtaaactgactgcctcgatcagacactatcttcttagggacgccatgcaaacacacaatccttgccatatacaattccgccaagcgacttccggaataggttgtctttaccggaataaaatgagccactttggtaagtctgtcgactatcacccaaatagaatcatggcctgatgacgttctgggtaaaccagtgataaaatccatacctatttcttcccatttccattcaggaatcttcaaaggctgcaacaaaccggcgggtttctgatgttctgccttgactcgctgacaaacatcacatactgctacatattctgcgatttcacgcttcatacttgcccaccaaaatctttccttgagatcctggtacatcttagtactaccagggtgaatggagtataaagtatcatgagcttctttcagaattgcatctttcaaatctttgttgtcagggacacaaattctttcacccaaccatacagttccttgctcatcctccaagaaaccaatagcttttcctcttctcatattcttcttgatctcttaaatatcaggatcattaatttgggcttctctaacttgatcaattagagtgggcttcgcttctaaggctgcaacgaaacctctaccgacaattcccaaatttaatctttcaaattccttgcataattccaatggcaactgtcgtccttttgtagcattgcaatagccttttctgctaagagcgtctgctacaacattagcctttcccggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccgggcgcacgggcggcggttcacgcgaacggacggccgagatctaaccgatccaagatggacggccgagatcgatcgggtccacagcggctcacggcggacgaccccgatgacgtcagcaatgacgtcaccgacagcggcggcggctcggcggagcggacggcgcacgctcgccggcgaacggcggcgcgagaacgcaaacggaaggcaccgggacgaagcgggcggcacggcgaactcaccgacgaccaaaacgacggcggagaagcaacggacggcgccggcgacgaggaggaaacggcggagttcttcggcttgacgacggcgatgatgctccggcggtctccgacgatggcgaagcggcggacgaggacggcgacgacttggcgaccacgatgacgtccttcccgagcgacggcgacggctgaaacgacggcggcacacggctggagcggcggcggcgacggcaaagctagggcacacggcgctagagctcttccggcgacgagaagcgaaggcgagggtggcggcgagaagagaagactccgggggtccttttaaaggggctcggaggcggcggcgaaggcccacggcgacggcaacggcgaaggaaactcgcggcttggagagaggaaagccgatccgattcgaactcgaatcaaactcattccaaaccgattgagccaaagattccaaaggagaaaaggtagaggagatcccggagattgtttcccctctaacaaatcggccggagaaggaaaggaacggccggattggaaggaaacagcggcggcggctcggcggcgccgcgctagggtttcggcccgaggaagacgacggctccgacaggcgggacccacctgtcagcgacagcgagggcgcgcgcgcgcggctgactgggccggctgggccgaggagagagaagagaggttttgggccgactttcggcccaaagccaaaagaagactttttaaaacctttttcaattaaaattatttcttaaatgcaattccatttattacaaatactttcttagctcaaataaatcccagaaaaatctaggaattatagaattaagcaaagtatttaatgaaattttatctggccccattttatattggaatttattaattaaacttagattttcttttcaagacttttaaaattatttctaaaaattccatttaaacaacaatttatatattttgaattttcagggtgtgacagccccacctgtcggcgaccccgagagaggaggcagcggggcggcctggctgccgggctgggcctcggcctgcggccggcccagcggagagggggggggaggaaaggagaaatgggccgacggcccatttgacaaaaaggaggaaaaagagaggaaaaagaaaaagaaaaaggaaaaaggattttccctggaataaaatattgcttgctcaattttaattggttaaaattatttctagagctctgaaaattccactaaaaatcctgttaatgaattttgacatgtagaactcaagaaaaattccacatgtcaagtccgattattatttgcattactttcttagggttttctcctgatttcacctgcattttcttggggtcatttgtaaattacaattttggcctgggaggaaaacttcggggtgtgacatcatccatggtcccagccgctcgcggccaaagcgcggacgctggtcgtgcgactgcaccagctcaccgccagctcgctctccttgaccgccaccaaggtcggtttccctccctccccaaaccgacatcgcctccactataaaacccaagccgcccccaaaccccttcctctctcgttttcgctcgcctcacactcaccgcgccattgttgacgccttgccgccactcccacctcttgccttcgtctcttcgccgtcgcacgcatcagaggccggtgcatgcgtggacgcgagacgaggactccggccatccctcttcttccccttccccggcccgaggccggagagctcgctcccgagccgtcggccgctcgtcactgcgcccgtcccggcttggtagtgccaccctccgttctcccttctcgctcgccctctccctccctagctcgcgtggtagctcggctagccccccgaacacgcatggacgccgccccaggtctcgccgccgcccgccataggcttgccgccgttgccgcccgctcccggaggccgccgccgtcgtcagccctcctcggcagtcctccgccccatccggtgccggaaatgagttccccgcgccccggagatgctccctcctccttgaatcgacctctcgtcgccccgccgcgatttccccttttgatcgccgccggccgccaccgtcgaaatccgtcgccatcgaatcccccccggcgaatccgagccggaggctcactccctcttatcctagccatcgttccggtgtgctccccttggccctagacctctgcatcaaactccggtgaactcggccaccgtccgccgtccatctcggcatccccccttcttcctcctctcgccgcccacgtggcctggcataggtgccacgtcggcttgacccagtcaagccggtcagccgctcgccctcgccccttcatccccgtgcgtgcggaccccggtgagccatgaggctgcacgtgggcccaccgcctccttgtcgaccggcgcaccgcatccgcacccaatccaccgatccgtctcgcccgtccccgcgtgcgccctccccaccatacacccgaccgctgccatgcgggcccatctcgggaccccgcgcggcggaccgcgcccaccccgttgggcctccctctctccccgcgccccctaatgggccgcctccccgtggccgcgctcggcccaatggccggccaagccttgtgaatccctcgggctgcgcctaagtcgcccgaggaagtctaaatccgatccctccttccttttcttttccaagggaattaataattccttttcctttagacagaaaatcaaataatccttagaaaatccatatcttctcaaccgctcacccgattgacttcgttcaacttccagtaattccgtaaaattgagatctatttaatggcactattatttagtctaaatagggtctttttcttggtcttttctttaggtttttgtttgtttgcgtaaagttgcggttatcggattttcgtcgatcgcgggttttctcgaagattcgtgaagctctgtgaagaccttgagcgaggcaagtcaccctttgaccaattgctcctataattggaaaatcattattattttgattgcagctcacattattagaatcacacacttaacatgcttggcctcggtttgcgtgccaaaccgacggacctacccagtagtcgcactaattcctgtaggtcgtattaccctgattccttgtcgctccacccttgtggtacttcggtatccgtgctctctgagcacttataccaactattccacatacaccgttgtttgtcgataatttgggaaatgggtttgagaagccttgaaaacccgacatgtggcgtcggtgtgtttgaaaaaactcgcgatgcgggggttgtgcctatgtggtactgtcctgtattcgcatataaggaccgattcctgtgggaaattcatctgagcatataataagtgcgaccacacgggtgcaatgggacgcccctggctgagtaattagctaatcgggggagccatgatgccaagagacatgtggattcaacggggtggtgtcagggagaaccctcgggcttcctggcacggtatggtctgggacctaacctggtgttggtctgggacccctctcgttggcatatggtaaacctgtgtcggctttcgaaatgccttgttatgaaagccttagggtctcccgacgtggctaatctcacgggctgggtgatccgggttagtaatgtcgtgtgggtaaagtgtaccccctctgcagaggttaactaactgttcgaacagccgtgcccgcggtcatgggcggatgtgaggtgtttcctgtagcgtagatttgtttgcctgtgctttgtgaaaagttgttgtggtgtgggaattgttaccagaatcagcctatgtggcagatggatgacctgagtggtcaagaaatgaatctgtgtgattcgggatgtctaccggcatcatagactaggcttcccgagtggaagcggattgttgtgctgctgggcagctagactctgtgagtccgagaaaatgtaaaaggctctgggagccgattaatcaagtggaatggctctaggagccgagaagtaatgatctgacccgggaggtcggtacattaccaaatgagctgttgaaaaacatctcttaaggtcgaatcgagacgcaagtctcttttcgacccaaacttagaaagaaataaatcactttgtgatttcaaaatgatttcaaaacaaaagatttgcaaaaacaaccttgcctctcttccaagcttgcattaaacacctaaattcccgtgacttgctgagtatgaaagtactcacccttgctctatataaatatatgtagttcctccgcccggaagttgaagatgaagtaaagtgaagattagggtttcgtccaggttcccagccgtcacctgtggtgttgggtgttagtccgttggttctgctgctgctgctgttgttggtgtttcctcgtccacgtcgtcggttgcaatctcgggctgttctgagctgcaacctaagttaaggtaaataagtcctctatttattttaaggattgcaatgattcatatttgtcaccgtgggtaccagcgctatgtcctgggactggtactgagatcgcggtttcgtaggaagcggttcgcgccgtttttcccacgacacgctcctgtcaggtgccgttgtacggcggtgccagattggggtgtgacaagcaagctatgctgacggcggattatagcgacgctttcggattaaggcagagcagggcggcggattcgagcagtggggtgtggtggcggaatcaagcggctattcgggcagcgaaggaagaatcaagcagagagatggtggcactcgcctttacaagccaaacgagccgaggggcaaaatggtactttcaatgtcctttctctctccatcttgacctgatataataaaataatacgagcagtgtccaacagctaattaccacattttaacggtgtccacaaaaagatacatgttctttgggtgtctcacagcaaatgctgcaaattttcagtcctgtagcaaattttgcactactactatagaggtaagaggtatactagtcatcctaactgttgattattcatgatttattatattgaataaaaaaactatgtgctcctttcattaatatttcacatcccaaattaaatgcaaaaattatcattaaaaaaattaacgttgcatgcaagggcaacataccaaagaggcacctaatattttgggggtcctacatattaatgaaagggcctactccctccgtcccaaaaaaaggcaaaccctgggtttccgtgtccaactttgactgtccgtcttatatgaaatttttttataattcgtattttcattgttgttagatgataaaacatgattaatattttatgcgtgacttgtctttttaatttttttcataaatttttcaaataagacggacggtcaaatgttaggcacggaaaccagggtttgtctttttttggacggagggagtacattgcatgtaagagagagagagagagagattagttgggagtccaggagctttacagtgcagatcttttcttcatccttgtttaaagcctttttgaagtctgccacggtatggatgccattattttgagtaaagtccatcaccggtccctaaacttgtactgttgtgtcatcacggtccctaaactcgcaaatcgaccgttcaggtcctcaaatttgttcgactgtgccatcccagtccctaaacttgcagatcactcgtttaggtcctccaacttgttcaattgtgtcacccggtccctaaacaggacggtctaaaaactttatatcaaaaaataatttataactttgtcatgcgaactctaatgaagacaaactttatatcaaaattgtagccctcgacacgacctataactttgtagttgaaaagtttttgaattaaaactgttcagggtcccaaaatattgttgcatgtttatagattttgaaattttaattttaaaattacattttgggacaaaaaatgacttagaataaaaaaaattcaactaaaaagttgtagatcgcgtcgagggctacaagtttgatataaggtttgtcttcattagagttcacatgaaaaagttatgaattatttttaaatataaagtctttagaccgtcctatttgacccagatgatattcaaatccaagtttagggaccggggtgacacaactaaataagttggaggacctaaacgagtgatatgcaagtttagggaccgggatgacacagtcgaacaagtttgaggatctgaacgatcaatttgcgagtttagggaccgggatgatacagcggtacaagttcagggaccggtgatggactttactccattatttttaagccatttagcacgctctcccttccctgaaattccctttaaacgatgcacttcatctttcagctttggacagttactctttttgtttgctggacaaaaaggaaacaagagagataaatgccaacagaacatacaaatccagttgattcgagtatgcaacctgtaatttcaaagataatcctacgaaggaagactttttatatagtcattggcacttgggaggtaccgagaaacaatgtggagaatacttgcaaaatagaaacatcaggcaaacaatctactgaatacaccagctgcaattctgaagaaaaacttacatttgtttcgattaacctgcacctcaacaggctgattcatcacggcttccttaatctgaagcccagctttgtcactgctaagaacccttgctgccagaatgagctttttacttccagtcttcgaagatggcatattgaaagagacgtcagatagggaggcctccccattcttaagcttcactcgaagaacacctcctaacaccgccccttttgaactacttactatgtgggcgtcaaactcacatgcagtccagttatcaggggcagcatcataaaacttatcatgaagaaccaaaatttcaattcttaatccactaagactctcgcgtcgtcctcccctggggcggcacgggaggcgacgacccggccgcccctctccctcccctccttcccctccgcctcgccgccgctcgagcggccgccggcaaagccggccggccgcaaggacggcggcggcggggcccctcgccgacctttcaccgggcgggcaggggagccgccaggcgggacggcggtgaccgccagatccaggccgctccggccggatctggcggggcggcgactggcggcggggaggacggcggccacggcggcggggatggcgacggcgaaggcaggggcgcgcggcgccgggcggcggcggggatggcgatggtagcggggaaggaaccggccgcgggcacgaagatggtggtggtggtcccgtgtgagcttgtggtggcgacggcgcggtgctcctcggcggcggcggcggcggtgtcccccagatccgcgcctctcggccggatctggagggtggccggcggcagttggcggcggctgtgcggcgacgacggcggcggtgcggcggcggtgcggcgacggcagcagcggcagttggcgacggcgacggcggtcgcggtagttggcagctgcggtgtcggctggcgatggcggcagtggcacacatggcatcgggcggcagccagccgtatgctggtgaagggtgacggcacagcggcaggttgcggatgcgggggctggagtcggtggcagcggcgacggcggctgtttgtggaggcggtggtgacatcagcggcgaggcgaggatggcgacggcgaggtagctgggcgttaggcagcagcggctgcagtggtggtgaccgtgtctacagtcactggaggcatggcggcctcaaacggctagctgagggcgtgggaggcgactacatctggccggcgcggcatcgtttggtggaggggtcggagaccggcttggcgcagagaagcgcagccgatgacagcggaggccggctcggcgcgagaggcgcgggcggcggagatggaggccggcttggcgcgggaggtgcggccgatggagggagaccggattggcgcgaggcgcgtccggtggaggaggccggcttggcgcagagtggcgcggccggcggtggaggaggcgacctaggggtgaggaggagctgccggtgggtgtggcgcggtcttcagcgctcgaagactggccggcgggggacgccggtgcaggggtcccacatgtcggcaaagcttgtgtggtggtggagcatcggtgcgtcaggcgtggtttcgcaagtggcgagcggcgggtgaaaacccagtccggccttggtcggaccgacaacgatggttatcccccctcctgagagcgttgtcgtgctgtctcacccctctggtgaccttgtctgtgtccctttgttggcctagtggcggtcggtcacgcttagcggcggccggtccagtgttagccttctcctgggcttgtgtgatggcgttgtcgccgtgtgggtggtggtttattttttcctttttcctggttacgactctccagggttgtaaccttgtaattttttcctgctctatcaatagaacttcgcaccgtctcgtgcgagtcgttcaaaaaaaaaatttcaattcttgctgaagaaagttggccggcagtaactatcttattatccctaaatatggcaattttgatagctgtaccatcctctgctgtaattttgtcatttgtataaacaagatggtctttcagcttattgaggaacctcaactcaactccttgatcctcgtgaacttcatttgcggcaaatctgagagctgtttgttcttgattcacttcctcagtgacagcagcattctcttgatttacctctgatctacaatacagacataaatagtatgaaacaccattgtgtattaactatagtctcatactaacatctggcagtactttaaattgtctgaaattcacaactgtaatacacaacatcatgaaacgaacatcactataaatatatagtgccatcaatacacagttgacagtaattcagaagtcacttcaagtgattgataagaactgatcagcacaataggaagaacctaagtgtgtgtgagacattgatatgtaagattgcatactggaaataacagaagtcagagatgcatattctcaatagttacaaagaccatacctgtagcgctcattagcatcacggttagaaattaacttttttatttgtccctgcaagtttgtctcaggcaaacatttttttttcatcataataaaatgtaagcaaacactttgcagttttaattttactcgaccaagtaacttcctgataaaacacaataaaagaagctctctcatcagaaaggggttaattaaactagtataaagtagtgtccttgtaataaagtatccgaaatctaaccacttcatggctgacagtatcaattcgctcagaaagagtcccagtctgcttggtaaggtgttgaagagagctgcaatcaaagaagtggaagaaaaaaggctagtttattttttattaaaaaatcatatttctaggacatagagaaagatataagatattgattaatacataaaactggacaatttaagatcaatgcaataagtgtgatttaatttcgtagcatctgcatagatcagatttgttgcatgtgttatatcagcattaaagtttgatcagcttgacagttaacataaaaacatcatagaggaactgtaaatgatgaaatcattagttgtccaaacaagtattttagaggtattaaacagggaatttacacgttcgatgcttactaaaaaaactgcaaatgagcaatctcaacaaaaaaaaaaaaggatttatctaagcaactagctagagaggtaaatttgtggtcctactcctatttgaccactctgctagttcaaggatcgattttataacttcttcaactccaattctactttcaccccgactgagagatcttaccaatagataggattaagatgtttctgaagggcattatcaaatgctttcataatgcctctctgaaaggcatcatcctcgggtgcctttctctgtgaagtagaactctcttcatgtatctacacaattaatcacaggacactgaaatgaactaccaaaagagtagcaaaaatgatgggagaaaagatttagtttgattcagttccagaacgagagatcgatgcagagctgctcaccgccactcgagcagggcgcgcgttgttcttgttcttgttcctccgctcttccttcctgcgcatccgcaaagcacgcgggtgatcagacaacgagcttcccacggaggaattaaatcaaacaggaggcgtgcgagccggcgtgcgtacacttgcgcggcggacacgaagaagagcacgagcatgccccgccggagctgccgcttcaccggagacgacgtcggcgcctgttgcgcgaacgcctcggcgccgctccggaacgcgtcgatctgcaggcgcttcggcggcggcgcgccgtgcgccggtgccggcggcggcgcacgtttcgggttcatgccgtcggctcgtcgctcgccggccgcgcgcgccacctgaaaccgggatggatggatggatggatggattgtcgccgatgccgcagagctctcgttactcctccccgacgacggtaggtagcttcgtcgtcgcttctccggtcgtcgtcgagcgctcgctgtgccgccccggcccctccactccacttcgacgacgagcttttatggtggtcgtgtcgtcgagcggcgagtggagtggactcggccgagcacgaagtcttgctcacgcggttagtgagaaaaataaactggaacatgcatggatttggatttggattattacaagagcaagcagatacaataacaagctatagctagctataaacatatacatatgtccagtagataaaataggagatagagaagcaacgggctatatatttgtagccagctgtagcacggacttcaagatataatgtgtgtatggcaggtgaggaacatgtattaatagtgtagtatatgtttatagatatctgatgtatgaattgactataaatgatttagagcaagtaattagctatactattaaacttgctcaagtgaattaacgcacactcaattgtttctcacttcctaaatactctctccacgtattgtaagtcgtttttacttttttttcctagtcattattttttagtttgaatattttactatatttgtatataagatttggccaaacctaaaataacttaactagaaaataagtcaaaataacttataatatgaaatgtcacaaactatgaaaggaattcaaatcttgcaaaatttcaagtccagaatcaatctacacagcatcaagaaaagaaacacagagacaaatctggtcataaaagggtgtttacactaatttccagccaaattttgttttaaattatgtaaattaaagttaatatcacataactttacatataaagtcacatttttcataaaatttcatgatcatgcatgattcatgcaaatgatatgcaagagatgagtgcatgtgtatctaggttgtaaattgacatcccccagtaacatctattccttcgttcaattactagatcaatattttacaatttaatacatccgtcccccaaaatctcattttggctatttatctctttgttctttaggatgaaacagctaactttgaacttgaaattaaataattgcactttgatagattagaaactgtacaaatataattaaaggtacatgcgcattatcacctgtccatccgaacgcagccatatacattattatatgcaagttttggtgactgaatgacaagagagcaaacagcaaataaaagtgaaaaacgagaaccttcgtacgtaaccacatatcctttggaaacgcatggtttgcagtagatttcccccaaaattaaacgggctccacaaagtcgtatgccagaaaagctccggaaaattcaggcaatagtcccggcctgttctcctcgccggttggttgctagaattccctcttgcttcttgcatttgccaagttcaattaaaatgtcttggcatcacctcccaaattcaacggacagaaatcaactggctgaaaccgcgtggatttggaccccagtataaatccaggctgcatttgatttaaacactactttacagtgccagagttcatgaaggtgcctatgcatcagaaatatttatatagtactatttgtttgccaaagcatgcaggtgcagccgtgcaggaggtagacttcaataattgttcactcatgtgttggttttgctttgatgtggccgaattgttttgctaactttgagagaattttgtaataagtggttgtattttttttagagtaaagtctgggatttatttttattattttaaaaaatgcaggtgcagcaggtctcggttgatttgtggtgcttgacctgaaagtgtggcccaacaaaggtcaacgggagttcttgaatgggctgtacatatcaaggcccattatgccaactgctacagtaccgtctgatgtaactcaataagtcaaacagtagtcaacacagctctgcagaaatcgcagttttgacaaatcgcaaatacttctgcagcagtctcgttatttaggtacacttgatg

SEQ ID NO: 13615 - DNA, 6500 bp, Oryza sativa
  unsure (1)..(6500): unsure at all n locations
tgaacccatctctttatctcagaagcatgattctcatcggccagcgacggatcgatcaattccatcaggtttccgtctttccacaagttccacgcctgagtagaaaaaatgctactggttaatcagtgatcaactctgaataatgtgtcaggcttgcatacccttcaagtcctcttcaggagtagcactcggaaaggttcacgtacccacttatttagaggcccgtagttgtgagattcatcagaaagcgccagtgaagatggagagatgtgttttcctctaatgatctgaagaagcgtagcgccaaagctatacacatctgtctggagagagagacagcctccctgtttatattcaggggccataaacccactgaaaaagatgaaaaattaatcaatcacaactaaaagcagatcaaacggggttaaatattagagtattttaaggtcctagacgatgtactacatttttttctagtgaattttgccttttggtaacacctcagtattaatgtacaaagaaggaccacaaattaacactaaaacctatggcacctactcgaggactgtaaaaccactccaaagtataaccattgaagattgtgctgtacaaaaccgccttaccgtgagcccaccacgacgccagtgcagtctttatccgcatctgccttaagtgcttttgaaatgccgaagtcacaaatcttcggtttcagagaagcatccaggagtatgttgcctggtttcaaatccccgtgaataatacgtggttcgcatagcttgtgtagatatacagctccctgagctatccctctaactatttgggagcgcttaggccaatccaatggttcttttgttgctcgttcacctgtaaatgcgagaagcaaatatggatataagtgaatatgaataggagggtagtacatcaatatcaacaggataatttggtctcaaaactgagattgatagtgctaattgaactgaaccctaccagttatgaatgaatccaagcttctgttaggcatatattcgaagaccagtatcctctccctctttctcgtgcaatatcctagaagtttaactatatttgtatgctggagctttgggattagatcaagctcattctcaagctggtgaaatggaattttgtcaacatatgatgctcttttcacggcaacttcaagtccttcatttagtcgcccctaggagtaaacgccaaatacaagtcaataatggtaaaattcatcatagaaagagaatctaatatcttagtacaagagaagatgtttcaaacaacttcgctaaatcattttgctgaatgcagaagccagcaaagagcaaagcatatgcaaatccttacctggtaaacaatgctgaaagcacctacaccgatttggttttccagagagaagttgtctgtagcaacctccaattgagagaaagcgaaccttttaaggcctgtcatttagacaaacatgtatcatttagtatttggaaacttcccttggcattacaaatggaattgccgaattggaaacgcagtcatgattttacactactaagttttggattattgatcattcatcattacctatttctttttgggcaacaagcatgccactattggaagaggtagcaatgctcttccagggatgccaccaacagcatcttgataacttcttttctgctgatgtttcttcaacaatattatgtaggactgtagaaaacggtgattcaagtttactgtgctaaatgcatcaatattttaagaacatagaatagcactcaagaaaagaaagttttttgttcatttagcctgttttcgtttgtgaaaataacccttgctgggaaattttgcagaaatatatgaattcatatgaaataggattaccagaaaccgaggtttatttcttcgttttttcccatggaggataattttaggatcatgacaaaaaaagggcaaatgaaaattatagaaatcaagaaaagcacctacaggtacttatccatgatatgtagattggcccataaaaatgaagtacctggctcgttaacagaggaaggctctgttaccagttgagctttccctgaaatacccagtgtttctcccctatcattgctgcatgcattggggggaaaaaaaactaaaaaaaaaataaaattcaaatataatagcataattaacttttgagattttttcaaaaatgtacatccataacctaatatcaagccattagatacacatacatactgtgatcagtatctcaccggtcattatatttgaagtgttgagcaggcaaccctagagcaggtacttgtacgccatcctgaaataacaacttaagttaggctcaaccgattaagcaggcatttatcagaacacatacacttcctctcatattgttggaacaaacttcagaatcacaaaacggatagattgtttgaattatcctattttaggcatttggcagttgcacgttagagtgtatttttagggaatgcacaaaagatttgtgttgcacagtacactgtaatttagcaaatgaagctcgatcttagctgttgtagacttgaagtaacagtgtagcatggatgtacctgcagctgaacaacatctggagtctgctggaccagaaagtaacgtgtggtttgatcaccattgatgatgggtaacacaaaatttcagagccttgagcaccttgcgcaactctttggcggtatggtcgctcttgcagaagcggtacgtgcagctcctctcccgacagaattcgatgacctcgcatgccctacgaagagttgacctgagcctctctgttggtttccacatgtcagggtcctctatgaccttggatttctgcaaccgaccgagcagatcaaggatcaattccgcacgttcggcgagcagctcacagtcctccttgttctggctcactgtctggacacgctccttgatttcctttaccagactggccacgtccaggccagccagctgcgctacattcgcagcaaaccccaggcagcaacacacctctataatcatatctgattgattccctgcatgccatgacatgtgtagacagaggaaggtgcatgtcagaacagaacttgtaaatcctttctaaacaagaacatgtacatatatgcagcacaatatatactaaatgatcatatggatcagaaagaaaactcaagcatgcatgccattaaataattagcaggagatagctagcttcttaatttcacttttcccccaactctagcttactttgacagaccttcaaatcagcttgcgcagtcaggaattcagcaaggatgaggagatatctgatgatgcaccttaccccagcctactccggttgcagcattatatatatgaggtgaaagaggaagggcctaaaatacaaacacctgggcatcaagactatcaaggtccaggtcttgttgtaaaacagagagcacttgagtgaattaactggtggattcttttaaatagttttggagccaatccatccaaactacctgctcaatcatcacgattcgcgacaagacaattatatatatgaggtggtgatgaataagaaaccaataaaatcttgccatcaagactattcaggtccaggcccccattgtctttttcttacttttttttttaaacgatatcttacttttcaaaaagaaagaaaaagtagcagaaacaagaagattgaaaatgaagtaagaaagtagctaaatccaatttttaactgatgccaacaatgcgcccactaattaatgtcttccactcctcctagctcatacttcaactatttaagtgcttaaaacgtgatgcttctgcatagtactcctatatagcaaatctccgtgagaggggctgcctttcgggagacacgtagctttaacttcatggacaagattccatgttcatgcatttgagggaaggagttacctcatcaaagagtactacaacagccgcttctgattcacttttagggcatccacaatgtgagccactcctagagtgttctcactaactgaggcactctagggaaactcagctcgcaatggaggatacccttggatgggctcctcaaaatctaaagcaacttaatagagacactccaacccacaatgagtatcccagcccacaaaaccccatatttatttttactaaactaccccctaatctctctctctcccgcggtcctgccccctcactctttctttcgccgccttggctcctccacaaaggcgacgccggtcgtgtcgagcgcgaggcgtgtcgccggcggttcccgccgccgcggccttccccctcgccctccccagccgccgcggcgcctccctcctcaccccctctagcagctgccttcctcctccctccgccagccgcgtcccgccgtcgtcaccgaagtggttccagcgtcggttgccagtgtcggcggcagctggaggaggcagatccggctgcgagggcgggcagatatggtgagctggcgtggtggcgtcnaggtggcagacgcggaagccgaccccgtcgccggctggtggtcatcgccagtcctcgtcgtcgtctccgtcgcggaagccgagcccgtcgccagctggtggccggagctggtcgtcaccgtcgtggatcctcgtcgccgtcgcctctctctcttctctctctctcgtcgccatgccgccggtgaggggcaagaaggggaaacaccaggagagaaggtagggatggggcaccgggtcgccgcaacacgtagcttcaagggagtgtctctggaaaaagcgagctggggagctagaggggttccccgcgtgggggtcgcgcctccctccagagacacgctgcgcggacggacggcggacggtgtgagcggggggacgacccagggacaccgattgtggatggccttaggctcagcatcttgaactgctaaaatttcggtgataaggagaactcagtatcccgatattgttgagacaaaaatccagtgaaatgaccttgttgactgcaatcgtgcggcatcagcaaacttgtaaaacgccagtactctgatcccaacacatccaaaacaagaactgtctgcctgtgctgtctgccgcatttgcacgaacaccttctgctcgtgtcccatatgcacacggaaaaggcgatgggccagatcctttttctgcaaaaagaacatccacatccttgcttcgcggggaagagaccgcgcgcttacggacaattccacgaacgcctcgtgctgacgaggggtagacaccgtcaccgcaccaccagggcgatcggctcctccctgccgcctccgcctcgccgccgcgcccgaaagacctgcgccatggctggttggtagtaggagacccgaggccaaagcctggcggcggcggcggcggccggctggaacgctcgccgagtctcaccgacgcgatcgaggaggtgaagcggacaagcggtgcttcgggttcagctacgacgagagaaagaagcccagtagcccacacaaagttaacgtgctagaggagcaaatccgttaccaaacatgaataccaccaggcccaacaacgtggacatatcttttttgcagagaagggtattttttttcccagactcaatattcaatcggatatgtacagccattttaaattaggaacttaacttatcaaacagggaacttagccctcaaataacccaatctaaaattcgctcctatgaagatttgaactcaggaccttggggtgctactcaggtcacttctgcaagcagtaggctacatgcccttttaggacacggacatatctagaagcacatctaacagccagaaaaaaaaagaatcgaacggtcagataaaacatgaagcaaatccaacggtcagaagaagatgtttaccacattgttaattttcattgttacctttcaacacaattggtagtgtttacgacattgcagaagttgagtttcaatttttttttcgtgaattggtagtgcttctttccattgttactataaacaacaatataagattatgtactccattggatatgttgcgatgccgtgaacatgcacgctaactagtaaataatagtactagaaggagttctgaaaccgtagtgtgatacaacagttgaattatgtaacataacagtcgatgtttttttttctgaaacataagtactagtacagttcaattttctgcatcaacaaatgctaatacatacagcaagaatatttcttgaaagtaatacatccatcaagaataaaacaataaaatatccattatctaaataaagaatgaaattaatcagaaatcatgatagattactagccggcaacaaagccttcagttaaactggtcctggatatgcagagctatgaggcctctcattctggttctcattgtccggaaagatgtatgcataacagtcaaacatgtccatagagccgtcaccaataacattctgcggtacatttgctggtccgatcatgttgttgcctccataagaggt

SEQ ID NO: 13616 - DNA, 629 bp, Oryza sativa
ctgaagggtcgatcgacctcatgcctcttccccttccaatcgatctcatctcgacgcctcccgctcccggtaacggcgccggcgagccaacgacagggatcccagcctacggcgtgacgcggagcgcgcactggaggacgacgtggagcgcgaccgcgccgaggccgcagacgaggagggcgagcaggacgatggcattggtgttgaacgacacggtgactggaccgccgccgccatggccgttctcggcggccagcagagcgcgcttatcggtcgtcgccatggccggcagtggtgagcaagctacagtgtaatgtttgttcaatttattttcctgaacgtgtggttgctgatttgtagtgcgaactgtgcattcatggtgttcgatgaaatgaccaagaaagaatatatcttgttctttcttagagttgcatttgatagcacagttaggactattttgttggatagtgtattaattgctctattgctactatactacttctgcagaaatccaggagaaacacacaactagaaaatgccgaatttgatgctaagttatgaaactcttatatggattactaatgagttaagttatgtattactgattccatcgtagcagcaatcgaatt

SEQ ID NO: 13617 - DNA, 469 bp, Oryza sativa
agttctactccataaccaatatccacatgattggcataaacggcaaagtcgtcatctattcattggaacaaaaaataactttcagcttcaaactttgtaaattatgcatactgattatatggaggaaatagatgtgtttatcataaattgtgaacattgtacacacattaagttgtaaaaatgatttgatacctggttgatactcataatcctcctcttcaacctgcatgttaacatcagaatgacgagtagcgtcaccatgatattcttggtcttgtggcgcttgttcttgctcttgttggacttcaccataagattcaaattctacaaatatcaaaatgtgtcaataagttttaccttgtcaataagtttcacactatgataatgctttaattatttatggacataactacatccatctcgttgttattatgattaggcctattgtaaccatacctggttgatcttg

SEQ ID NO: 13618 - DNA, 1286 bp, Oryza sativa
tagcctcttctccctcctcacgccggagttttccccgcacgcacccacaccaaaccaaactctactcgatctccacggccgtacacgatttcccctccctggagccagcgcgatgggggcggaggcggaggaatcgctagatcatcctggtaagctcacgagttacttcttcgtcgtgttttcttttttccttttgagggggcaaatctgttggttgttatggtgtttgcaagaattgatgtttgtttttgcttgatctgtgatatctgttccacggagtggcggtggggaatctgggtgctgttaattttcctccggatttttccgttttgtgaccgtttcgttttgttttgatttttttttcggagcaggatctctgtcggggatgtcgccggcgacccccgacgttgcctggaagccggcggagcggcggcggcggcggtcggaggccgacgcggaggggtcttcttgctgctccctttccgctgctacggcgggtgggttggcgccggtaatgtggagagtgacgacccgtctgttcgttcggtcgccgccggggagcaatcccgctccgtgtctcgcccggaggaggaggaggaggaatgcgcgtcatgtacccaggattccaccgtctctccgccggtgagcgaatgcggcgacaggactgcgcagcaggaacccagcacccaggagtacaccgtctcgccaccgccggtgagtgagtgtggcgacaaagttgtgcagcaggaatccagcaatcaggagtccaccgtctcgccaccaccggtgagcgaatgcggtgataagattgcgcagcagggatccagcactcgggagtccaccgtcttgctgccggtgagtgagtgctgcaacaaggttgcccagcaggaatccagcacccaggagtccaccgtctcgctgccggtgatcgaatgcggcgacaaggtcgcgcagcaggaatccagcacccaggagtcgaccgtgtcactgccgtcgagcgagtgtggagacaaggttgcgcagcaggaatccagcacccaggagtccaccgtgtcgctgccgttgagcgagtgcggagacaaggttgcgcagcaggaatccagcacccaggagtccactgtctcgccgccggtcagtgaatgtggcgacaagattgcacggcaggaaggtgctgccagtgcgatccctacgccggagaaagtggaggctacccctaggagacccaggaagaggtcaacgaaggggttgactcgattcaagattatgaaagatcacaaggcggccca

SEQ ID NO: 13619 - DNA, 1748 bp, Oryza sativa
aggataatggtaggcggccacttggtgataaatcagtgaggaggaagttgaattttgaaggcgatcgggtggacttggaaggcaatagggagttcagcagagccaagctgatggaggatttgaggtgccttgccaaggttcatggtgtgcgcgatgatctgggtgcaggcaagcgaagcaagaaagggaagaaaagaaaaaagatgactggagaacatcaggacaatggcgaatcggcccttgtgccttaccaaaaggccccagctgccacatcatcatctgcgctggttccaattcaaaattctacgcaacttgctattgtacaccacagaaatcacttgaagaacttgcggacaaaggttttaggccttgatgagaagacattacaagtgtataatgttctgaggaagtgggatgagactgatagtgagagtttcgaaggtgtagacattggcagcgggcctgaatggaatgaaactcggcgtcacttcgaacattacgtggatgtgtttattgctactgtgcatggtttattgggtaatagtccggattctagaaacttctttttctccttttttcttctcttcacatgtgtgcagcacatgatagaacataagaagtatagagacataacaagcaaaatgcactactagtttgatttctctaagtaggctgggagatatttgtagtttggtttgtctaagtaagccaggagatatttcagtatgcacatcacacaaaagcactgaactttttatgttgaaaatctctactgacatgttagtgttttgtttggaataaaagtaagcgcaagcttgaagatttgtgaactcttacaaaaactaagcaatcctggtggctcaaatgatatcttagtaagaaatgaacttattgatgatttattagtctacagttctaaacaagagaacaatcaataactgcgccaagttgtacactccagattttgaaatgcttaatttaaatgtgaccagctgttttattttccatctcttagtttctaaattggggtgaaattacttaaaatcaatcaggtgcatttttctgagcaaacttggaagcacatgtatgaacatcacttgggtaggtcggtgagaaaaaaaaaccaatcagcatgatgtataatttgatcaaatcatttacttcagtttttgtctgaaaaaccaaggaaatgaaatcagcagcatttttcatcgttggtacaataattattcctggttaatgatttcaaagcaatagagcctcacgtccactttatacaacatatgcgtatgggatgaaacgagtcttggaatcctctgcttcattgaaacatgcagatttaaattggattctaaatccaaactacttttctgtcaggtcccagaaaattttctgaatggggaggatcagtaactgattctgttgtgggtactttccttacgcaaaatgtcgctgacaatttatcaaggtaaaacttagacgcaatctgatgtctactttacatgtttgtgctggagcgaatctatcagctgcatttcatgtttctgattataattttcaataaacatgcagcaatgcttttttgaacctggtggcaaaatttcctccaactaagagacatattaatgctgaagcatgttcaaatttgtctctgttgatagatgacatgagacggaaattgaatttgaatgaacaatctaatggtactgattctggtagttcagattttacaaaacctgtcgattttg

SEQ ID NO: 13620 - DNA, 2048 bp, Oryza sativa
ggataagttaccggaggaagcatatagtaagggataccaaataaagggacccgaataagtgattctgtgattgggaagctgtgctacatgcaccagcagttgagattgcaaattccattgcagtcaggggacaacattatgttatagcattgcggataccggtataagggtgcaagatacacgtctatttgcttgtttaaaaaactctgttctaacattagtgtagcaggaagatattcctgaataccttcgttctggcgatgaacatattcaccttttgcaaaattgaacttaatcaccattttgtatcatttttggccagcatatcggattaaatatatctgtagtttcaaagtggtttatgtattcaatattacttcattactagtttagcatccttttttactaggacattattcttaaccaaattcatttccttaagtaggcatttcaatcacttactgtctgttttcatgtgtgtctattgaaataagctttgcttacagcatgtctacataaataggtcttataaatctgaacttaaagatggaccgttttattactttgtttcatacattatagattatacattgtctcatactaatgacataacggactaatactttgcatttaaactacatttttcaaataccctggatatatggtacatttctattctcgcaatatgtgtggccagtggcattttagaacatttattgtttaaattttaaaatgcccattgaaagaacaattttactactgatgcaattaatagattcatgatcaaaagtgcagtttacagaccatgttgatatttgaaataccttttattttcttatccacataattgtatctattaaaaatatatgtgatccaataagaaaatgattgaaacatcagctatgatctaagctcgacctccttattcctgaaaaaaaaactccacactttatgcaagaaaccaagatttacctataatattttgattttaacatcattgtcagtggaaagatcatttttttccatgtaagctatggttttgatattactggaactctcacatatttcttgtcttcttcttcttgtgcatttgacacacagcactaaaagtattccttttccttttacaggcttttctcaagcgtgtaaagaaagatcatggaaattttgacctggattggcttagatatgtaccacgtgaaagtgcaaagtatggacatatttcataaaaacctacactatttttagtatgttcttttttttacgctatgtacaacgtgaaaatgcgaagtatgccttttttttaaaatgttgaactgacagtaaatagctgacaatggtaattctattccgtatataagtttagaactatttcccatatttgttacgttgaacttcagaagtattattgaaggaaaaccagggaacttgttgtagggagcttctatcaagctagctgaaaataacaattcgtagttgttgactgggttacttgccttatattttgcttcttcttttttggcgggcattagaaattacctcatcagtattctggggcttggagataaaagtgttgactgcatccgtcttttgtcattaaagcataaaggtttcccggtaagttatatttttctaaaaagaaaaatcaaatattgtcaacagagtacgtttcattgatcaatctcttgacaggactgcatgctcctttcaggttgatgtcaatgtagctcgcatagtcacaaggctaggatgggtcaaacttcaacccttacccttttttgcagagttccatttagttggcttgtaagattggcctcacccaaatttataaataatgattacaattctctgcttatacatacatatatatttatatatttcccttttggtgaaggtatccaatcatgcgtgatgtgcagaaatatttatggcctcggttgtgtaccatttctaaggaaaaattgtaagtcatttggtcctctcacaaaagtttgtcatacctttggtttccggcatcccatctgatgaacgtgatacgataggtatga

SEQ ID NO: 13621 - DNA, 2692 bp, Oryza sativa
aagtagtatcctttgcatgatcaaattaatcggtactgtagcatatgttgtaaactctgttaagagcatgttaatgagttgtccctgtgtactctagtctatgtgtatcttcaattgttatttcttttatacggaactatgagcattccataaaatctgcaacacaactaaattgcagaccacccttaggctaaaccaatcacataatgcaactagtgaggttagaagtccccctgaatgttgttatatttgctgcagtgtaataacaagagtagtcttagttatcatagtatatttattatgtctattttagggcataatatgttgcgatttgtagatctttttttatttggtctcatttaaattagagtactgtatcatgacactgggttgttaccagattatcactccctcctgcagaggggcatgggcatgaatatggtgaagagcaagcaagcactgctactcctggaagactcttgttgtcaaatgatagccacatagcaggttttcaacaagtatgtcaaccgcaaatcaaaataaacatgcctgctggaagagaatccatctataagtgtgagcccattattgagatacctccaagtccagaacatgaatatgaagaatcaccttatgagcaagaattatatgaagatgatctttgtgatattgaagataccataccagaattacagtatgattttgaaatagatctgtgttcactaaagcacacggtgaataatggctcttggacaccaaactctggaaaagacttggccttgattaattcacagcatgcctctgttcaaaacaaaaggttgaaaaacatagggcgtcttagaacagaacacaacgcgtatgtaaccctgttttttttatatactgctatattatcctgaaaaatcaaacggtatcttgctaagcttgataagttgttgtcacaggtacgtcctcccagatgatcatgcaatcttggaagaggtatgttgtatgccatgagcctgtaagttcaatttttactacaatgatgaaatatatttagtgaccggtttgcaatgtctaccagtttgaagatagagttccagaagatccatgtccttatcttctagttgttatttcttgttctgatgaacacacagtgaaaggcacaattctggtgagcaaccacttgtttggaacataactgtaaggtgcagtgtaaaagataatattgtgctctcgattctcaagtaacatgggctcattattaaacagagtcaaaactcagattcagaattttggggatatgcatatctatataaaacaatgttgatatttgtaccaaaagttaccgaaattgaagttaatatcaaaattaacaaaattttcatttgaacttatgagaccatatcacattgttgaacttacagaaattcaattgtagatatttcttacaaggtagaatgagaggtttttcaactgtaaattctgtcataaacatcttatgcaaattcaaaatcataagaaacaagtgatagtttcttatcttctgtgttctcagtttggaggaaattagtacgagttgatccacaaccctcactattctaaggacaatattttttgtttctatatgtaaccttaaattagttttcacttaataaagattataatatgagtaatttttttctcctttttgattagtttttgcactcactattgaacagataccctgtcggacagcaaccagaggaaactttccattgaatggtacctactttcaggatcatgaggtttgcagcatttggtcctcttcactccaatttcatcttatgtacatttactagttataaataagatgaagaccatattggctagacattgatctgttatatatattatcctttacaggtttttgcagatcattcatctagccgttccccgattaccatccctagagaatgcatctggaacctagatagatgcattgtatattttggctcgtcgatacaatcgatcatgaaaggtattgtttgctgaaaggcgaacctgagattcatgaaataattgctttgactgatactaagttgaagtaatcatcaattccaggtcaaacaaggcaagacattgaggactgctacaagaaaggtaccaagtggttgtaagatttatttcctctttgatgtttctgtcttcgacagtccgacagaatttagatactgaataagctaggtatcttacaattaaaaataaacatagctagaacataagggcctgtttggataggggtgactggcattaagtagattaagatatagtttgaagttgagccatatcccacaaatttcgaaagctatttcagctcaaacagctgaaggccagggataaatcagtgaacctcagaaaattcctactgaaagtgcatccgcttatgcgtagcataatgataccctgttaggtattgttgggtttgaaggggattgaagaggattggggggattgagagggaataatttcaccccccgataggtgtggaataaatcccctccaatccctctcatggggattaaccgaacaggccttaggtggagtcaacccacaactccaccagtacactacaaatataccaatacactacaaatatgattccctttaagaaattgtatatgattcattttcttgaatcagttaaacacaattaagttgcaattttttt

SEQ ID NO: 13622 - DNA, 1040 bp, Oryza sativa
catgttagtgataaaggcgcggtgcagtcaaatccggcatatcctaatcccatttccattccctgtctccctctctcggctaatcgtctctctctctcacacgacatcagcagggtagcccttcggccatcgccgcatctgtcgccccactccacgcttgatgactcttgcctcgccatcccctcatccagctgccgctttgctcagtaatggagcaaacaccgccgccgttgtgaagttctgaatctcgaggattcgaggattagtaatcgttgtctcacaagtgaatcactagtgaagtgttagttgcatgtgtccattttcttgtgtggaattctgatgacggacttttggttcatcagtatgggtgaatgaacggatgatgggtcatgtatttgctgttttacttgcccggaagtatggattacagacttttggttgatttgcaaaataattcctgaggaaacaagcatcgacaatcctccagcaacattgttgttcccatctatagcattcatacaagaaattggctttacaaaaggaatatcagtgtccacagcctccttttgcaagtttgcaccatcactacggatttcagaattcgcagaagccaattgcacggcacattggcatacctcattcatcagcttggtaacaaaaaaggcaggaggttggatctggtatgaatggatacatttatcctcaaccattttggaaaccttgtctaaattaatggagaacctcaaagggtcgaaattgcatttcagtggcatatatcttcacctcacccatagtggatgaagctacatcaagttccacaaagtgtcccacttgagtttcttgaaaaaaggaaaatccaaactcattcttgcaacctccgactctgagtgcatggaggctgctgtaaccctgtgatgaccatgttctcggttagctgcccacctgaaggatcccaccattaaatcatacaatcagaccaagcaaagaggtaacatgcacttttaatgaggtaactgatagtttcaacttttgttacatac

SEQ ID NO: 13623 - DNA, 783 bp, Oryza sativa
agggtccatgtccaggaaaatcttttcagtagtagtgcacagaagtagaaaaaagtttttttttcttcccatcttttctggacaacgactgatagagcaacatcattgagcgcaaccaaatcaaaccaaactcctcccaacacacaagaaaggttttgcgatgaattagggggagggggcgagagagagggagataaaaaaagcaaatgtgcatgcaattagaagggagcaatgtggagtagggttccttctccctctactctcactcgcagcacaagcgctgccttgccccgccacgaggaggaggatgaggaaacccattaatctttatctattataaaaattgaagatggttctgtacttatatcttcatcttttttttcgttcgtcatgatgtctccgatacaaagtagtttacttttattcggtcgtatgtatgaaaaccgcactttattgttacaggcagtcgggctgctactgctgcctgctgctatgcatgccgttctgttggcttgcctatccaagtacaggcccatatggccctcagcgatagtccatcagggcgtttggtaagacccacaacccacctggccacctgagagcgatgcgtctctggctgtgctcatatgtcaaggttaccaactctccctccccattttcggcacgcacgcttttcaaacggctaaacggtgcattttttataaaaagtttatatatgaaagttgcttaaaaaaatcatattgatccatttttaaaaaaaaattaagagtaaattgcatattg

SEQ ID NO: 13624 - DNA, 2969 bp, Oryza sativa
cgtaggatggtgtagtaataaatagtaggatcgagctactatgaaaattttgatactagataggatcggtatcattttggtttagtaggatcgtagtatcgtaagatactatgatacgaatcattgtgtggaagtactatcttttgcatgcaggtctcctagctatccatcggcgaaaataaaaatattttataggcaggccacgatttttgcattcgggtcttgtctccctcgggaccgatagtattggatatgttactgtccgtctgtgaaaaccatttctatagcagtgattgcctgttggcgtaaacctctagggatgtacggagtacatagcaaaagggaaaaacaaacaatgaataagaataataattatatgtaacatgaataagaatagtgattatatataagaatataaaatactatttggatatcccattccaacgccattgccctctgttctaaaatataagtattttttgttgacatcgatacagtcttcaagatactactttgaccaacaatatctataagaataaaatattttaaataaaaatagttgcatattataatattttgattaatgataaatcgagtaacatcaattttacatgatatatatatttttatttttttactattaatagttaaagttaaaaattgttaacttaccattatgctaaaaatgcttatattttgggacggattgagtagttaataggagtaattaaattgagaaattatgatggaggacgaatatgggctgtcataggccttctttctgcgcgctaaggcccacacggcccacctagaatcggaaaataagaaggcaggccaaggcctccaccctccatcggatcggaaaggaaaccctaagcgaagcggaggagagaaagcaatggcatccctgagcaagcgcggcggcggcggcggcgagggggagggcatcctggcctccttctcccggtcttcggtggcggcgcatgggcgcgaggcggcgaccatggcgaagaagctgctgcggagcacggggaaggcggcctggatcgcggggaccaccttcctcgtcctcgtcgtcccgctcatcatcgagatggaccgcgagcagcagctcaacgacctcgagctccagcagcaggcgctcctcggcgggccgccaccgcccgcgcctctcaaatgatccatccgtccatccttagcttctactgctgcctacctatgtcgtcgtcgtcgtcgtcttagcctttttcttcttttcttcttctctaagggaccactgttgttactagtgtttttgcctgtctagtcggacaaatcaaaactttcttgttttcatcatcgatctatgctatgctgctctgatgagatgtcgctttttctttcctgctgctactttattttcacgctcatcttatcatgccgaataaatcgatcggttactatatttcattctgtgcgattcctgtgccgtttattctttctcgtcatatgctgttgtgatgagatttcaatttgcatcaccagggttactctttttcttttatggattgacatctccatgttcatgaacaacagttagtataataattaaggtttttttaaaaaagaaaaaacattatagtctgtaataaaaaagagaacattgtactccagtttctaatgttggatcacaaatgggaacttaagaggatgatttcttattcataagagtaagactcgagcaatgcatatgttggtttgttacgcccccaaaactttgggaaacagtcatgtgtgtgaaggtaaccaaacattttgatacaaacagcactactttattgcattttgatacaatcaacactggagtactttttattgggtactcctacttcctccaaataagtgtactagggtttatatgaagtaaaaccataataattcgtccataataattgtattccttctgtcacatcagaagaatgggagagcaactgagcagagcactagcagagcaagtaagctattctctcaactctcatccttattcatcctttttttttctgaagtaaagcagtttctaacttgtatatggccataaattagagatttggtgtttgttgttattggatgcacaactatttactataatattttttagaactatacatggcgctatactcaaaacaaagttgggaacccctctcattttactctagctctgcccctggctcctgtggtgcaccgccgttgcagtcaacatgtttcgggggctcatggccgaggccttctgagtgcttcgcaagctcaagctgcccggctcatggccgaggccttctgagtgcttcgcaagctcaagctgcccgtctctgggtatgggatgaatattacgttggtcgaggtaggaccggtggtgactggtgagggaggttgtgccgtggcagcggcaatgctggggctgactgaggtaagtttctgtttgtccctatctccaacttggtgttgaaaaagaaaaggatttggatggtgagatttggacgattgattcagtgatttaccttgctccctgttgtttgtataaagtttgtaatctgcgaatctgaatcattagacagcaagatactaagttgtataccattaaatagtgttgaaacagaagcacttccctcataagtcttaacaataaccatatttctccattgtttgctctgctaacagtattaattaagattgtaaaactgtatttattttatgtgccttagttctaatcttatggagggggaaaaccataatgtttacattttaagtttggcaggaaagttggccgaaattgcagcctacagattttatttctagattctatagtcattgttctcaacttgataagagcaaaccctgctctatttgatagctttctttggaaatgcttctttctaacatagaattgttcagctgacatcagtgttaaatgggaataggatatgcacaaaagc

SEQ ID NO: 13625 - DNA, 1650 bp, Oryza sativa
gctattgtgctattgaccatatcaaggaacatgtttcttacctctcccacggattagctgcagttgtaccgtgttgatgatgtgagattgggtagcctcttccctgtcagtcgaaggcctctcccgtgccttgtcgggttggtcctctggattaccaacctgcggtaatgtgtcgatgtcgttgcccagccaaggcggtgagggtggatcttgtagagcatcgacaaccctgcgcggtggtattataagtgtcaaaacggtcgagtaaatgatggattttggctgattttgagatgaagttgcatatacgcagtcggtgttcttcggggttgaatgtagggtttcttgttgctttggggggggggggggtgatttctaggttcgggtgacttgcgagacgctgtgacttcgttgaggagggaaaacgaagtgctgtggaaggaggttcaacagagtagggcatagggggaagaacagaggaaagcggtagatgatgtaaggagtgtggttgctctgaacaaagaagaaattagaagtttgaaggccaggaaccaaaagctagataatgagagaaatgtgcttgtaatttgtgttttgtcatgtctgtttgtggtgtttgtgttgttgtttgggaagaactgagattatttgatgtgtggtctataatttgtgaacaagatcgtgtgtttggtatgcattggaaacaacatgtttttcatgaactatatgtatcctgagttgtggtaaccatttggaatgaatgttgtgaatgaatggtttatatgtgcaatttgtgcagcaaacctaaataatacaccaaatgttcaatttttgaacatgacaatggcatatgtttcagctagttgcaaacaaggcacttttggtatttgcaaacaagcagaaagattggatgatattgcataatggaactgaaatatttttctccatcattcatacaaaagcaactgaaattgtctgacattacatctcagataggtggcatagttagccaaattgtctggcatcacaacaaacatagcagaagttctaggctaataggtctgacattacatcacacatagttggaatattaacccaaatagtctggcctcactacgaagaaagctgaaatactgggctaatttgcttgccattacatcataaaacaagtacttccattactctaacagtagtaaacgtgccatattcagagcttgttagtttcccatgggggcagaagaagaagtgccccaccagatttcttctttttcttggtttgtgtaggttcttgagttgagacacaaacagatgctttgccaaatgtgagtctcacatatgaagttgtagagctctaggaatggggaactatggcttgcatatcaactctagctgaaccaccatgttctatagaaactttagccttggcatttaaccctgaccagctcctgggtctccattggtgcctgcagtcaaatatatttgcatatgttgaacttgtagtgattacaagtaaactttgcaagggagaaagatttgcacataccttgttcttggtttttttttgggccatggattgttgggttgtacttgttgtacacagggtgactgtcttcgtcttcgtgctttgagcagaactccctgctgtgcttg

SEQ ID NO: 13626 - DNA, 867 bp, Oryza sativa
gcgttttgatctccggcgaagccctgctgctcctcccgtcatcgccaagcttcgccgctgcctccattggattcacagctgcgaagtgaagcccggccacccctccgttgtcgccgcacatcgccggaaagtcgtcgcctccgtggacagtacctcgccgcccttcgaagctcgtcgccggccatcttccgttgccgttcgtcgtcgcataagtggtggtaagggtcactttgatcccctctcgctcccggtgccctccgtttgcgttattgtgccgtgattcgccggcaaccgccgctcccatgccgttcccagtgtagtttatccctagggtcttaatcccatctaatctaatctaatcttgtttggccctagtgtcgtcatctccatgtgttgccgccggttcaccgtcgtcatctatctctccccgattggttcggtgggacgtctatccgtgtctccttggtttagatttcaacccatcggccgcacttgccaagccgctttgtcacagccgcagccgtgcctgttgcattgttgttcgccgcgctgctgccctagcccgtgcaccgtcgctaccggagtgccgctgttgtttgctgtcaccgctgcgctagtcgtctagctgcccgttgtgccgctccctgccacagtcgtgttgctgctgctgtgcgtaactgcttgccgctagctgctgtctggccgctgtgctgtgacgtgccattgctgctgtactggtcgcagccgtgcgtcgcttaaacctagccgccgctttagcccgttgctcggtagttgagttgtctagctgtaggtgcatccctaaatcctgccggcctatagtttgccggaccccggctttaccgtgaa

SEQ ID NO: 13627 - DNA, 3440 bp, Oryza sativa
tcttttgtaagtatttacgttattattatgatgaatctgtatattaaattgtcagtttgtgtacctcggctgattcctggacaaggatttaatgcccaaataagttcggaaattactagtgaatttctgggtgtgacagatgatgaggaggaggctgctgagatagagaagcactacaaggagactaagagaaaggtgaaggcagggcagctagaggacctagatgattgtttcttgcaaagccagaggtcagaaccgacaatgcaagctagtgatgaagaagggaatggaaccccatatgcagacaatgatgaagaggagttagtagaggaaattggtagtgatggggaggtgagaatgaaaagtagtcaacatccaaggtacaagaagaaggcatgtgttcctacatttgaacctgggatgaagttcaactgcaagaagcaattgaagaaagctatcacaacatatgctcttgctgagaagaaagtcattaactttgttagggatgatgccaagagggttagggcaaattgtgattggggtagctattccccgggtatgtcttctttccaagaattcaaggtcagacagttggcagatagttatatttgagaacctgcatgcttgtccacctaggagggataactagatggttacctctgttaggattgctgaaaagtatggtaacttcatatctgtcaatccttcttggcccctggctgacatgaaagcaatagtcaaagaagaaatatttgcataagcttctgtttttttttgaaccaaagacagtgggggaggcccccacggtatattaattttctagaaatatgtacaaagaaggaaaaaggcaaaaaagggaaggaaaaaacagttaaattacaattgatctatccatgattgaactaggggcctataacattctttgagcctaattaaatgtaagctcaaatctaacttcaagttcatcaaccagttttgcactgagagttggatgccttggaaaataagtccattcctctccttccagatattccatgaggcaattaagaatagctccataaagcaaggatgcaagacagccactttttgagcctggatcctttgatgaaaatccaagttagggttccatgtccatcccagacgactccaacaagccaaactaaaaggacaaaggaagaacaggtgatctctagtttctctagcattagctgagcaagagaggcaaaggactgaagtattgggtggcgcatagtgttttctatcaaggagatcccttgtattaaccctatccatgaagaagagccacctaaagacctttattttcatattgactttggactgccatatccatttgatagtaggtgggggagtcagagctagaaaactgagcttgtaacagagctgcgaagtgaatttccctgatccccaaatgaatgtacatgaatcatcaacctccgtaaggtaagagattggagattttcttgcatgtccatatattcatcaaacgcttgttgcgagaggggtaggaagaattgatcttgggggcctctggccaagtgttgtgcaatagaatcattcccgtgctttgcgaaggagtataaacggggatatttgacggaacgtataactcccttccataaatcatcccaaaaaagaatagctatcccaaaccctataattggtttggcaatgcctctaaacaatatatcatactgaaagatgtccctccaccaaaacgaaccacaacttctcacaatctgaggaactgtgtccttgtaataagaggaccaaataagatttacccaaggtacatgagctttgctgtaaaatttgtgcaaatgtgtcataagtagggctctattttggattctcaaatcaatctttgcataagcttctgtttcaaagctgaagagagtaaagtggctttttatgaagaaacacttagatgctactagggggcagtaccaaaagttgttcaattatcaacttgagcttctcagaagtaaccctggtagcattgtggttgtgaacagggaaattggcttgaatccacaagttttcaagagaatttagatctacttagatgcatgcaaaaaaggattctcagctggatgcaggagagttattggactagatgactgctttttcaagggagcaaccaatggagagcttctatgtgctacagggagaaatgctaacaatcagatgtatcctattgcatgggtagtggttaccaaggagaacaatgagtaatgggattggtttatggatttgctttgcagtgacctaaaaattgacactggagctggttgggtcttcatttcagaccaacaagaggtaatatgatcacacactaattcagtcccctctcattttccataactaattcagtcccctctcattttccataacatgttcctgactcaattttttacttgctatgcagggtatccttaatgctgtgcagaaatgggcacttgaggctaaacacaggaactgcgctaggcacatgctaatcggaagagacacttccatgacaagcaattccaaaagaagttttggaagtgtgcaaatgctccttgcgggatgttatttaaccttgctagggcaaaacttgttcagctgattcaggctggagcacaacccatcctcaacacacatcctaagcaaagcatggttcaggttagattctaactgtgacttagtggacaacacatgtgtgaatctttcaacaaatggaactagaatctaagttttatctaataatcacaatgcttaagaaaattaggagaaaaatgatggttaggatcagtgatcagaaaacaaatggtgctagatggacaactgttgtatgcctaggtattctgaaaaaaacttaatgtatacatcagtgagtcagctttctgccatgccatttgcaatggaggtgatcgttttgaggttaagcaccatgaacatagatttacagtacacatggacaagaaagaatgctcctatagttactggtagccatgccctatgtaatatcatgcatcttttatagaaccaacgagctagatgactacattgtaccttgttactctgtggaagccttcagaagtacatatgttcttggccccaggatgatagagagccactcaatactcctagatacataaagatgccaggcataccaaggactggaaggagcagaaaaatgcataaaccacccaagccaacaaaaatgtccaagtttgggacagtgaccagatgcacaaggtgcaagcaggttgggcaccaaaaatcttggtatgcaaagcataatgttgccggtgtaggatcaaggaggccgactagagagggggtgaataggcggttttaaaacttaatggcacttaaaccaaaactaacataagtggttaggcaaggtgaggtgcgaggttaactaagaaactaagtta

SEQ ID NO: 13628 - DNA, 2466 bp, Oryza sativa
ggtcaccgggcaacacctccacaagccgtctaggaggcggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaaggggggttcaagataatgcaatggagtgccaaaaccttacccttgctgctggggagtgggtatatatacccccaaccaccaaaactagccgttggaaccgaaatccccaactttgtgctctgccggtcagaccgccgttgtgaggccggtcagaccggactactttgtaacggctagaaaactagccgttacagggcaatcattgagcccactcaacctggccggtctgaccgcagtgtagtggccggtcagaccgtccacggctcggtcagaccgccgtcggctcggtctgaccggttgcggctctggcagctctgtatcgccaccaaaaaccagaccagtgcaacaaaccagtggggccggtcagaccggccttaccacgccggtcagaccggctaacagacccggtcagaccggcctaatgcccacggtcagaccgcaggtcacttttcagctcaaccgaccgttagtaaaacggcgatatctcttgactcgggtctcggaatttggcgttcttggactctatggaaagcttattcaaagggccatccaacccatgaaaaatccatccaagaaacacaacttaagtcaaggataaagggctcacactccaaaggatatccaccggacatacccacaagatgtcactcactcctattggacatgcccacttctctcttggtttaggacttgagaaaactcatcacacttggttagacaagcccacaaaatgcacctacatgcatatgaactaatatggcacaagatcatccacaagctcgcttcatagacccctcttgatagtacgacgtctatctagcaaatccggtctacaccaaacaccaagaccgggaaaagactaagaaaacattcttagctacattatacctttgccttgcgccatccatcttggggtcaagcttgagccgagatcaacacttgtgaccatccggttgaaccatgtttatgctgaggtcttgtccatcctttgtcaagactttattctcatcacaagcttgacttcattcttgttaacatgacgatgtccttggcttgatgaccactaacccatggtgtcattcattagcctcatcatagtgggacctattccttttcacacctcaaaggagaacattagtctcaacaaatcggttgtcatccttcacttgaagaccaaccggttgcatatgaaagatatggatatgtttgttgagtattcattaacttcacaagtgtcatatactcgtatgcaagctcaagtgcaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtaatgatgtagaccaacataaaacttataccttcatgatctccatgttctcaatgtaaatgagactaaataagataacattcgagtaaacattagtctcacacttatatatcaataacatggaaatcatatatatgaacctatcaaaaagtaggagataagaagtggtacatatcgttttatctccatgcatttcatccttgtcatgattaaggtccatcacaaaagaatgcatgtcttccacatctcattatcgggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatacagagagatgagatgaaaaatgatttcaaatcaagatagaaatcttataataaacaaaatatagaataagctccccctcaagatgtgcatacatatggatatgaaggaacacatatgcacataatcaataaagatcaaataggaagctcacactatattttggatccacaagagagaccaagttagaatatgtgaagtttaatacatacctctcatcatttttacttccatatccaaatgagactagtcaaagaaaggctcataaaaacgttagtctcatataattagatttgtcattaatcaccgaaaccaaattaaggcacttgaacttatagccggtttaggcatagttggttcttaaccagtagtatctccaggtagagctgggacttgggccctgctttctcgggcctg

SEQ ID NO: 13629 - DNA, 1888 bp, Oryza sativa
gtgcgtgcaattcgggccggccgggaggagatcaggaggcaggagcgccgagccgccgagcgcgtgcgtgcgtggtgagacttcagtgatgcgttcagtaactgatgaggtcagccggcggctgcgctgaatactgatcagtaacttatgagcagtgctttcagtctttcagaattcagagagccgtgcatgcatggaaagcatgatttttttggctaattaattctgggatcacttaccattggcgattagtatcgtgtatatccactgtctagtcaattaaatttttgtttgtgttttttcaactttttaaatggctaattacctgtgtccttgtttactgcaatggtgcatgcatggaattatggaaagcatgttcatttgcgtggaagttcagagttcagacgcatcgaacggtcgaggtgtcgactgatgactgatcattggtcgatcagtattcagcacggaggagtcgtttagtcacgtgtcatgggctcatggcacggcatggccattggtcgatctgtcatcagtcaaggcgtcgagccgccgaggagtcgttcagagttcagacgcatcgccggctgataaccgaggaggcaagggagaggtgaagagcctggcgcccagccctagcataccctatataaaccatacccattttttttgatttcaacacacttcttcttctttcaacacatctccccaccgtatctatttttcatagaaaatatgcggaggtccaaaaagcgtcaacacgagtcaacaaccggtccatcccagaggtcggtcgatgcccgacagctatccctgggcatcgatgactacgggatgcatgatcgccacatggatggtctggagggcgacgacgatgatcagccatctcctagcgaggccaacttctccttcgacaccaacgccatgacgttgcccacaccaaattccaataaccagccatctgccagaagagcggagtgttggcagcacttcgaagtattcaccgagatggttgacggtaaaagtatacctcgtgctcaatgcaaatattgcgacaaaattttgtctgcagctacttcttcagggacaggccatctcaaccggcattacttggcgcatctcaagaacaaggcaccggcaggagcaagacagacacaattgtccttcggctctgacggttctgtaagtacatggatctatgatccaaaaatagctagagaagagattgctaagtttattattgctgaggatctaccaattagaatgggggaaagcaaacattttgagagaatgatccaaaaagctttttgcccacagtacaaaaaggtttctaggaaaaccaccaagaacgatattacagctatatatcattctaagttgagtgtgttgaagcaaactttcagtactactagtttttcatttgctgtgacatcggatatctggacatcccaacaccaaagaacatcttaccttagtgttgttcttcattatcttgacaacaatcggtcattaaataagagagtcatagggttccaactcatgacgtcacacacgggagatgccatagccacgacaatcctagaggtattgagagaattcaatttacaatctagggttgtttctattactcttgacaatgcatcagcaaacacaacggccatatcgattttggagtcggatctgcgaagttatgttggaggcttcgttattcatcagagattcatttgtcacatcatcaatctcatcgttcaaccaggtagtaatgttattaataatttattgattttagtgtatgcggcatattgcttatttattttaatgtatgcgacctatttgttttgcaggcataattgttccggataaattgttaaacaaaattcgtcattctgtt

SEQ ID NO: 13630 - DNA, 1037 bp, Oryza sativa
tggccgttgcggcccgtggcggttcacggggcaccacaatgggtggtgaggcggcggtgttcacgcgtgtggtcagttgccggcgctcgcggtgcctttgcagcggctgccagctcggtggtcggcggcgcttcggggtgaggcggcgtggctattgcagcgtgagggcttgtgcggcggcggtgttgcttgcatgtgggtggtggccggcatgtgggcggcaaaggccgtctcttgtggggctgcggcggcagctggctcttgcggtcgcggcacatcgggtcatactggggggtgtgctagcgtctccggccacccccattcccctgaaaccaccctcttctctccttccttccctcctatctctcttcctctcgctgctgtctctcggcactagcagttgggggaggcatgcgtctccctttccttcctccttctttctctcttctctatttgccgcctcttggcacaagctattggggaggccgcccccctcctcttagttgtctaggagccttgctgatcaccccagtgcccctctctctgtgctggtggtgaagttggaggtggttgctgcagtcgaaaggttcatcccgcgaagcctggagctcctcaccggttacatggttgacaccgatgcccatttgccctgcttccagctctcagttcttccccaggcctgcctgcctcctttcctccttgttgctcctcccttcttttggtagtctgcttccagatccggccgtggagtctctcagtggttgaggagtttgtttgtccgtggggttggtccagtctgactgtaatcagggcttttgggcctcgccggtgcttcttgtgccctgtgaccgtgtgaacctgctgtatttccgagtttggaccggagtgcttacctctagggtgcgagagttcttgtgttaaggcggagtcggagctgctgcatcgggtcagctgatgagctgggcaacgataacactcaacactcttactttggcttcttggaggtcctgcaccttttgtgagagtgttgggtgtaa

SEQ ID NO: 13631 - DNA, 565 bp, Oryza sativa
agtaaatttgtggatgcagtatataggcaacgaccaagcctctccatcctcagagaacaaatcaacatggaacccggattcagagcttaaccactacctcgccaccaatcatactgagcatgatccgacgcttgatggccacgatgtcgatctccttgggtggtggaaagagaaagagcgaactcttcctgtgttagctcactttgctcgagatattcttctggttccagcctcctccgtctcttccgagcaagcattcaacgttactggaagaattattgaagaacaatggtcatgcctgacacccgagacggttaagtcaatattttgtcttaaagactggatggaagcagacgaactaacgcaacactgtctacatgatcaagagtttgccgatgcaatggaagacgcattggcggaaatttgccttaccaaagatgatggtggtgttgatctggagtaattgatggtataatgtaaaatagttgttgtactcttttttccttacggggaaccctactttagggcgtaaggtttttaacgaggcaacaactatatattcaaa

SEQ ID NO: 13632 - DNA, 14422 bp, Oryza sativa
  unsure (1)..(14422): unsure at all n locations
agacactaggagcacggagaacacgcccctttttcctcggcgccgatctgaacctgccaccgtcgctactgccgaatccatcctctccggtgagccattgctcgattcctcgcacatacgccaccatagggacctcactaacacttgatgactgcatgcatgccagttcttggagctgtcaagctatcatcgtcgacccagaggagattgccgccgccgagcagttgcacgagtcgccgtcacccaccaagctttgccagtcctgtctagcatctcggtgagcatcctggactccttaggaagcacatgcatgcatgtatctagcgaaaacgaggccccaaagcagcatgcagtagcagcctaagcacagccgtcgctcagacccgccgccggcgctactccaatgtcccataaccaagaaaactagaggaatggaatcgcgagagcttggtcttcattttatcttttgacctcaacctcaagcgagccaccgtttgccgccggcgagctcgagatcgacctcagccatggctagctctgctgtgtctagagcagagggatgacttccgtgattagattaagcgcagggatccgtttacaattgtagaaacacactgacatatgggcctaggactgcgggttgattcctagaaaccccaagggcctttgtgcatatggtccctcacagccatgtggaccccatcctttaaaatctgaagaataattaagaaaatgcccaacaaatatatgtttagcagaaaaatgcacaaagttgtaaaatctatataaatcaaatatagctcattttgaagtgattccagttgctgtagattcttgaagttatgaactttattccaggaatataaaacttgacactcactgtacaaataatgtctctaaaatttatctaagataggtcatacataaaacatgtacaaacttataaaatacatagaaaattcatctcaactcattttgaaacaaactcaaaaactgcagattcatcatcatgcactctctggttaggtgaaataaaagtaattacttactttgcataaaatgcctctaaaactattatatctaaaatgattagttttagataagctaaactttagaaattcatgtagaacccaatttagcttcaatttgaataaacttaagttctataggatcaccaaaacacgtatttccatgttatgaaataagattatatacttactgtgtagtaaaagtctctaaatattcatataaggatttactaacatagagcaacctttaatttgtaaaacttgtagagaatttatttttagtccaaatgaaatgaacaaagtttctatagaaccagcaaatagttagcttcaacatagtaaaataaaatttggcaccttttgtagagaacatagatcaaaaccttaacttagtgaaataagaatttaaacacatagtgttatttaagtaatacataaacatgtataagtatatatacactttaggtataattaaacctaaataaaaacttgattgaccagtgaggccatagttccatactcatccactaaaacttagaagaacttaactcatatgacaatttctaggttaatataatatattgctagtttagattagagcatctctagtttataaaatatgaaccatagtagtacagaccataacatgtgaaataaaaatgttttagttaaccaaattattccttttattcaacttaaacaggaagtagcatgttctaaacctataactcaaaagtcatgaacatataaaacactatatgcctaaaacacgttgtaacttgtaaaatctataagaaaatcactataactccaaaaattgtgaaaccaaatgtgttagtcttagaaaacacatctccacacccctgtgaagtctaatataataaaaatcactttacaaaagtattttataacactacctaagactactactataaaccgataaaaattctaaaattcataactcccaaatggaataagataaaatagatattatttcacctaaattcattttagatcagtaccaacccactgtgcataaatcatgcattttagagcattttggattttcagctctttcggtgtttaattgcataacgtgtcatttatatagataattgcataatcggtgaaggactggattaggtgctaacgtttctctgatcaaggcaagttttctcctcccatcctttgaacacattgaatcccatgatttgaggaatgaaaatatttgtttgcaaagttgcatgtgaacttagactatatcggtatttaaaattgggttaaggtagttatgacctatttgctacatacccccaccttgaataattgatcctcttgctgtttgaaaccctagaaatggttagagtacactctttgtgctcaaatgggtttatatatgctctatgtgcaactacttgcttagccatgcttagaaatatgcaaatgctcattccatctataattaaaatgtgattttgatacatgaacctttgctagaataaaatgaatatgatgggtatttgcgaactaaaatgtgtaaaatgtgattttatacttgggcggcaagtggtgtgcatatggtgttagttgcataccgatagggggagtgtttgcccaagtccataaggaccgaacttgtgtcacccatttaaagttattcgtacatccacatgtgctagtatgggatggtctaagctgattaatctatttaggactagccttgcattctggtaggccgggtgtatgagttcgtataattcagaggagcttcctatttaccccgacgtggtagtttaggtgactaaacatgtccaatacaacggtattgtgccacgtggtgggttcccgtcgtgtccgccaccacggcgttaagtttaaggcgtgggcccaccacttaacggttctagacatatttccaagtatgcctaggatggaggaacacgtatcgtgctggtgcaaggctagattctaagtagtgtaaaggattcgttgtgacctctagtccgcactcataatgtaaagtgtggcgtacttggccggcactgaaccaactagagtgtagcctctaggcttctatcatatcatgtggggtaagggtgtacaaaactctgcagagttctttaaaactaatcgattagccgtgctcacagtcaaaaacccctttgggaagtgccatgagtatttaaactaatcgattacccgtgctcacagtcaagagcgctttggtgatgtgtcatgagtatagactatgttttaaaaatgtaatcatgtgacattggtttgaaattgataaatgtgttgagttgtgtgtgtggtgatacattatgacttattgttaagtatgacaataagagattgattatgatggaattatgaagaagttaataatgaaacttaaaacttgtctttgttaattgaagcatcaactcctttacaaaagaattgcgaacaaaacttgctttatgctgaaattaaactacatattgccttcctttgaatatatgtcttacatgtagtatgataggattgatttgtgcttgccagtacattaaacaagttaacttgtttaatgtactgacttgctgttgatataaccttttgtttgcaggtttagatttagtctttgagtgatgcgggttccgattgcttcttctaggatgagaacttaatggggtaaacccctagtcgatgtgcttgtgattgggtagtcaagcttccgctgttctctaataagtctatttggccggtcggtctatgtaattattaagttgttgtaagtcttaagtttcttttatcttagttgtgtttgctatgtataatcatgtttaagatgaaagtgtgaatctagtgcactagtgcacatcctgggaactagatttacatgagtatgagttaggaatatttgagaggttgtagatctttagctatttttgtcaagtttcctgaatgtgtaacacatctggtcgccgccttcgagtggtttgacgggcacatatcaggctgaagttgactggcaggctaagggcttagcaatgtcttcaatatttctctctcgaggcgtccgatgtttcattatgcttgtttgatgacttgaattattcacttcatctctcaaatataatggaaggtctggagagcctacgacactcttaccgaatcactatcaaatcgactcaaataccctactctaattggcaatgatagtcattctaatataggcccagaccgagcacaagtcatatcatattggctgtatcggccatcagcctcataaaccttgatcaacttacactctgtcttctagcaaatacggtatccagccgatgcgcaatccgactccaaattcaactcgattccacaccaaatctgcttcgatcttcttctttcttctccgaatttgatgcaaaattccgttgttaacaatattatacaaaatctctctgatttgattttgtcttcgacataagcccccataggcttttatgtgggcttggcttcacttttatataatgacccatgtatatatactccaggggtgttgattacgtgaagaataacaactcaatcatgttaacatgaattcttgaggataacttttcaacaaggcatagtgctgaagctggtcaccaagcaaaaaaaaaagtctaaaacaactacttataaaggtaaactaatcctatgtaagtacaccgttattaaacaatattttattttggtagcacaatattttgtgttgtatacatataaacccaagacttcatatttaccacttaagcagctattagttaggtctactatatactttttggacacaaccattgtgagccttatgcattatattgctgagtagatgttctcatcacttgagcatccggtccagcaagtaatggcattaagacctagaagaagtttgcttgtgtagaagaattccaccaagataagaaaatatctcaatgtgaattctagatgaacattaaatacacaagaagatgacgacgtgataaaccttgaactccactcgatacgctcacggttttgattggcctgatctttcggtgagttgagataactacgatttgggagcaacgttgacgatccgactacaacttacaagacgtcgttgtgttacgccttagcgatcgatacacctcccccttggttgttgattcttggtggtgcagatcaattttattcctgcaagccaattgaagaaacaagtaagaacaagattaaagccatatgatattgcaaataggaattgaataaacatgataagttggggttctgaagacgagcaattaggtggtatagccaacacacgtaactacaaggtaaagtagcaatggctaaaactttaatctaacaaaacccgagaaattataaagaggtcctgttgacggtcgttatcgatcagtttcgactgtcaatattactaaaatagaggagaactagtgatgcttgcaatggataaatatattaaaataataatattccactagtattaggtatactaacatttttcagagaatgaccataaagtggaggagaatcgacatcaacacagacgataaatcaatcggacgatgtcgagaaccagacttatgtatgaatgggccaagaactcagaattgacacgacaaactgagccaaaattcacaagtctgcggagaaaaacaacagagtaggggtgggcataaaaaccgtgaaccgaagaccgaagccgaaaaaaccgtaaccgaggccgaaaaaaccgaatttccagttatcggtcacaacatcgtgtgttaggtctaaaagaccgaagttctttcggtgagttcggtcatcgtcgttaattaaccgaaaaaaccgaaggaccgatcaacccaactgcatgtattcttttccaggcccattagtctattgcgtgtgtacagcccacaagctaaccctcctttaaagagaaaaaaacaccttatcacttatccccatattcccctccacacagaaatcacggatgcggcatctctgcaagctctcactccgccgccgacggaaacgagaaaactgcatcccgcagtcacgcctccgcttcttcccatgagcttccattctcttctccccttcccttctaagcttcaattgctccactgcccagtgcccatgaggccatgaaccgaggatctgaggggtgaggcaagaaacgccgcaggcttaggctcggccacccgcagttggtcgccttggaggcgcggccgcgcggggttgagcaatcgtccgcgaacgaggagggttgagcaagctggtgcgccggaggtaggcaagcaacagatgccggcttggggtttctggtttattgatttagtcaatggggaaatgtaatctatgactttatgactttttgtttgagattttgattaatctctttgtgaatttgtatattcaggacgtaattgataattttgatgcattcccatgtttggttgttctgcttttgcttatttacttcgatgtgcaccttgttaaatcggtcagctcgggtaaaactgaagaccgacccgacacttcggttacccgaaatgtcggtccatgaattttttgttgcaaatatcgggttcttgttttcaaagactgaagttttaaaaacccgaacaaccctggccgatttttcggtctagaccgaaagcccacccctacaacagaggaggccgccagctgaaccatgggttggttgggccggccccaagtttggccaaacttctctcatcgccgctggatgcagggtttcttctggacggtgtggattagctctcaatgacggttggagggtatttctgaccattccaaccgtcacaaacatcattggggtgctatataaacccctcaccttctcacttcacccacacacctcaagcaatagctctctcatttctctcaagtttcctcaccttctcacttcacccacacacctcaagcaatagctctctcatttctctcaagtttagtttagtagtatctagctggtggaataggaatagagtagaaatcaggagtccggaagccttccgaagagttcgggtatgactctagtagcttttctcttctcttttgtaagctttgtacttttattagaaaactcttctttatatatttatggtattaaaatacttgccgaatatatgaatatctactttatattatgttcatgttatactgaatatacagctaacttatctgggagatgctttggtgcgggtataatgtttacttatgcaattactctgtcatgacaatgatattagagtagtatctggtagtttaggcgtggtgtctagattacgggatattattatttggggttatatattgcggatgagaggtgggccgctgatggtgacagctcagtacgggtattcctccgcgccggtatataatcctaagttaattccctggggagggtattcctccgtatttagcccgggttgtatggtcatgacggactgtcgtaaggaactcggcagtcagtgatggcttctcgaagtaccaggaaggcatcgaatagagggtattagctagtatatcagttaactataatgtatgtatactatgtatattagaagtataggaatagattatctttctcttttctatccacttaggttagatgatatattatgagaatgagtagttaatgcttgtgtgtcactctacccttagattatcttaacccctgcttagaatatgattatcacaagtaatatataaattattagtcaatgttctctctatatgatctttccacgggataaaataaatacgataccattggaatactctcgggtgaaatgctacaatgttatatccgtgcgcttgcggatgaactctgtaaccataataaaccaggagtatttttgcgtcattgctgggaattatatttctagtaatgtcgttaagaaatactaacaggtacctagctatttaaggaggctatttaaggagttgggatgatgaccaaggggtctctaaggtcatgctccaccagattggggcgcaccccatatgggtcccacttaggctagggtccaagacgaagttacgggctcataggcccattatagatgacacaataccttgggcggatgactaagatggaattttaagatgaggttggatcctttggaaagaggactccgagatctttccatcaagtaatcacaggccgaaaacagaggttgtatgcatatttggcggccgtttgaagtcagcaatgtagcaggtggccgaatcagattccaaaactcatgtggcttgatcttgatgtctcccagttgagctatgatgtgagcaacggttgcatcaatagtggctatgatcatatcatgacggtaggttatttatgagttataaggcatgggatgttggccttaacatgggctggccagacgagacttaattactccccaaagtagattgtcatattgcgagcagctcgaatggaattttgacatcaatttcatggcaacagtgaagcacgtccgatcaggacagtctgactaggtcttgttaaacttgttgggattagcatgtgtatccaaggaaaaactttccttgtcatacaattgttctatatacccctggtatgaaaggtgaatgacatttagcatcaacataattttctttatgaaaaatgttctaaaatgctataggtaatagtatatgcatgttttaattattccatcatatagatagtcctagaatatctatagttccataaaaaaaaaattagagcgtgacatttgttatagatctaatgaccataatacactgtaaatattgcttgggtagctttctatttataaattgactatttattatgttatacatttttaaactagaggtaaaggcgtaaatagttattttctattttatatatatatatatatatatatatatatgtatgtatatatgtatgtatgtatgtatatatatatgtatgtatgtatgtactactaccgggagcaactactcccatcttatctatgtggcagtgcaaatttctgctatttcggagtccccattggcgtgttaattagccatgtcatccaacccgtttagaatgataaccattattttcatgggatacaaacaattttgaatgcatgttagttcatccgccagaggagcagaatatggacactacgattggcagaaaccattttttctcccattgatgtctgttccgtttccaaataatgttctgctcctttccaatcgatgttctgttccgtttacaaataatgttatgctcctttccagttgatatttttctgcttctttttaatttcctgcctttcttaacgtcttctgcttagtgacgattttgttgaaggagcagaagatgtgcttctgttcaaattagttttctgctccctttctaaccgatgttctgctccttgcctcctttcctaggtcacatactccatactgcttcctttcatgtttctgctcattttcaagtcttataagcttcatatagacgatgagattcaatttaacaggcagaaggtattctgcactttttattccttgttctatgcgttcttacaaatttgaaatgacctgaatggacacaacagacgtcacaaattatgggccggggagcaaaagatgttctgcaattgtttctgccgagtcctatgtctaatagtgaatggaatcggtttgtgaaagagcagaagatattctgttatctctaccatccattgattcaggagggggattatagctttctgctgcacaaattctgttatgccgttgtgattaaaaagagtatcatccctcaactcggctgtgttgtacatccataccaacagaaactatcctgagcaaaatataacatacctatttaagtatgtaaacataaactgcaattagtaatcaataggcagaatatgaactgccgttacatagagaaaaaattggtatttgttctgccaacaatttgttttttcgatgatgttctgccattttctttttctgatgttctgccatttttttcaattggccagctacatatcttctgacggttagaagcagagcatattctgccaaggcgagcacataggaacaaactccaaccgaatgttttgcatgcagccgatgatttagcatttatttgaactaataaactatttagttaattacttaattaaacaacccggtctgcagaagtttagtagattcagggttattccgttaaatcgatccgttaagggaagggttactcccgggcaccatggtatcaaatgcacaaaatcattcaaatatttcaaaattttcaaattatgagtatatacctagttataagaattcgatttatacctacacctaacaacaaaacaactcaaatttaactttatctcacaatccatgattacatacctaactaattatatgtttggatgctatatacctagaatcaaaatctaacaaaaacaagttcaaattcagttcaaacttgctttgaactagttagtaaagtagttaatgttaatatctaaatatttgaaaaagtttcatactcatttgaattggatatatactcaatttcaacaatggtgcccgggcaccatggagcaccaaacaaatttataatatatatatatatatatatatatatatatatatatatatatatataaacatgtatcaagtgaagtacataaattttataatatatatttttttatataatataaacaatacactgctaatgactatacttacttaaaaagtaatgtagtagcattaaaataaataaaatttataatagtttaataatattatgtaagttttcagatttcggttnnnggnacctacgaacaagaaaatcgggctgcaagaaccggattttcttctgaattatctaaaattcagaagacaaaaataatcgaggaccaaacaatacctagcaagaagttgcttaatctctagagctatgatctttatattggtttgccaatctaaactagctcatcacaactaatgaaaatctaaactaaagataatgaagggatgaattcaagagattcaacgcaatgatggaaccaactaaagaaatagattcatcgccggttgaagcgtcccgtctaccgcttctgcctgcgattcttgatatgccccgtcttgctggtgtcagcggcggcttgccaattcaagccaggaggcatcgctatctgcgtccccaatgatgctgcagtcaccttgcgtctccaatgatgctgcagtcaccttgaaagaggccggacacaggagctgctcagctggaaccgggaccacttctttttcttgtttgtcatcaggagcttcgagaggtctggagatggagattcttccgatcgtcgccaagctcccctctgctgctgccgtgcgccctccctctccttctgattctgcctgcgcccactctctccctcgctctctcttctactaattgacgatgaaagaataactcgaggagaaaatacaaatcggtgggctcccttcccctaccttgtaccattactagtaatgtaccattatatagagcgtcttgattcagcggcttagtttttctctctaactccaaataccacccttgatatcataaacttcaaaactcatttttttatttttctttcaattcaattcgttagtgactcaattatgcttccattttcattttcaattcaatttgttactgactcaattatgccaatggcgccctcggagaaatatgaatcggaacggaaggcagctgttctaaggcgatgtggcggcggagaggtgtactagctgcgctggtcaccggttgctacttgcggctcctgcatgcgcgcggtaggatggcagattggttgttggtggcttgatgactgtcattccgatgagggccggatccactggtggcgctccaaaaaagcttcggatctgatggtggtcgttcagggaggtacggtagtgacgctgacggtggccgacgtccaggctatggcggtgccgcttgatggctatcgaccgatgtgatggtggtgatggcgtcggtggtggccgagaaaggtggcagtggaggtggttaccggccggccttgcactccgatgatgtgtggccatgccgccgtggacgtggtggcagcgaggactagcggcgtcggcgctcttggtggtggcgacatagtgatgttgggcggtgtcgggggctagtcctccgatccgtccattcctcggtcacaggaggagagggctggtgacgacggacagcggtgagggactagccctccccctgcaacggcggctcaactaatgggtatggtgatagtggtggttggttggttcggccatggcagtttgtgatgacgatggcggatgctcttggtgttggtgtcctaaggatggcggtgacttggcgaggtccggcgctggttctgaccatgaccaggtgaggacaagggatggtgatcatcgatgacggggctggttgacaatgcaatggtcgttggctcgcccgatgcagataaggacgacagcaacgaaagtttttgatgactgcatcataggaaaggttgctaccaagcaaacatcgacgcaaaggtctgggtacggttatgtctcgattgcagtggagcgtcttcgacaagtctttgattgtagaggcagtgcatgtcatgctaaacggctccacgacgctctagaagcgacagtgatatcgatggtctacagaagatggtggtggcgcagcaaggacgcttcgtgacgcggtaagggcgttcagaatgcggctgcagcttaggtgttttggacagggcgtaaggtgttttggatggcgatggcagacagaaagcataaaagttggcagcagatggtgattgtgttctgcagagggagagatgatgcgaatataggtagctcggactagttctaattctcctctttccccgtcttgcactgcgacggaaagaataagtcttcgatgaaggttggagctaagtcttctcgcttttttttttgtgtgcgtgtgtgtgtttgtttcttttcctcagtgtgaggtttagagtctatgatctcgtgtatgtgttttggctatgtatatcctttgtagatatagagaccggattaatgaaaaatctattatctaaaaaagatttgttggtgactagtattatgacaattatgcttccaatttgttacgatttcactacatgttgtacgagccaatttatttgaaaagcatccgtgcttgaccacaacattttcatcctcccaatcgagatgaacgtatttacaagttgtgcacttgtgtacacacaattgcaacgttttctttttccttttcaatactttgtttgtcggtaccaacacttgaaaattttgaaaaaacgccgccgctagcgcaggtgtcctctaacatcttcctgatcatgcccccactactgatatgttttttctttgagaactactactgatatgttcgtcttgtttttttattcatactagaaaggtaaagatcatttaatttgtatacatgtatcaacggataaataatcagacatgatgaagaaaaagaacatcaatcatacgggaaagcacgatatgtcgtcctgctttatctcaagtagagcaagaattgacggaggaattagcaactttaatcaaccttttcagttggcatattcttttagaagtatctacgtgtcctgttaaccgtttggtataatacaaatggaatcagatgatacaaaagtgggcaacgatgtacataagatccacacggactttgcgagtctcgttcgcttgctatctccacatccacacggactctcgttcgcaggttgctcgcgagtcatgacccacgcagtctcctacgcataatgggaattggacacggatgagtaacaaaagttttgacaaaaatatcttccattttataatagtatatatctatacaaatatttaacatttataaaataatttgattaaactttagaaattttgatcaccaataattttttaagtgtttagtttaaaagcagaagaaaatatatacatagttaaagaagtactatcaaaaaaataatccagttttgaaatgaaggggagatcatctcatacctcccgtttagtgttcccattagaatttagaactgtccatagtcatgcatgtgtgtgttggagagctgccttgcttgggggctgggcgcagcaggctcatccgatgggaacgatggacagaaaacccaggtgaccagggaagagcaaggagccttcggctgtgtctgggaaacaggacttatttcaagaccctatcacatcggatgtttaacattaatttagagtattaaacatagattaattacaaaatacattctataaccttggac

SEQ ID NO: 13633 - DNA, 2454 bp, Oryza sativa
cattatctaaaagaaatatttctatgcatgccaccatgctcgctactcacatgattcctgagaccgactcaatgatgacgcatcgtaccatgcttccaacatcaacaattttaattgttataatagtagagatatgtgagatgagcggaaaatgaacttattttaggatagagagtacatgtgtaaccacactaccataagaaacgttatccatatgaatatatacttacttcgtccaaaaagaatcaaatcctaactataaatctaaccaaatgcttgtttaggggttcatagccagagttcgaggttttttttggacggattacatctcagtggaaatctgacattgtagtatctctgaactcaaatattgtcaaggttccatttacaatactactattgtacaaaacaaagttaaagcacatatcgacacggtagagcggaaacgcctaatgccgagtttcatcatagtccctaaaattttcaaattctacgagaaaacaaagttctgaacaagattgccaaacagcacaagattgtgcctgtctgcgtatcaatcggtgtaggacttttcaagtcaagtttattcagcatccactagcattttttacatcgataagccaaaagttttcggtactacatgctagctactagactgtgacagacgatctgggcgcacacttcctccatcgagacaaatttcatcatctggtagcggcggttcattccccatatccctagtcttgtgcaggagaaaagttcctgcaacgatggtcacaaaaccacataactgtgttgcaatctgtgttgcattccgtgagaatgaatcctggaatagaaaaggcaacgatggccaaatatatcagacaaaaatggcagattgtcaagttgaattggaaatacaaaacagttatttgaactcaaaacactcttggtctgcaagagaacatcaagctgaaaggataatgctgtaactgctgatgggatgtaattttgaaatagtaggatccattgaagtcagggacacaggccaaagccataagtgatgaacaaccttgtggaggtgtggtctagtgaggttttccttttctttttttttatttataaagatggtctagcagattaatttcctccaaatgagttatcatggaaacacctaaataaaagcctggaattcctacacccagcaaaacaaaacatgatcttcagatatagaaaaaaaaaactgaagttcaacctatacatttgaactcgtgagatataaacaaaccttaactgcctaaatcttattatctgcagagatacctggcagttatcataatgcaattcaaaaaacagtttaaacttttttataattctttaatgtacattcagaagaaaataagaaaaagtaaagcaaaagcttcatatattattgataagtttttttttcaaatatatagcttattgctaaaaagtttcttctaatttgtggcacagtgccagtcagtaccagggtttgcaatttcggttgccaccgaaatttcggtggttgccgaaaatttgaaaattttgtgatttccgggtttttcggaccgaaattatttgaacttttaacatgttttgactgaatttgaacgaattttgaccaaatttacaaatatttgagaaaaaaacagaaaattttggggagatttgtgcttgctggtgggggccgaaatttctgaaattttgaaccgaaattttaaaccattgtcagtactaatctggagcgcattttctctcagggagacaaacactacaggaatcacatttgcagatacaattttaaagctatttgaaagtaacaagtacatcaccttgtacataatcatgttagcaaaaatagtaagtatggtgaacatcacgtagtacacaggagagaccacagctgtattaaatgagtccagtgcctgcaacaaattaaatagtcagaactcaaacagagttcaaacacatatttctgcagcagcctttatgatttagaattatcaataaatagtactacgtatctattttagaaataactcacaatttggattattagtgtacaatcatatcttctcctttactttcagaacaaattattgacttgagtagttatgctttgatgataaggattgcaaaaaaaaaaaagacatattccaaagtgtgttacacctgcacttacctttggaaaaactaaagcaaataaagcatttgccatactttcataggagtaaaaaataacaagctggccgtaatatgctagactgcttgcttagtataggttatgaaacaaacatagggaaataaatatatttgagtaattgaggcttaggtcatgtcagacattatagagcgattatttgcatattgagttacactttttgacataagctgaaatgaaattggaagcatagaaggtttaaaagtttgttgcagaatagagcacct

SEQ ID NO: 13634 - DNA, 732 bp, Oryza sativa
tccaaaaaccataattgtattaatccacaatcactaaccacatccattcaattaactgaatccaaaggtgatgtatgtcttatataccgtgagagatcccattgttgaacagattgcaatataaacaagcatcttcctgtgtccagaacgttcagcaacccagaaaatcaaaaatagaacagacaccacagccacacatgaataaacaataaaacctgcagaagttatccagataacaaaaccttgtggttaacattctataagaagttccattcttagaacaagtgagagaataagtaaatgctcgcaagagaactttaagatcattattattgggatatattacccaaagttgcaaaattttgcgatggttgtagtcttgcaattttccatagtattggtcaagtcagggaatacattcagttttaccccataaaaaggggaaaaaattaaacatccacattggatacatcgtcctacaattagcagatttagtaataaagcttcctcacaaaaaaaaaagattatgtagtaacacatgaaaatactagtgttttttaaaatgttagcagtacaaaagtatcctacggtatacatattatattaatacgaaaagataaaaatggatcctgttggttctttattgacagaagtattcaagtagtttacctggctcagtagcaagatgccatatttcatctattgaatcaatctctctctcctttggggcat

SEQ ID NO: 13635 - DNA, 8149 bp, Oryza sativa
acatctaagtatcagtatccagtatgttgatttgagctctgtattaatgaaatggctaccctttttgaaagtgaaataatcagaaagggaaatgtaaataataattataataataggatagatcgcagcagtgatattgaattgcagggcatgatgctcataagcactactccctccgtttcacaatgtaagtcattctagcattttccacattcatattgatgttaatgaatctagacatatatatctatctagatttattaacatcaatatgaatgtagaaaatgctagaatgacttacattatgaaacggagaagtactttttagcgattatattctgcagataaattgctaagttgaaaaccatccatgttttttttaaaacaaaggtcctaatctgagtatcaagtgttcagaattaagctgatccaagatttgctttttctcaaactttgcaaaagtacctactccggattcctgaaatcctgaatcatatgataatttaattgaagtgatgtaaatcatgtggattggccctaggattactgtactggtggtggatctacacaaaacttaatgctataattatagcattcagtgattatgcttcacactaacccatcatccaccatttttttcttctattttttatggttgaagtaaacaacaaaaaagtgaaccagtacctatattcaactaggacttattactcaaggtgtgtgacacaattcagtcagtagtgagcagcaaatccacaatgcagaatacttgattttttaaaaaacatatgactagaatacttcaaaaggcatggttctaatacacacttactagttatcatccccaaccaccataatggctcatacaagtatgagaaacctccagaacctacagtgcatattaaaaaatatgaacaagtaatactacataaaaggctgaaagaattcaaaactgcacttgaaaacattatgcaattctacatataaaaagcatttgtttgcaatgtcaaaagttcattcagtttatatagttgctggaagatgtacaacctgctcttaccccagaatccccagccttcttgagcccaattttcttgataataaagcttgatccgataaatgcacttgatgatatggccagggtcaaccctctcacattgtctatagatgttaccatgccttctggaatgagaacctatgaacctatacctacaatccaaaatagtctaatgaagaaaacatttcatatattgaacttgtagacagtgatgttcaacctcaggttgcttttgcattaactcccatgtaatctgtagagaaagtggaatagatgcctcaccaatgtggggaggtgaactctcatatatatatatagcagaattacaatcaatactagggagttacataagaccaaaggtctaggagagtaactatctaggagtgtaaaagtttaggagataaacagcctatagattaataaataatcctaatacccgcccacggtcgcagcgggaggagcacgaacgcacagactggaccgaaaatcagtaaataactgaaccggcaagcctttggtcatgatgtccgcgaactggtgcgatgaagggacatgaagtacccggacttgtcccaaagccaccttttcacggacaaagtggatgtcgatctcgatatgcttcgtccgtcgatgatgcacgggattcgctgtcatgtaaacagcactgacattgtcacaataaacaatagtagccgaagcaatcgggacatgaagttccagtagcagttgccgcaaccagcagcactcggcaacggcatgagcaacggcacggtactccgcctcagcactggaacgagagacagtagtctggcgcttggaggaccaagaaaccagattgtctccaaggaagacacagtagccggacgtggaacgacgagaatcgggacaacccgcccaatccgcatcggagtatgccgtgagggactgaatcgggccggagccgatgtggaggccggtggagaggctgcccttcacgtaccggaggatacgcttgaccaaggcgagatgaggctcccgcggatcatgcatgaagaggcagacctgctgaacggcgtaagccaaatccggccgagtcaacgtgaggtactgtagggcgccagcgatgctcctgtactctgaaggatcggcaacaggcaggccgtcggtggcggagagcttggcacgagtgtccactggtgtcgatgtagaatggcactcggccatgccggcccggtgaagaagatccacagcgtactagcgctgcgagaggaagaggccggcggaggagcgcgtcacagagatgccgaggaagaagtggaggtcaccaaggtctgtcatggcgaactcggagcggaggcgagccataagctgctgaagtagtgacgtggtcgaagcagtgaggatgatgtcgtcgacgtacaacagaagataggcaatatgatctccatctttgtaaacaaagagagatgtatcggacgccgaaggcagaaatcccatctgtcgaatgtacgtggcaaaccgctggtaccacgcacggggagcctgcttgagaccatacagggacttctgcaatagacagacagcatcaggggcagcggggtcaacaaacccggagggttgctgacaatagacggtctcctctaggtgaccatgaagaaacgcattcttcacatccagttgatgaattggccaagcacgggatgcagcgatgctgagaacaacccgtatggtggccggcttgacaaccgggctaaatgtctcgtcgtagtcgatgccatgctgctgcgagtaaccacggaccacccaacgggccttgtgacgagcaagagtgccatcagagtggaacttatgcttgaatatccacttgcccgtcacaatgttggccccaggggggcgaggaacgagacgccaagtgccgttgtcaaccaacgccttgtactcatcagccatggcagtgcgccagttgggatcagccaacgcactgcgataattggccggaacaggagaagcagcggtggcgtgggtagccgtgtaggtcagcctgtcaaccggccgtaaggagccagtctgggagcgcgtcaccatggaatgcggctgaggagcagtagccgtgacaaccacattgggtgaagatgatggcgggaccgtcacggtgggccgacgggtgtagacatggcggaatggtgacatggtgccggctcgggtggcaccgaccgacagggcagcgccgatcgaggaggcactgaccaagggcgtgccagctgagcgggcgtcacgtgccgcagggacggtgtcgttcggcaagcgtcggccgaagaggggaacgtacggttgctcaacctccgtggagggagccaccgtaaggcgtcgcggttgctcaacctccgaggagggagccaccgtgagaggtcgcggttgctcaacctctgatgagggagccaccgctggagggagtccctgcaacaaaaaatcaaaagacgagggagcagggggagttgccgcgaagggaaatcgtgattcgtcaaacacgacgtggcacaaaatgatgatgcggcgagtggagagatccagacatcggtatcccttgtgggaggccgggtacccaagaaaaacgcaaactgtcgaacgaggggcaagcttatgtggagtcgtggcactcaagtttgggtaacaaagacagccaaagacgcgaaggtgggagtagtctggggtggtgcgatgtaggagctgaaaaggtagtgagtggtgaacagaggaggagggtctccggttgagaaggtaggtggcggtggcgagagcctcagcccagtaggaaggaggcatagaggcctgtataagaagggtgcgtatggagttgttcatggtgcggagcatccgttaggctttaccattttggggagaggtgtaaaggcaagagagtcgtagctgggtgccacgactagtaagaaaggaagtggtggctgtattgacaaactctctgccattatcagcctgaagggttttgagtggtaagccaaattgggtggaaacatactcggcaaactcaacaagatgacgatgaacatcagatttgtgtcggagtggaaaggtccaacagaaatgactgaaatcatcaagcaccactaaataatatttaaaacccgaagtactcaacaccggagaggtccatacatcgcaatggacaagctcaaagggagcgaaagtgcgagacaaagacctatcgaaaggtaatcgggtatgtttgcctaactgacacacatgacataaagaggtgtctattttattacaggaaatagaggacatattccgaagactgtggatggcggctggaccagggtgactgagacgacggtgccaaagcgtggaagaagtggcgagggagcaggacgcggtgttggagggagtggcagctggaagggtgtagagttccccgtgactattgcagcgaagaatcacgcgccgggtctgaaggtccttaacagagaaaccaaattcatcaaactcaatggaacatttattgtcgcgggtaaactgacgaactgaaagtaaattacgaactaaggaaggggcgacaaggatgtttttgagtgcaaatttggtggttcctatgggtagaaaagaggtgccacgacaagtaacgggaatagtttgaccatttccaacagtaataaaagtgtaagagttaggcaagcgtgtaacgaggataccatcagtggaggacatatgagatgtcgcgccggtgtccaaaacccagttgtttgggctttggaaggccatctggttcagtgctgcaatgaggccagcttgctcccaattgggctggcctgtaggagcagatgtgggcgacacaaatggcccagcatatgtggtattggcctgggagtagtgggccgtcggagccggcccaagaaggccggccgaagaggggcgccaggcctgttgctgggccggccaggggttaaaacaaacccaaggcccggccagcctccagctagggttggccacccagccggtcgaactccctccagcagagaagccgccgccaccagaggaaacgccgccgccaccgccgccagagaaggcctggcgagcgccaccaccacccccactgccgccgccgttccctcctccatttccaccgccacgtccaccatttcccttgcggttgcggcggttcgtgttgccgccggtgcgggcctggccagcagggaagccgccgccaccagtcccaccgcccgggaaggtctggcgtgcgccgccaccactcccactgccgccacccccaccgccagaggagatgcagccgccgggagggcaggaaccggagccgaagccgccgctggccaccagcgccgtggctgccgccaccctggcttcgttggcgatgcgcaactccttcagcaggagggtgttgcgcgctgaggtgaagcttgggaggacggctgcgccggcgatgttatctccggtgttggagaagcgctcgttcaggcctcggaggaggttaagcacgagttgggattcggtgacggcgtggccgacgtcgcgaagagcgtcggcagcggtctccatcttctggcagtaatcgtcgatggaggagtcgccttgaatcatggagtgaaactggtggctgaggaagatcgctcgaggctctttgttggcgtggaacatgtcctcgatggcgacccagagctcccgcgcggtctgatcgggctccatggcgaggtcaaggacgttgtcggcgactgacccgaagatccagctgcggatgcagcagtcggcctgttcccaagccgggtcattggggcgtggaggagcggaaccgtcgatgtgagccatcaacccgaacttgccgcacaaagatgtgaagaaggccctccatttgttgtagttcgggtgggtgttttctagggtgatggggacgtgggatttgacggcgaccgtggcgtaggggtggaggaattcgctggtggtgctggaagaagaagaaccactcgaggccgaggaggtggaggactgagttgattcagtcgacatggctgggatgcagctgtgatggcagcgtgctagagcagcggaaaagaaggtaagagcctaggctctgataccatgtagagaaagtggaatagatgcctcaccaatgtggggaggtgaactctcatatatatatagcagaattacaatcaatactagggagttacataagaccaaaggtctaggagagtaactatctaggagtgtaaaagtttaggagataaacagcctatagattaataaataatcctaatataatccttaagctaagagggaagataggagcaactagatgttggctgattacaaacaattgtttgtttgaccttctgaagatttcataatcaaggaataaatttgatttatttatgtttttcaatgaaattatttatgttcgaatgctatggtgcaaatccattatgagaagaaactggtttagaaagtgatacgtttctctattccttgctaaagcaacatggaaaggactgtaggcttcagacctctccaactcatagaacatgccagagaaaagaaacacttaaaggaaatacttgcataaaatcgaatggtcataaatgtgtacagcatggaatggggaagcagcttttgcctgttgatactacaaccaaaatgtaaggaaactgaactttgagacaaaactcgatctgtctactgagaaaaaaaagtagtataataagcatgacggaaaaatatcaaatcgtaataagcgttctacatggtgcagaacatagaagatgacaaaatccatgttttgtgcaaaattcttctttggtagaaattaaggagatctgaatttgtatttcactcgacagaaatgaaatgaggacatatagcattagcaagacacagggcaacaactttttttttttagataatggattaaaaacccggcctctacaacagggcaacaactacaagcaaccctgcggaaaaagcttccccaaggcagattgctgcttaagtgataatgccttacaacctgcttcatcgcatatttgcagcacaaactactacaagtagcagactttggcatatgaaaagattttttttgtcctttgagaaatgtttcctatgaaagagagaattttcttcttaatacatgtacagcacatataaggctgtactcatgaatcatgatcaaagcattcaagatgccaaaacacgactatggcttttagttcatccctacatgagttaccaagaacactacggcacgataattaaatttacgattacaatctagcaaaggaaagcacaagaaaccacacggattgaaattcaagaaaacactagtgcccaatacttgtaagataacagaaagaaaaatatccatcctctacgtcaaaagattacgcaggcacacaacccaacattaccatcagaatctccttacctcgaaattcagcaagaaaggaccactagttccccacaagctagcaacggaaagaaacgtagatgagattatgagaaaacaagagcacaaccggttgataaccacaaggattaaagtgcatgttattgccagcgattctgagagctggcacgtgaaggttaagggaacttttgaccacgccagccatgcacaggaaagaggagaaagctttaaatagacgttaagaatgtcaatgagcacgagaatgagggaagaacaagtggaaattaactgccggctacaattaataattgctttgccagattaaatcaaatcttgtgcaaaggaaacggagagaaatgtgtagtagtaactaggatcattgctttgagcggttaattaccatcgacttcaattttaaagcaataacgaaattaattatcaaagcacggggtgagaaagaattaaattcccatgaaaacgtttgcttgctgctgaaccatccatgcgtaaagcaagccaaaaatcacggaacaaaactgacgtgaacttgtaaccggtggaaggcaaagcgttcgaaacgaaaaggggataatccaatgaagaaactgaaaattttaaaatccctcggggaaggaaaaaagaaaacaagaataccaccgaatcctcagacaacatagaacaaggca

SEQ ID NO: 13636 - DNA, 3997 bp, Oryza sativa
ggggatttttatacaggttcaggcccccgaattatcaggtaatgaccctacatcctgttggccgaaatcggtgttgctctttattcatctggatcacacaagtacaatatttgaggtagcatatctaactgttgtcgacatggcggtctgaaggtctgactcgtagtcgacaacagggtagcatttctcctcgaatccgcatccggcgagatcagagacagtgctatatctctcctgacggtatccgtaggctccgtaggggactagccatgcctgtctctgaagtcgatatctgtcgtcttgtcttggcgtatgttggcttgtatgttgtggcttctgttgttccgtgtcccctctcctcctagggggccttgtatttatacccataggtgtcgccttgtccaaatagaactagaaaaaccaatatggatacaatccgagtagtccttgtcgtttccatgtagaactcagttgtctttccttatccggaactccatccatatccgaaggttgtttccgtataagacattgtatgtggtgggtcctaccgagatttagtcaactgctattaggtatgtggtatccataaccctgacaatatgattatattatatcaaaagaaaaacatatgtttcaaaccgttaaaactaaatgtttcatacatgacagtgatatgtttcaatgtgcgtctgcagtgtgttttacaaaactcctgatactacctgctactactctctcactcctctctctctccacttcatccatgcacacatgcatgtattttagcaagcttcaaaatgatttttctcaaaaattacttatccaatatatgatccgattagaccattgtattcgttttaattaaatctttataacaacatatcgcatgacttgttgtttcatacgtggcagcgacatgtttcaacatgtatcttcaccatgtttcataaaatatttaaatgtttcagttgctgattttttttttcaccatatataacttaatgtttcacttgttggtcaactgcaacatttgaccgtctgattttttgaggagcatcggacgtccgatgggtagctttctccctttaggtctctcactttgtcaccgagtcttagattcgatcctggaccacaatacccagttctcttctccaacaaaattagataaaattttggatacttgtggcagtctttttaaactgctaaacggtgtgtttcgtgcgaaaactttctatacgaaagttgctttaaaatatcgaattaatatatttttttcaagtttgtaatagttataactcaattaatcatacgttaataccacatcgttttgcgtaaaacactaaatcttcatctccaaaagaaaagaacaccacccgtgtaaagatctttatggcgggtccctcaactccccaaaccaatgtaaagatcccaaggtgatttggacgacggtttcggctgacgtggcacctatgtggtgttgacaaagtcagataaaaccgtggggacccacatgtcagtgagggttcaattaaaaataaaaaagttgcagtgggacccacgtacgtagtggagtgatctctacaaggaggtggccggagggaggtgatggggtgcaccgtcgtgtcatgctgcttatcgtttgtcgtggtggagcttgttgtcgttcgcggtgccaccgctaggagaaaggagatggacgagctccacacctaggtcgacatcgtgaggaggggctgaccccctggtcagcaacaaggcggacggaagactggtgtaggtcggtacggcagtatagattaggagacccaagacgaccacggcggctgctagcgtagccggttggagccagtgttggtgagctgggcggcaacccagatctagagcctgttgagggaggctctgcggaggggatgtgctaggggtccagggcacgccgaccacggtgaagtgactcatgggtgcatgcgaagatcgataggtgtgctatttttgttaattcaaatctctcagttcactcgtggccgttgacatgtggagcatcgcatggtggttctcgatgacggaggtgggtgaatccaccgtcgcggccccagcaaccccaccaccaccacttgaggaggcggcggaggaccataggggaacagttgtactgatagagtacttgtggggacccccggttttatacaccggtaatcccatgtgtcatacagtgccactccctggatcagtaggtggtacacacatagcacaatataatatcacaactgacatcgtttacatgtatttctacaataaaaatacaagggtaatctcattgggtcccgaaatagaccaagcatggtcacttacaatacaaaatgccaaagcaatagatagaacagcggaagcgaagcagcggcggtccatcgaactccacaagcaacgactggtgaacctatggtccctaatccatcatcttcaacatgtacttggcagcaacatggcataaatctaatcgacgccaactcctttctaaaagatttaattaagcaagagtgagtacatgcgtactcagcaagccaccactaagaaatgaatctagtgcacacaggggttcaaggatggcttggtttatttgcataaagctagttttcacaatccatttaacaaacctacgacatagcagttttaactgaaaaacaatgttaatgttgaagttgtaattacctagggttcatccacctctccaagcctcgcttggttcggtttaccctcacatttcatcttatatcaactctactatactaacattcccactctttgggcaaggttcacatgtctcttatatttactctaagtaggatcaaaatctatgagtctagtcaagggtattagccgcgagcacggctattcgaatagattggtttactcacactgcagtggatgtacgcttttaatcccacactccgtgacgcacccagcacatgagacttgtcacggctcgatttttcagttacccttgcatggcggcacccgctccaaggactatgaatccccattgcacccccggcgccacattcctccctcgagccggttgtgaggggagtcctggcgctcccaagatcagagattacattatacatatatatagttttgacgtcattaaaccacatacttccacatttccataccaatgtccagaacctaccatgtctggggtgccaccccacgagaataacctagtccaccgggtctaaccccgctcaagaagtgtggtcgtactcggttcgtttcctgcttagcttcttgactcggtccttaactgagcagggtcggcgactagccgttttcagaaccacccatattctatccatgccaccccagtcgaaattattttggttttattaagttttcgggtttcgcaaaggttttcatgttatgggtggcgcttatgtctccacccaattcccaataatcactcccatcgagtgatcagtataaccacatccacatattccacatatggagtgtaaaacgtctatgtaagcagggctaagcagtaagtaaataatcacgtgtaacgtaatagacccaggtaacaaaggtatgtaaatacataaggataacaatatcaaaggtaggcttaaacaattgtagtaattttataattagcatgcaattttatttgtaatcaacacatttataaaaataggatcaacatgttcaaggagggtgcgtagtgacttgccttgctatcggtcctaatgtcttcgagataattgctccagttagataactagaattcccacgatcgaagaataaccgggtattcgcgctcgataaacggtaaataaaccacacacaatcctaaaagaattaaaataaagcaacattcaatacaactaatggtgccgttaaatagatctcgattttagagagattaccgaagttgaacggagttgatgggaattacagttggaaagatatgaatttttgaagttgggaagggcttataaac

SEQ ID NO: 13637 - DNA, 3788 bp, Oryza sativa
gtgtggcggcggcctagcacagtgggggaggagggaccggcgtctgggtgacggcaggcggcctggcacggttggccggtgtgagggagggagggaaggcctgtggtgggaggggcgacggcctggggcgtcgtcttggaggcggcggtggtgaaactggagtggaggttcggcggtgaggagatggagaccggcgatgggaggcagtggagatggaggggagggccggctgtgatggggacggagagggggcggtcgatcggcatggcgccatggtggagggaggcgacaaggcgacggctgattcggtcaaggcgtcgcggctgcggaggtgaccgtacgtcggcgctcggcccggcgccatggcggcttgggtcgggcgaagacggcggtgtaggttaggaggagaaacaatgatgccgcgcgtatggcagggacgatggcgcggccactcggcggcgtcctgggcgaggccaagacgtcggggggcagcggccggacgtgtcggcgcaggcgatggcctagcgacggcgcggcggcagccaggctaggctactaggcggcgcggccgggcgcgtgggagagggttggtgtagtggcaggggagtgacggtgcgcggtccggctaggcgtcggccacgcaaggaggtggcgacggtgcgcacgatggtggcaccgcgccgagacggcgacaagtgagtgggaaaacagagagagggcggtcgacaaaactaggaaagggagagcatggaagggaagggggaagatgctcacattgcggtagccgagtagcggcacaccgtgcgtggtcgacgggcgtcgacaaccggctcgcggatcatcctaggcttgctgttcgtcctcgcacaccatgtgttcgatcgtcgtcaaccaaaggaatacataatgctaagggacaacgtcagcgggttagtgcaaggtaagagttagggagttagaagttagcgaaacggaaagtaaaggagtcagcgggttagtgagttaggggttagcgaatccaaaaagaaagagttagagagtcagaggttagcgaaactgaaaatggaagagtcagtgaaacagaaagaaaaaggttagctggttagtgagtcaagggttagatgttaaagttagtcgttctcgggtgatcaatggtgcggcagcctatccgtcctcttgctcaactgaggcccagccggagccggccgcggcggagcaaatggagggatggcagcttgtgcacgggactgaggagtgcagtggcagagctcgagcgtggaggtggagaagaaatggagaggagccgagctgctgctgtctttggtggggtttatataggtttgctggctgcctgtgcatgggaggcgatgtgagggtgggcagggagcagtgccaaaacgtcgacatcgccacactaccaggtacgcatggcccatcgtacttggctttgccacctttcggtgtgatcttggcgttgcccttctcagtgaacttggttctgtggttgcatgtatttggtggagggttttgtggattgggttcatggtgaatgtattgctgctgttggggagggctccagggcatttgatggctgtgaatgtttggtgcaagactctgtgttgtgccggcaaaagtgggtgtgaaaccctgttgtggcttgtgggcaatttatcgaacatgttctgtgcatgctgctgttctgagggaggcaaaatagacttctggtggttggctgagaaagagagcatgagtggctgccaggtcggctggggagggaatacagactttggctgaggaggttgcttggttggctgcagctctgagcttagggaggcaaaacagacttgttgtgagatgagctgggctgacagggaagggaggtagcctggttgcaataggaacttttgcatattgcagggattgaattggaatgacatactatgtattaatgcaacttgtaatttggactgtatttatattttggaatgtataatctggacatttatttggctctgtacatcggactgtgcttgtatggtactatggagtgtatggttgtgttcggtatagaaattccgttatgcacaaggattgaatgattggactgcaatacgaggtttggtatttacggaacctgcattgccaaataggaatctaggcttaacgcctgacgaacgaattcatcggtcgtcatagattattttgagaatgctcgtacgaacgaacgacagtagtgaattaaggatttttagggacgacgtgtggcatacaaatccaatcatcgtggtaggaatagatttgaggatattcaaatcaatgtacgataaataaatacgtcgatcgtttgtagatattcgagggaattatcgagtcggaatgatataacggtttgaaataaccggagggtaaaaattgagaaagatatgtcgtgttgtgacataagggaaggttttcgggttatatattcaggtctgtgatttgtttagtaccgaagcacttaataaatcagaccgtgaaacaagggaaggaaaggacgttggactgagggcgtccctttaagagataagatttaatcgagatctttggcacacaacctaaatacacacaaatgcataataaatcctagcatgcaaaaaggttttaaaaagatttttgattattccgaatttttaatttcgtattttagaatcgaaattttcagggtgttacagtactccaagcccaccaccaccgcgacggaagatgccatggcaagaggaggagagagatcaaaacaccaaactagttgctgttgtggcagccgtccttcaccatcccgcttgaccccatactcgttggggtggcacgccatcataaatttcacgactgacagtgacctggtccttaaatcgcccgacgagagagtgtgcagtggggagagcagtggcagtgagcgaccaggcgcacaagtgtggaaccaacctcgcgagccacgctcggagcccaccgcggttcctcctcgccgcctccacctctgtgtcggttgtgtcccgacgatgatgccagtgacatgttgttctcgtcatcttcccctcacctcgtcatcccgattctcaccttcctttttgtccacctcgccaccgccatcattagagtccgtgggcggggaaggtcttcgtcgatggtcactgtcagtgtccttcctccttcgagctagcttctcctaccagttgccattctcctaaccactcgccgctggccttctcctcaccgctcaccgcctggtgagatgggaacaggggaggaagagagagataggtgaagaggtcttgatgggcccacactgactcggtactattgatttggatgtcacgtcaaacaaaaccacccgctatactatcatgggacctacattgcatcagttttgacaattgagggactcggtgtatatggtatttctgttgaaggatgaaaatcgaacttgctgtcaagttaagggactaaaatgaacttattccttatttttatagtttgtgtaaatttcacaaaactatagatattttaaccaaattattgcaaaactatttaaggtattgtgttacaaagcagcacattagggctaattttatcataaaaggctaatgccataaaactacatatttaatagagtaaattgcgtgttgggccacaaattcttaccaaagtttcacttttgaccaccctttgttttttttaaaaaaaataggctaggtttttttgccaaatgtatcactttggaccggttggctcatatatcgatgagactataa

SEQ ID NO: 13638 - DNA, 4677 bp, Oryza sativa
  unsure (1)..(4677): unsure at all n locations
ctgtaatgggatctaaattggacggttttgtacagtttaagagtgaagatttctggttttgcggttaagggacgtcaaaaaaaaatctcgctgttaagtttgagggatctccggtggacttattccgcgtactgaaccttccgactcaacgggctcgaaggcccaaaacgccgctcaaaacggggctccaaggccaaaaattccgcggagagcagctggcggccgtccccgttcgcgtcgcatcgcagcgcagcgtacgcgtgcgtggtgtgtgccgtgccctggtggtggtggagccagccagaattcaagctcgagggcgaggggcgaatcaatccgccacaccgcaccgcatagtgccgcgtcgcgccgcggccgcggggctccagatccggagccgtacgtataacccccctcactcacaacacaacacaccctctcctctctactgttccgccacaagaccccagggcgccgccgccaccgccaccaactcactgggtgagccgccgcggccctaaaccctagcccagcgcgcgcctctcctcctcctcctactccccccatggccgcgccgcaggcttccccgtcgccctccgcgcaagtggtaagctgcttcggtcccctgtctctctgtggttgcgagatttggaggggggtttttctcgccgtggttccgtgctgatctgcaatggcgggggggactgggtgctctctctgcaggtgggcaacgcgttcgtgcagcagtactaccagatcctgcaccagtcgccggatctggtgtaccggttctaccaggacgccagccgcctcggccgcccgcccgccgaccgttacggcgacatggtctccgtcaccaccatggaggtcagcccccgccgcctccagatctggcgccgccgcgaggcggaggcctccatttctgacgatttttttttaattttctggttgggatggtgacacgaagatgggggggtttttggtgtggttccgcaggcgatcaacgagaagatcatggccatggacatgtcgcgggcggagatcaagacggtggattcgcaggagtcgctcggcggcggcgtcaccgtgcttgtcaccggccacctcaccgtccgcgacggcgtgtgccgtgaattctcccagtccttcttcctggcgccgcaggagaagggctactttgtgctcaacgacatgttccgctacgtcggggacggccctacccctgctgctgctgctgctgcggaggtgcagcccgaggcagatgccgtggctccacccctggctaatggtacagctactgctcctctgcagcctgctgctcctgactatggtgtgtttggtgaaacccttaaactctatatagctttttgggggaattagattgtgatatcgatttgttttcccccgttttgtagatgctatgccgcacgaggagccggatgttgtggagaatgtggcggtgcctcctgaggaggaggaggaggtttataatccgcctctggaggaggtggagggtggggctgtggaagaggaacaatcagttcctgaggtgattaatgaagtcccaaataatgtggtgcccgttgtagctcctgcagatgctccggtgtcacacgaggaggcgccaaagaagtcatatgcctcaattgtaggtttcacaaaagcaactttctcaaatttcgagctgtattttgcttataaatttatatctaatcatgaatggtgttttaactgttttattccatatgatttgcaattgtgaaatgcacactgctactctgtaagctactccactccaaatgtgtagttatgcacaaacttttactccctccgggctgataatacttgtcgttttggacaagggtgaagtcaaactttagaatatttgattatgaatcatttttaaaatatttatctttcaaatatggtgactacatgtatagattagtcttaaaaagtactttataagatcatatatttgctaacaattttatacatattataatgaaaaataattgtcaaagttgttcttcgaacaccgtggcctcgtgcncgacgacaagtattatcaacccggagggagtagtagcttagcgtaccactgcactaaatattctgtagtcttatgaggtgcttcttattgacaagtttttatgtgatgtcatccatacactagatctagactgattttgtgcattataatgttttgtcttgatgtcgcacaatctgggagcattaatctattgatggttgaccaggaagaggcagtgctaaagttgaaaaattattgtgcttttttaagtgtagtgcttcaaataaatattagtgacagctttcaaataatttgagtagctttttactgttggccatgatggttgtcatcttgtttggtagcaggtgattggattgaaccattgctcaaatcaaatttttgttctgcattctttgttaatggtatcgtattttttcctgtgctgcaggtcaaagtcatgaaagaagctccagtgccagcccctattcctgctactaggcctgcacctgctgctagacctgcacctcccaaacccgagaagcaatctcctgcccctccggctcctgctccagttgcagatgctactccttttagttctaatgctgagagcagcaatacgcatgagccagaaggtattttctacaatcctatgctttgatcaatactctagatatgtcaattctgttagcttctctgaactttggtctttattttgaagttgatgcacatgcgatatacgtgaggagtctaccattaaatgccactacgacacaactggaggatgagttcaagaagtttggcaccataaaacctgatgggattcaagtcaaaagccataaggaacttgtttttttccccttcctctggactttggaaaactatctatgttattctgtctctgaaagtgttgtcaatattttccaatgtaaatgcagattcaagggttctgttatggctttgttgaattcgaggaagctactgcagtccaaagtgctatagaggtagtctttcttagttttgatcattccattttgtcaggttgtttggtgatagtatcaatttgttcatcacacactaattttgatccaatactgtgagcattgttagttcattatcactgcgtgcttttctttagctaccaacagctcttgttgcttgacattatctggtgatgactgcattacatatcatatcttctctaattttgagtaacttgtttttttgttgttgagtggacaccatttatctttacgctgttctgaaaaaaaccattcttttttttttgttccacaactggtctgaaccatgaagcactggtcattgaagagcttagatatgggcaaatttttgtatatgcctgcatgacaacgtaaaatattggatctttccctgagaaactataggtctggctatcactacaacacattgggctgtttaagtattaaacataatattaactcagcaggtaggagagtgcgtgtgaaatggctacctttcacatacacatgtaaaaaaactctccatctgttgctcccattgtaaccaaggttccaaatactgctttgtctggaattatcggtccctggtgaaatctgtactgtatataccagacaaaagttcaagtgctggccagaaaatttctaaatttaaaattttatgtatgagtttgaatcacagccatccagccagtaaccaatcaccccctggttctggaccagtttctggccagcttttggaaccttgggaacaactggaaaatattgctgtggctaaaactattttagaatcccatctgctaactttttgagaaattgctggaattattctgaatatccaattaaggagataaaattgcttattttggctaatgaatggttaattgtgatttgtgggataacagttatttttaacttaaaatcatttatttggaacccttaatttatatttttattggagtttttttcatatttctttactagattaataatccaggtgtaattagggatgtgtgggatcttctctttccaaagaactggtgagcattttttttaaaaaaaatgttttcatgtgttgtggcaaatgaattccatttttggagagctgaaccaaagttttggtgtattgtcaatcccaacattatagttattgtcattgttagcttcgtagatattgctctacgttacataatgtttccactgcattccacccaatggatcagaattatttgttgtgaattctgtaattttgttctcagttcccgatgttgtctggatcctactctgagtttgtattgttcaggttgagctaatcatatcaattcaattgcttccatgatttgctttcaagtttccttaacccttcaacaaaggatatcacttgttatgtgcagtcatgctctgttgccagtatcattgtgtggtgactttgatgtggtttacctttttttacttggtcactgagtattatatacatgcatcaaattctaattgtttttaacttcacacaggcttctcctgtaatgattggtggacgccaatgttttgtcgaggagaagagaacacctggttcacgaggtcagtgcaacagaacactacaagtttatttcttttttcgagttattgtaagtgtagcattggagcatactt

SEQ ID NO: 13639 - DNA, 14491 bp, Oryza sativa
cttcatcaattgattgcaagctggaattgtcaagcccattttacaaattatgaggttctatttttgaaggcggcaaaaggggttaaattggttgctaattgtagaatatacacctattcacatgtagtcttagcttggtctttgatgatcagctgatgggttattttttttctttttgtgttaattttgtcccgtttaagtttggagcattcatttgttgtgtccatttgattttatagttactacgaactgctgaaaatttgattttatagttactacgaactgctgaaataattgatagtttagactctagagtagctggtaaagtagtaattaggagagattttgtcttgttcttgtgatgtcttgaggcgaaggacactcttattgatactagtttgatactggtttatttaattttcgaggaatttaccctgtgcgctttggtcttgttggcactgctattccctcgattgcaattttgctggaggactggtagcgaaccaagtaaatatgcagtcgttgacagtctatcgagttgattagaagatattggttctctgtttggagggtgcaagctatctaaatgaaatggtcgattagaagatactggttcgaggtctgatttgaaggtgccaaggtagtaattccgatcatagcttttgttttatgaattactactgtctaaatgagatctctttggcaggtgccaaggtagatactaggaattttgggatctaagcaaagcccagcggatgaatgattggacaccatgtcaccatgtaatgtcttcactctgcacctccgttcatctcatcaactttgcctaccatttaacttgctacctcgtctcctctaagtcaggcttcctaatcctaggttccatgaggtcataagcatggttttctgtaaaagggaaatattttaagacaggtgttctattgtttttttaaaaaaaagactcatggatggtttagtacaaagtaggtttatctactcattagtttggtgaaaaaacctactcacataaaagaacgagcatcaatgggctctaaggaggagttgaagataaggttatcaaaatcttgtatctattatacgactttataatcctgattaaggtgcttgtttttataattttatataagtagaattacgattctatgtttctaatcctaactacaacctcggattcggattcaggtcgcgattttaatgaccatggttggagaaaaagaaatcatatacctccatgctattagaaaagtgatggaagatactaaggtaacaaataaattaacctaagtatcattattgtgaaccattatttcaaaaaaatagcatgcattggtgaacattaaaaaaaaatcaaatcctatatgatgctgtcttattagttttgtttaatttttctttcacaaaacatgctcctttgaccaatattgatactaatgttgcgttcggcagctgaagaaagtgagtgagtttgtttcgatttctgagcgcacgcttcccaaactactaaacggtgtattttttgtaaaaattttctataggaaagttgctttaaaaaatcatattaatctatttttaaatttaaaatagttaatacttaattaatcatgcgctaatggctcaccttgttttgcgcatcttcccaatcttctcaatctcctcctcctcaaactcaccctaagtgcattcacaatgcaggctacgtattcgagagacccaagacagtagtttgatctagaaccattgtagaaaataggctccacactgcatgtggtcttaaataggacccaaacaaatatcaaaatcctcttaaaatgaacttaaatagaacccaaacaaatatcaaaatactctcaaaaggaacttagcctacaacggtggtgtcccagtcaaagggtcaacaacaaattggatcaaattcccccaactaccccgcttctcattaagtcttttccgcttcctaccacgcttctcatcaagttttctccacttcctccgcccacatcgctcatcgccgttggggcaggagccgctgtgctagttgctagtcaccgcggcagtaagactaagggagtggatagagttggagtccaagaggcgcgggtacggcacgagagccatgacctgcttccccttctctctcttttcctctacgccatcatcgccattccctctggatcctcctcttatccttctcgattgctccacctccatagtaggcggcaacatcacgacggtggaggggaagctatcggagctctccaccaataacagcatcgataaggttatccacaggaaggtcaagataagctgtattcagttccctcccctcatgtgccacttcatgcatttttcccatggctacaccattgtttgtgatttgtggaatggttgtgattgaccgacggtgaatctccgtacaagcaatctccccctccctgatggtgacgagcaaagcggcgcaggaggggggaaacctggtgcacgggaggggctattggggaaacgcttgctttgcatgggcaaaaccacgattcgacaaagctccgacctccacaacgtggtgccacgctcctcttcttgctctgcacatccttgttcagcttgaacaatatgtgaccaatttcggttacgcggtcttcatggggctccgcggcttgaagagatggcgacaaatacctggttcctagcacttgggccaaacgacaatcggcgcatcatgagcaccctaatacaaccatgtttctagtagtgagtgaaaaatatgttagggtgttagtattgtgttgggacttaaatgaaggtggggtgctaaaagcaatcattttctagttttttcgtgttttagcttccaaatttaacaccgctacattcgtttaaaaaaaaattctaaaaaaaaagagagatggaagtgtaaaaccctaaacccaaaaccagaggaagcgacgccactctttccaccttttccgtcccttctccccaacgtttcctcctccgcccctctcccattccatccatggcggagcaagagcaagagcaacagatggattgggaatagaatcaatcgctcgcagcaacaacgcgatcgccgattccaagtttccactcccggaggaggaggaggaggaggaggcggcgattccaatctagattgcgagggggctggtcagcagcaggaggagtagggggagggcaagatgagcacggtggacaagatgctgatcaaggggatccggagcttcgatccggagaacaagaacgtcatcaccttcttcaagcccctcaccctcatcgttggccccaacggcgccggcaaaaccgtgagcgccccaatccaatctctttcccctagcatctgtagtgtgcgcgtgtactgatttttattttttgggtttttttgcttggtttctgtcctccctgcagacgatcatcgagtgcctgaagctctcctgcaccggcgagctgcccccgaactcccgctccggccacaccttcgtgcacgaccccaaggtgagacacacgcgcggcttcagtgttcgtcctcaccatgggctcggggttgagtcgtaggggttttgctgcatttcgggaacaatggtgtgattaatcttgttagtaaggtctattgggggtacccagttcacggtggtttgatagcagtcgtatcgaacaggggttgatgcttttatgatttgtatcttggtggagcgatggattgatgcaattgagggatctcgaatgcctatggaggtgcagtgtgctgtgctattgtgccagggaatgggcttgaaatgaatgatggttattgtggactgaagctgcttcaaggttgttggcataattttctgccaggagttcttttacattacttgtttctgtgggatgtgcaggtggcaggtgagacggaaacaaaagggcagattaagctgcggtttaagacagcagcaggaaaggatgtggtgtgcatccgctccttccagcttacccagaaggcatcaaaaatggagtttaaagcaattgagagcgtcctccagactataaatccacacacgggcgaggtcctcagacttattgtttccccttttgcttccaagttgtttaatatggggccatgcctttgagatttatttatttgattatattgaggcatgggtgtgtttgtttagttacaaaagattcttgaaactccaactgggaaaaataactttgccagcatgtcattggatgatcttgatttggttcagaacacctgtaacccgaaaatgatttctcatgtctattgttgtttgtaactcaaggttcattacaaagctaatattattacatatatcaatcatatgctgtagtttctgttgctatacatgtctctgcctgtaggactttcttgtagtaaatactgtccccatggttgcatacaaagacgtccattattttccttgcactttgtattgtccgtgtcaggtaaacccttgtctcaaatttgagttaagtagatcttagctatgagtctgtggtggttataaatgttttcataaactagaatagccggaagtgcatagttatgtgggaaattttctctcaatttccctttgtattgcataccgattgatattttaattaatagaacaatcagattgcccttatgaaccatgcaacacttctcaaatacatttgatttctttcatttttgatctatttttgtggtcgtagaaaattttcttaggacaccttgtactttctgtgaccacaggtacttagtgtgacattgttgcacataaaaatttgatccatgtgaatctagatgatgggaatttcacacttgtttggttggttctaaataataaatttaaacaaggcaacgggtttgtatcactatggcttcatttggggttgaggtggattatgataaatctcgtttggtaaactgttcttattcaatctaagttggaagcgataatattattgtgttctataaaaatgaaacaattgtgagagatacgatgattgcataacatatttttctaaccattatttgattttttttaaaatagaatgattcttacatttctactacaaatttaaaataagcacagtataatacagcacagccaccacaaattgcgcctaaaggagtactgtatctgttgaacattttaggttacaatgtatattcacagcctaatttgtttttgttattgctgaattcagaaagtctgcctcagctacagatgtgctgatatggatagggagattccagctttaatgggtgtatcaaaggctatactggagaatgttatattcgtgcaccaagatgagtccaattggcctttgcaggatccatcgacacttaagaagaagtttgacgatatcttttctgcgacccggtacttgaatgttttactatttcgtgtttgcttcggaagctctggtcaagagcataaccgttattagttgaaacatgacaatattttgagataaattattctctagagtaatcatcgttattccttgaaatgtcgttatgactagcattggactaccttaatttctgtattgcatgtgcagctataccaaagctctcgaagtcataaaaaaacttcacaaggatcaagcacaggaaatcaagacttttaggttaaagttggagaaccttcagactctaaaagaccaagcatatagggtactctaatcttctgttcaatcattcctgctagactgccattgtatgaaacttttgagttatggtatcgagagttgagttcaacttgtcattgcggaagcacctttgttatttgcttatttgccatgggttgggctatcattttgttctggatctttgaaatgctacaatgtttttctttttttttaaatgattactgatcaactaaaagaaattgaagggattgtatcgttctgtcctgcatttgtgccagaatatatggctaatcagcatattttacctttaattatttgtcataagatgtctgatttatcaacatggtgtcctgctgactttaatgatgttattggtgaagaatgcagaaacaatgtaaatatttggcaattaatgaagtaatttgacagcagacaccattgtaacacatttggtattacttttcacatcaatcacctcccattcaaacttctccccatcttactacgaaccactcccccactccatacatatccttatttaatgggaggcattttgtcttttttctctataattaatttacctcaaataacctagaatcccttgtatttggggatggagggagtatatacatcaagttagatactagttattgtttctatgtgccattcaaagttgtgagaaccagcttttgcatgttcacctgacatccgtagaccctgaaattatttcttaatctattattatatgctacttatgtctcactaacaattgtgtccttgacccacatgtcagcgagacaatgagtgctatataagggatagagtaattgtccatgacccacatgtctcactaacgtaccttttatttttactttaactctcactaattttgacagctccgtgacaatattgctcaagatcaagagaagtcagatgccttaaaaattcaaatggaggaactgagaacaaacgttcaaggtgttgaagacaaaattcgtcgtactgaaaaaagtttagctgacttgaggaggcttcaacaggaaattaactccatacatctgctagaactacatattttacacttcagcagcaacagtatgctgctctttctgaggaaaacgaaggtaagtgactccttggtgtgtcactgtgccttcaggcttcagcccattagttctcaccattacaacaattgactctgtctttgtttagataccgatgatgaactaaaggagtggcaaacgaaatttgaagaaagaatggcattgctgcaaaataagatcagtaaactagaaagagatgtggatgatgaaaatacaacaagctccttcctttccaaggccataaatgatttgatgcgagaaacaggaaggctccaggcagaagctgacgtaatgttatcatcttttatatcttctttttatgattttatcagtcattattaactatagtggacattgttttatggcgttaaaagtttaaagtaacatccaaatatgtggttttcaggctcacatgtcagtgaaacacgaacgggattcagcaatcagaaagatcttcaccaaacataatcttgggccaatacctgatgctcctttaactgatgctgctgccatgcaccttacaaacataactaaagcaaaactgtcaaatcttaatgatgatttgcaggataagaaggtgagaatactgattctatgtattctggaatttaattgctaaagtatacacttttatttttaacttccgctgattataagcttcaaaatcatttccaaaatcaatatgcgtatggagtttagtcatatagcaaatgtgctctattctgcatccacctcataattgtcctgttttggtgtggcatctcagtggacgtatgagttatgtattaaacagtttttgttggaggaagaatgttactgaatctactcaaatcatttgctcaagtaggcagtgaattttatctagttaatattgaacccacctgttcttaaaaagtatgtgctctgacaatgaaaattccgctttatgaccagaaatctaatgaggcacagaaacagtttctgtggggacgctatcttgaagtaaatactcgctactctgaagttgttggccagatagaatctaaggttgcctccaaggttagtcatggaaagaacattggacaagcacaaatatgatcttctgcaactatctcagaagaaattgtatttcttcacatatcaataacttttcagaaaggtatttcaaggcgcatgaaagataaagagagtgaacgcgatgccgcggaaatggacctttcaaagtacaatcttccccgtattgatgaaaaggagagacatctggtactttcctgatccaattatctttagttcttggaaacatccatatatgtggctgcacttttcttgttacatttttatcagaagtagaaataaatgtcacaggctcacagcattagacagtttgagcattgcacccttaggcgttggctcatatttttctccacatgctttgatgtcttaaagtatgccatcattcttaattctgatgaaagtattttttttgagaataataactgattcatcccatcttaattttggatagcaaattgaagttgaaaggaaagcacttgcgctgggagaaaggaactatgattcaattgtaaatcagaagcgcacagagatatttagcttggaccagaagataaaaacacttcagtgggaaaaagacagcattattagtgattccaatgacagggtactactagacgtgaagaaggatgaattggaagaaagcaagaagaaacttaaaaagatgcatgtttcttcctctctccttttataaccctacttattttatgattcacttttttatatttcccaatcttaaatcttgctgtgtgagaagttcaagtagcacatactgtgtaaaatgcagatttgatgagcataaggacaaaatcagaattgtgtttaaagggaggactccttctgagaaggaagtcaagaaggaacttagtcaagcctttgggtatgtgctactctgtttttcttatatttgtttcaaccagcgatcagtgattcctttgttggttgctgtgatcagttcagttcacctgtgtcatttgtcaagctgtagtttgaaaaagttatctcttccatcaattgacctcatttctgcatttttatcagtgggctactgatagctagtagtagtaatagcagtatctgactatctgtagtcatgcatattttgatcaatcatgcacaccatgagctgatgtacattcaatgcaagtgcagtagcgtacatgataattttaaacataaccgtgtagttgtatgtatatggctgttcattaatgctgggatgattagtcctgtgcacacgaactatcatgtttatgccaattcatcctaatagtagatgtgagaataatacatatgaagtcctctagttgttatttatgcatttagtaatggtacaaaactctgcttggctcaggtctgtagacagagaatacaatgatttgaactcaaaatcccaggaagcagcgcaagagctgaaactggtacagatgaaaatacttgatgctaggagccacttgtcaaagcttcaaaaggaattggatggtaaattcagatattactcccgtacatttatacttacgtaatggcgtgattttatgtgaaatattttgatatctaaaagatccactatggtgtgggatttgaacaaataactttggagaggagtcggttatacgtctccttgaattttcaagtgcaaatgtaccatatttttctcattgctatttttaaacaatggcggatttcctacgaactatgtatattgcatgcatttgatatttatttttttatctttaggctaacctagcacattcctatccaaataaaggaaaatatgtgaaaaatactgataaatttaattagtggaacttaggatgttacaatcataaactaacggagttagattacttttgatcagattggcctgttgttatgggcagaactcagcccctctcattattagataaggttgttaggctttattagataaggctgtaggaggtttgttaggttttattagataaggttgttaggatgtttgttaggagccggctctatataaggagaggcaccagtcatgtggaattaatcaagaaagaagttaaacctatctctagtctcccctcttctctgttcgacctcacccaaactctggggcggcaaggctgcaggcctcgccttcccgttgagcaccccaattcattcctccacataacatccaccccaccacgccattcaccatgcctgccatccatgacctccacatgctgcgccaatcctccagggccatgcagacctccatcacggagatcacagctgggctcgacaaggtgacagaattggtgttggcactccgtgcggttttgaggccaagggggtggcgttggaaactacgacgacaacgccctctccgccactcgcgacggcaccgccttctctgccatcgtccctgttcgcggctgcggtggaggaaccggtgatgacgatgccctcttcaccgccatcggtccaatcggcggaggtgctgcagcccctggctgtagtgccattttctcagttgtcgttcgcatccgaggctgcggcagtgctgtcacacctcacaacagtccggtcggcgctcgctggggcaccatcaactcagccatcgccatggaagaccatcgtgtcgcgtcgtcaccgttcccttctgcgaccacagcagcagcgagggatcttccagcagcttcctcgagcggcggctgcgattacgctgagcgttgctcgacgacggggagcatcacgtgcggcgccaacggcgtgggatccaggcgggccacgcgcgccgggaaagggggcgcagctgctgcagcacagcgtgagcaacacgcgtgtcaacctcctgggggtggcgccgtctacatgagcagcaggtgtgccacgagagtcggcgcaggaggcagctggttcctcgcgaccccacggcgtcagcccttctcacatgcggctggtgcgcatagccggtacggcgcgtcctcatgcagtgattgcggcatgcacggcgcaagagatgtgacttctggtggcggcgtgagatatgggaacggttcctcgttcgtccctgctgttcggtgggtcaactggaccgtgtctttttggctggtcacgtgatcctctgttgagaagacaagatccatacaacatgtcttgggccaggggctattggagtgggctgcagttgtctaggcaccacacagctttggtctcctttggcaaacatgacagcaagcaggacatttgtggtttttggaacacacagtcacattggtatggcgtccttcctctatgttcttctggatggggcccacctgagcttggcagcagaagaatggcatggaacaccaaaataattttagatttattctttccaaagaatgttaggagccgagatgtaaaaggcttaataataggacatcatgtgaagacaagcttgcagctcgcgggcgagctgcttccgaaggaggagggaaaggggactaggatgacatgggtgatcggcacccctcaacctttaggcatggcttccaccgcagctcgaggacgagctgtctcgaaggagggatggagatgttatgggcagaactcagcccctctcattattagataaggttgtaggaggtttgttaggccttttgttaggatgtttgttaggagctggctctatgtaaggagaggcaccacagtcatgtggaattaattaagaaagaagttaaacctatctctagtctcccctcttctctgtttgaccttacccaagctctggggcggcgaggcctgcagcctcgccttcccgttgagcaccccaattcatccctccacataacacctgtgaccatgccaacatgtgaaatgcaatcgctgttaggattcacatcatttttgcagctcttggcctccattgaggtgagatagtatcagattcttctctcccttggtctctcctcttaacacttggcatagctagctgtggcagtatagctgcagtactgtagttgcagctgcagctagtactagcgagctaggccatggtgtccccattgtgcatgattgctccctgattatgtggtctgcttccttgctgctaccatgatgccagacaaggcaatactggtctatgcagcacttagctcgctctaatcgtctaattaattgcatgtcggatcaaactgggtgtctaggtgttccttccacagatcggtggatgcagttcatgctatgtactcgctctctcttctttagctgtttgtgctcactgaatgtttctttaagtaactgcctttgaccccaaatgagattgatttgtttggttgcatttttgattggatagccaaattggcaggtagttcatgtgattagccttgctgggacattgccttgtactccctccgtttcacaatgtaggactttctagcattgcccacatacatatagatgttaatgaatctaaacacatgcatatgtctagattcattaacatctaaatgaatataggcaatgctagaaagttttacattgtgaaacgaaggaagtaggagataactcatgcattgaggaaatattgttgttgtacatagcgcctttgtggaaggtgtccaagcatctggtagctgccgtgcctcattctttagtactcctatgttagtgcggcggaatttggttggtcatacctgtctaatttactcttttaattgccatcatgttcaaagccaaattgtcctttagactcatcatagttcgttgaataaagctgggactagttctgatctatgcttcacctgaatcatgggtaaatttcttctcaatttgatgacaagaactaatttgattgttttgtctgggcagaaatttagcacactgtacctatatcatcttccaaggttctctcagagatgataataaattaatgttttctcatactgtaaagagaatacaaatattgtcatggaaattaataaagtttttctatggaactaatgaaaggactgctcattcgttttatcttttaagactgtgataagatccattgacacatgtttttctacagcaaagagaagctatgtggagtccaaacttcaatccattacgaagatgtctgctgacattaacatgtttcccaaacatctgaaagatgccatggatgaaagagagaaacaaaaaaagttgatatccataattttagccatttaatttggtctatatatctccttgtgatgtgctaaattcaatgcttcctgcttatatgcagcaatttaagttacgcgaagggaatgcggcaaatgtatgagccttttgaaaatttggctcgtgagctccacatgtgcccttgctgtcaacgtgctttcacacctgatgaagaggatgaatttgtaaagaaggtgcctgatctaataattgatataacatgctgccttttactttgttagagttactttattcatatgagtttttcctaatgtgtctgttgtacctttcagcaaaggacaacgtgtgaaagtactgcagatcgcatgaacaagatctcattggaatgctcaaatgctgaagactttttccagcaattgaataaactcaatgcaacttatgaggaatttgtgaagctgggaaaagaggctatacctctagcagagaagaacttgaaacaacttttggcggatgaaagtgagaaggcacaaacatttgatgatgttagtttcctgttattaacacacaactctgttttagttcccagacataaaagaaatagcagacagtataacctcatgacttaaatgaacttgacttctctggttcaatccaaactgaatatccttgagcttgtatttcgttcctcgtgcccaactcgggcacaattatatcatcccttgccacctcgtgcagtactaaatcagtatatttaatttctttaaaacaaggagttgatctcatactaattgcgactagcctacagcatgctactccctctgtccacaaatataaatgatttggttatatacctggacaagcactcgttcagttacgtagccaaaatcctttatatttgtggacggagagagcatatcttgtttagatggtctgtagttatgtgttgccacctcttctaggccacattggcataaggcttgttttggtgttcttaagctcttcttgattgggcactgtaggatggagtctctcaatgaaatctataaaacacatgtagtttgtggttagctcatgtcatagtcttgtatttaaataagtacttacctttgagaaaatattttaatcatagtatatctgtggtctcatgtgaaatcataactttctttcaattagttacctatgcagataatattgttattgacgaagataatttattatgtataacctatttcgctttgtcttgtttgcattttgatggctttgatctttggagagatgtagttttgtttacagtttccatatgtgatccttcattgcagtttgtcagtgttcttgctcaagttaaaatggacaaggatgcagtgcaggtattgctacagccagttgaaacgattgataggcacgtacaagaaatacagcagttaggaccacaagttgaaaatcttgaatataagcttgatgttcgtggccaaggtgttaaatctttggagcaaatccagttggagttgaactctgtgcagaggacaaggtatttaattctcagaacggag

SEQ ID NO: 13640 - DNA, 2613 bp, Oryza sativa
atactcttgtatcaaaattttaaaaaatggatgtaacatttatatgctgcacaaaatcctcataaatttgagatgtgattgagaattcaaaagtcaatgatcaattgggtgtttttgtgaaacttttggaccataaaacctagggttatgtgtcacatgacaaaatccctgtggttttgggtaacttggaccataataataatagggagagtttaataaaatatactcctatttatttgttgtaatacctcaattccaaggttcatgcttttcagatatatgcccattttggttggatgatataacatatttacatatagtttactggagttatatgttatctgggcaagccacaaagttgctgctatgatgcagtccttctagtttatagccttaagagcatttgatcaatttgataaactcgtatgtaaatactacagtgattttggatgaaatgtaactgagaattttactggctggttatcattgtaccacaatttagtcagcacttgcatcaacctctttccaggaaacgcttgtggttcacttggcttgctattgtttgagtcccggaaatgttgggggtgctttttttatcaatgacatgcttacacttgggcttatgcactatgatgcaacatgtgtataatcggttattgctcaattatgcagcatttaaaggagtctcttggtccgttgtcaaaagaaagagaaagcttgttgcaagagcatgaagctttgaaggaaaagcttgatcaggagtatcatcaactggcagaaagaaaaagggaatcccagcaggaaattgatgcactcgaaacacacaatgagcgtatcaaagggtataaaactcgattgctcctgaattttatttggtccacttctactatctatgtatactcctgaatccttttaggtacctgaattcaaagaagggcgagaagcctaatgaactacagggaaaccatactcagttgcagtctgatctacagaaaagtaaggaaagaaaagaagaaaaatcgcggaggttaagcaagaacaaagagctattgaaaagccaagatcagttgaaaagaaacattgatgacaaccttaatacaggagaacaaaggatgaagtggaacgacttactcatgaaatagaattacttgaggacaaaatactttccattggcagcctgtctactatagaagcggatcttaagcaacattcacaagaaaaagataggcttctttcagaggtattttatatctcatttgaaacaactgacagttgcatctaataagatggcgttcttttatgctctgtttctgtaatcattaacatacaatacgtatggcaatgtatgtatttcttaatgtcatgttcacatgttccagtaatgaatttaaaaggaaattttactcagaagattgtgatcaccctaattctttttggcaacttatgcagtataataggtgtcaaggaacgcagtccgtttatcaaagtaatatttcaaaacacaagcttgaacttaaacagacgcagtacaaggatattgagaagcgatactttaaccaacttcttcaactaagggttgatggcatgaatgtccaggttcattttctttggtttttgatcttgttgcttgatctaatagctgatgtgactgcagacaactgagatggcaaacaaggacttggaccgatactatgctgctttggataagtgagtacgtctcaccatcactatgtgctattatgttctcatttttcttgtagttactccccaagatttaagtaagtgatactgactttctgaacattgttcttttcacttcaataagcaaggtttgaaaaaaagctaagtgagtaagtgatactcatgtggttgcccccctagtattgattatttgattatgcataaccggcaatggaagattgtgtgatctaacctatgtatgccaacaggaagggggcaccagttacatatatatgctctaagaatagaccagtatattgaacactagtaataagaagcatcctttttgttccttgtttaaagatttgccttccttctactatgtattaatagactgaaaatgtcacgtttgtgtcaactgttataaatttccttgtttaaacactgaaattgtttattgccgtatctgttatatcagatttgtcccttataaactgaaaacattgaaatcccatagtcttctctctgccaagaaaattgcgttgctgtcttatgaatctgttttttttttctaattttattagcatgaaattcttatgtagtactccttccgttccatattgatcatgatgtaaccaaaaaacagaaattccaaattgatcatcatataaccctgaccctttcgtttgacgtgtagtattattattgtatttatgcatgcaaattgagtttgcatacagggcatttgggggtggtaaagttcctgtttcttgtgtatgggggaagttaaagtctgcatgtttcttgattttctcccatcatatactcacattaaatgaaatacaaggaagttaatgcttctcttggtcttgatgaaaatacttatgtgatgatcaatatggaatggagggaatacattctatgatgaacata

SEQ ID NO: 13641 - DNA, 1470 bp, Oryza sativa
tttacttgctaaaaattggataatcggattgacatttgaatttactttcatatggctataattttgttactacaaaccttataatatttgagaaattataagacaaagattagttttggggaccgtgtcaagtttgaccatgccttatatcatgggatagagggagtacctacctaatctattaggattagcagttttacttcctttctgaataagatttgcattaagggtataaatacccaataggaggtcataaaaagtttagccaaaccaagtgagaagcatttgcagtcgagtggcttccttccattcggtgctggtcgctaagaagcatttgcagtgttcacccatctgtagaatctagatcaactgtggttattttcactgctagttggtccgatggtgccgtcgacactgttgacccgtcatgcttctacttctctaccacatagtgttgcacactagttggcatgggtccaaggactgagggttgggcgtgccttgattgatcagctatgctgccactaacgttctgagctctggttgataggcgaggagaatagagaacctttgtttattctttgcttcaataattctgagagatgtgttcccttctaaaagagcagcttacaaccaccgagcaaaccagatgagacacgagtatcttcttcaagagagagctagcaaagtatctcgtttcctaaataatggactttgtacttccttggtgcaaagggtcaggggtcagccagcattaccagttcactcctgctgcggcagcaaatgcatgcatcttgtccctttcttttgcttcttccttggtccaagactgttgcccacatggtgcacaaagcccatagcatgtacctacagcttgttgtatgaattattttgaattgcatcctttattttttgtgtaggccttgtatgttgacacatgattagtggagtaggggcttacatcttgggatgactgtgataatagaatatgctcagatgtttgtttttctgctaggaagtttcacccaacttgcattttacaattttgtgtttatattttctgctagggctcttatgcggttccacaccatgaaaatggaggagataaacaaaataatcaaggaactgtggcaacagacatataggggccaagatatcgactatataagcattaattctgactctgagggtgctggcactcgatcatacagctatcgtgtaagttaaattagctaacccttgattaactttcttggattgttcgtcagggttcacttgttttcaacttccttttaggttgtcatgcaaacaggtgatgctgagctggaaatgcgagggcgctgcagtgccggccagaaggtaaattttggcgatgtttatttttcactggtaattcagtcaatttattgacaggtttgctgtcttcttttaagcagtacacctgttggataagtgctagaattattttgt

SEQ ID NO: 13642 - DNA, 1636 bp, Oryza sativa
gattaaattggcaccaaccttgtagttttgtgataaaatttgctacttaatatatagtttggggatacttcattttaaatctgtagttttaaatttgaccctaatatattttttggtgttaaaataccttaaatatatagtttttgtcaagtatatgtagctttatgaaatttactcttaaagtttttttaacactatttaatatataaaactatatatactcctctcatcatctaaaagggttaattttcccatcatatactgtagtcttgtgaacacagcacacctatcacttgtcccgtaataagttcattttttataatcattacattaaaatttgtaaaaatagaaaataactatatgagagtagataaaatgaggaataattatcttgagatttaataaaataggggtattcaagtcattttgattttgtattggtatgatatgtgaaaaataactttttcttaagaaacacagtagccttgtgaacacatgcacacctttcacttgtcccataataagttcatttttgtaatcattgcattgagatttataaaagtagaaaataattgtatttgggatagataatatgaggaataattatctggggatttaataaagtagggtagggatttaataaagtagggtattcgagtctttttgattttgtattggtgtatgcgggataggtgaaaaatgaacattttttttagaaacatagtagccttttgaaggcacacacgttgacaagcacaccttatgagctgactatgggtacatcacctattattttagaattagctgtaaataaaaaacgttatgtctaagacttaaatctgggtaaattgatttcaccataagtatcctaccaagttgagatactttaacctaccgaaggaaacaaaaaagccggagcttacggcgtccacatacggtgtactaaggaataagttcactggaggtccctcaacttaacagcgagattttttgacgtcccttaaccgtaaaaccagaaattttcatccctaaactatacaaaaccatccaattcaggtcccatggcagtagagatgcctggtttcactgacgtggcaccctagtaagcaaataataataataataataataataataataattaataataataataataataataataataatgtggggcccacatgtaagtgagaggaattatcgtgggccccatatctcctctttgttttccttctcttatcttttctccttccctcacttctcttgagctggtgcgacagtggagcgggcaaggggagagagacggccacgcgacggcaccggcaggacggggggagagaagcggccagcgcaaccgcacgcgacggcgagagaggcgggtagcgtgggcatggagcgggcacgccgacccatctgctgggcggcgtgggcagcgcaaagagggggagagaggcggccggcgcgaccactcctgacgacgagagaggcgggcggcacggagcgagtgcgctgtcccatccgccaggcggcgcggagagggggagagaggcggccggcgcccggcgctaccgctcgctccggcgggagatggggagaaaggcgctaccgctcatgacggcgggagagggggaga

SEQ ID NO: 13643 - DNA, 1040 bp, Oryza sativa
  unsure (1)..(1040): unsure at all n locations
gccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcgaggtgcaaccaccaccatccttagagatccatagcctgagtctgggtccagaagggtatccatctgttaaaaaaaactcaacctaaataagaatataatacattctaatagaacgaatcaagataatttgctattcagatttgttacactcgaatggatcatatttctaaataagaatataatacattctaatataatgaatctagataatttgctattcagatttgttacactcgaatggatcatatttccttttaggtaattttttttaaggacggagagagtctaatcacaatctcaaatacttcacctataaaaaaaaactctccatacgagcaggccgggccgaacaatggtgtgaattcggcccagtattgggccgtgacggagaatcacgcgcgacggcccactcacctcccgacctgggagccacggcccacaatattacgagagtagtgtttttgctgggccggatgcggctgcgtgtgctcgtgcgggctccgggccgcaggcttctgatgggccaattgccgataggcggcccaggcactggcaacgatcaatatttgggctctgggctggatggcggagaaagaggcggcatggcccaataacacctcgcctagatgggcctcaaactctcaattccgctgatggggaaaactaaggccctaatcccaaagacaatgggggacattcagattcttggtagatgaagtcaatataaaggaac

SEQ ID NO: 13644 - DNA, 12751 bp, Oryza sativa
atgatcatctctgctcgcatactgagactccacatttgttcacatccatttgagtatttgacctctgagccaatcatattctgacttatcatccgtttctgaagcttcaacgtaagctgctcacgctacctgtttattcaacgctaattaccggagttaattggatggtgactgatccagccagagttagccgctgtgcacacacacacacacacactgtctaatctaatcatctcttccttttgaccatctcccggcgttctttccggtgacgagacatatatatacacatatcgcacacacatctgaatcatctcattgttcttcttctttctccgtctctctctctctctctctcgctgtctttccgagcagcaagcagcaatggcggcggcgatgattctctcctgcaggtatctgctcatctgcagcgcgacgcttgcgctgctgctgctgcgactgtgcagcgggctgagcctggacacggtgagggagttcctcacgagggaggaggacaccgtcgtgttcggcctcatcgagcgggccaagcacccgcgcaacacgccggcctacgaccccggctacctcgccggcggcggccatggccacgacgcctctttcgccgagatgttcgtgcgcgagtccgaggcggttcaggccaaggtgcggccgtttttgatatctcaactctggactctagcttgctcctcttctttcttgctcctgtgtgttcttgttaggattcgaacttgcaatgcctgaactctgaagcagtatttgagttcatctcgtttttgtatctttttttatgctctttgttttgcttgcattgtcaaatgtcaacggtctgctatgtcatctggcggttgggagattaattgtcgagatgttgatgaccagaagttgttgtctaaatgttttgacttgagcgtatgaaaatcggagttggacaatttaattaattatctaggtgatggcctgaagttgttgctgtctaagtgttttgactagttgagcatatgaaaatcctagtcaaatgtttcatgctctcatcaaaattgtttgaataaaactaataatctctttcattttactctctccattctaaaatatagtagtaaggcttattagtttttggcttgttctccaacattttgctttgattattattttattttataatataattatacatcattaacaactactgaaattaacatcatacaaaaatattttcaaatatgaatacagtagtaccacttatattagcactaaaatatttgtattgttagtttcattattaatgaaaaaagttacaaatgttgattttctaataaatatacacgctttattaatcaaatcatgcatgcatgtctgatctgaaggagtgaagaactagagtagccatgccataaatgtgatatgtttactttaagcaaagataaagaataagcatcttgcagtggattcaaaaagcacacgtcaacattaaacggcacgttaccaatatgatgcgtgaattgtgacaaaagacatcaactaaacgttatttcagcatcactaatccacattttctgttggacttgtctacaggcaggaaggtaccaaagcctgcaggagattcctttcttccctttcagagtgcctttcacattggcacctccatataacttcacaaccgtaagcgttcagcttccatatcttttaaaaaaaatcatctagaacaatgctgaaaaaaatctcaaaatgatcttactgaaaccatggttcatataaatcgtaggagctgtattctgcagccgcattagttaatgtgaatgatgccatatggagcatgtatttcaatgagttgctccctctcctggccaagaatggcgatgatggcaactatgctgcaactgtttcatcagatcttgtatgtctgcaggtaacaatacatgctacactgcagatcttgaattcatatattcacatttcatcctaaatttacatggaaaggttcattcttattgtaggcactctcaagaaggatcaactatgggaggtatgtggcagaagtgaagttcataggcgaccagcagaactacacaacttaattcgtaacaaggtaattttatcatttcacctactcctacataataagtaacaagctgatcagtgttggagtgatcatgtacaacagtacaattattttttggagatgaatcatccaagtgaaatttgtccttcacaggacacggatgccctgatgaaattgttgacatctgaagcccaggaagatgtggtgaagagaagggttcagaagaaggccatggtgttcggtcaaaatgtgacattggatggaccagttgaaactggcaacagcaacagtagccaaacaagtttcaaagttgatccttcattagtgtataaactgtatgacaaatgggtgattccattgactaaacaagtggaggtcgagtacctgctccatcgtcttgattgaatcaagcatttatctagctaacctatttgttcaaagtgtaactaagttgtcacatgaaagattgaaatgatacaccaataataacatgcagcaaggtctgcagattgttcagttcatcattttttcagattgactagattggctcaataaagcattgccaaaatatattaaaaatagtatgctaaacagatgaaaagaaatcaagaaagaccacatcatcatgctttcaacaagccaactgagtgaaagccaattcatgctttgtagttcccatgtgagcagtacaaaatgagcaaaaaggtattaaagcagcataagatctttctcatggctactaacagttgccaattcatagcatcatatccaacaaaagatacaacatcagttagtgacaaaataatcggagtcctaaaatccctccagaacagatgttaacactcttgtagcttcgaaaactctggttagatgggcaagagacgaattatttcatccattacccagtaaacacttgcagaaactaactgcaacatcccctgttggtgtaaataagtgatgttcctaggacccatttgtaaatgttaagagaatagaaaggaggagatgtgggaacaggggagtaaccctgaaaaaacccccaaaattagacaatatggtatcagagccgagctcctggcgaccagcggcggcaaaaccctagccggcggcggcgctcgtgccggagcaggacgaagtggaagacggtgtggaggcgaccgctgggactcgcgaggtggcggcgcgacctacggcgacagcggctgagcggcgtgccggggtggtcggccggtcgcgcggccgtggcgtgggggcgacggcgcaggagtggtggcggagctgcgaccaggtgagccggctggccgctgttgcttgctgttgctaccccgccgcggctggttgctgcgccggcacggaggacgacaagaagggcaccggctgctgtttgctgctgctgttgcttgttgtttgctatttgcggctgctactgcttgctgtttgctgctgctgtggagagaagggactgctgtttgctgctgctattgcttgtttggtggactgctgctgtggagagaagggaaaagagaggagaaggttgctgttgcttgttgttggtagtgtcttgtgtgctgaaaaattacaggagcagagagcagtagcaggtgaggactaaggaagcttagaaagggggaggggaaatgtcttcaggggttggaaaggaggttgtagatgcctcctcggtggttactaagggtgatatgaaagatttgctagagaatttgttgaagatgggcatgataggtccgaagagtgtagcagggggattcgaactgaaactagaattgatgccaaatgagttgaggttggaatggagcaaaaattatttgagttggtgtaggagagcccaattaatgttgagagcaaagggggtggatcattttttgcaagagagttgtgaagagccttctgataaggagagccaagcatggagaatgtggaatacaacaaattccaccgtggtatcttggttgatgacctcggtggctccttctattagtaggatgatagagactattcagaatgcagcaattgtgtggaagacattgagcaacatgtattcaggagagggaaatgtaatgatgatggttgaggctcagaacaaagtagaaaatttgaagcaagaagggagaacagtccaggagtacgctagtgagttgtagcagttatgggcagatcttgatcactatgatcctctacagttgaagcatgaggaggacattgtgattggaaataaatagatgcagaggcaaagagtcattcatttcttaaaggggctgatcaaggagtttgaggacagaagagcggctatgctctaccaggctacattgcccactatggaagaggctatttctgctatggtgcaggaggagatgaggttgaaactgatgagaggtacaaatcctacaagatcagcatacactgtggctgataatagagaatgctacaactgtggacaagtgggtcatgtgagctacaattgtcccactcctcggaacattggcggtagggggttgattcgaggagggtatggtggatttggtggaacccgtggtggatttggaggagaccgtggtgactttggggggaaccacagtggtagaggaggtcgtggtggagatcgtggtggtggaggtcgtggtaggggcgaggtgctcctcaggccatgtagccatagaggagggtaaagctattaccttaacaggtgaacaggtgacacagtgggaggaatggcagaagaacaagatcaatgagagctccaacaccaccactcactttggtaacttcgccaactacgctcaagtgggcgaagtattcaggcacaggcacttgcatctacatacagacatcctatagattggatcatagactcaggagcatcaaagcatttcacaggattgcataataccttcacatcatacaccccttatgtccactctgaaactatccaaatcgctgatggtacatccaaacctattcatggtatagggtcagtagagtgcacatcatcaataaacttatcctctgacttgcatgttccttcctttccagtaaaccttctctcagttagctcagctattgaccaactcaagtgcattgttgtatttgatgagaactctcatctgttccaggagaaggggactgggaggaggattgggactagagtcaggtgtgatgggttgtggtacatcaatcatgaggaactggggctagctgcggtggttggaaatgttgagaaggagatcagtttgcttcattgtcagttaggacatccatcttttgagattttgagtaagttgtatctagatctctttagtaaagtggataagcatagattggtgtgtgatgcttgtgagcttggaaaacatactcggtctacatatgttgggattggtcttcgtaactgtgagcctttcatattaatacattctgatgtttggggaccatgcccagttacttctgtgagtggttttaagtggtttgtcacctttattgattgccacactcgtatgacttggatttatatgcttaagcacaatagtgaggtccttcgttgctttcaggactttcataaattagtgacaactcagtttgatgcaaaagttaagattattcggactgataatggaacagaatatatcaataatgaatttgtgtcatatatctcagatgaggggattattcaccagactagtacccctcctcaaaatggtgtagctgagagaaagaatcgacatttgctagaagtggcaagatctttaatgttccagatgaatgtgccaaagtacctatggagtgaggctgtgatgacagctgcatatcttatcaatcgcatgccttctagaatacttggtatgaagtcccctgttgaacttttattgggtaagcgagagttcaaggtccctccaaaggtgtttggttgtgtttgctttgtgcgagatcatcgaccttctattggcaagttggatcctcatgcagtaaagtgtgtgtttgttggctatgcttcaagtcagaaggggtataaatgttgggatcccattgggagaagactgtttgtgagtatggatgtgacatttcgtgagtttgagccctattataaaagtaaaggagatcttgaccaatttcttgaggaattctcgactgtcatggaggttgatagtcgagagggggagatagagagaggtgacacacataggaaaaatgttagtgacaagaatggggagacagtggtggttggatcaataccatgctctattgacaatgcaagtaaagaagcagtggaagttattggagatacacaagacaaggatagagaaatggttcttcatgaggaggatggagaagatggagaagatgaagaagtggttgttgggacaattccatgtcctatggagcgagccgaaaaggtgaaacaaaaggatgtgctagtctaccaaaggaggcggtttgatagtcagggggagaaaagaaaagggttagtgcaaagttaagttgaagagttatcacatccagaatgcccagtccctgaatcctctcagaacctctctcctacagtctcattggctccccttgagataattggtaatactcctcccattcttgaacaagtagaattacctcttgcacagcgtagagagactagatccaatgctggtagacctcctatacgtcttggttttgagcatcttagttctatgcatgacattgcaaactatatcttatattctcatgtttcactggcatacaaaacattcattgcatcattatagacagtgcccataccaaaggattggaagtgtgcaaaacaagatccaaggtggaaagatgcaatgagagaagagttgaatgcccttatgaagaataagacttgggagcttgtaaaacttccaccaggaaaaaaggcagtgggatgtaagtgggtttttacagtgaagcaaactcctgaagggaaggtggataggtataaagcaagattagtcgcaaaaggctacagtcaaacatatggaattgactatgatgagacatttgcaccggtggcaaaaatgggtacagtgagaactttagtatcttgtgcagtgaactttgggtggcccctccatcagcttgatgtgaaaaatgcatttcttcatggtgatttatatgaggaggtctacatggagattcctccaggatttgggaatagccagacagttggaaaaatatgtaaactcaagaaatccttgtatgggttgaagcagtttccacgtgcgtggtttgaaagattcaggtgcgcagtgtgtgatatggggtattctcagtgtaatggagatcacacggtattctacaaacatagggggacatacatcaccatcttggctgtgtatgttgatgatatagtgatcaccggtgatgatgtagaagaaatcaggtgcctgaaggaatggacacctaaatgtagaaggatattgtgatgctgattgggcgagtagtatggatgatagaaggtctacatcaggttattgtgtgtttgttggtggtaatcttgtttcttggcgaagcaagaagcaggcaatggtggctcggtctaccgccgaagcagaatatagagctatggctttgagtttgagtgagatgctgtggatgaggagcttgttgactgaattgcgagtgttaagaagtgatactgtgatgcttcattgtgacaataaatcagccatcaacattggaaacaaccttgttcaacatgatcgcactaagcatgtggagattgataggttctttattaaggagaagattgatagtggggtacttatgctagagtatatcaagtcatgtgaacaactagctgattgtctaactaaggggttaggtcctagtgaaattcaatcaatatgtaacaagatgggtatgattgatatcttttacccatcttgagggggagtgttggtgtaaataagtgatgttcctaggacccatttgtaaatgttaagagaatataaaggaggagacgtgggaacaggggagtaaccctgaaaaaccccccaaaattagacaatatcccctctgccaactatatcttcaggtctgcaaccgcatctcagttgtatgcagtaatgcttatgcacggagcattaccacgtttgaactccttcctacgttctgttggtgccttctaccccggaagtgattctccaagtcagatgcagatgtgcaattagccttgcaagtgctgcaactccatcttggcacaaacttttggttcttttcaacaaactgcgccacttcctttgcatacacctttgcttccatttccttgtcttctctcttcagggcttctaagttttcttggtgcctcctacctcttaggtgattttttaagtccagttcacttgaacaattggctttgcaaataccataattccatgttggtggataatgccgtgtgacagataaggactctgtttctactttcttcttcgtcccaatagcttcctttcttgattccaaagcattgttttcctcgttcctatggccagcagagtgctcctcgaaataaaattcattgtgtattcacttggattccatcacagctccttggcacacatatttttttgttgttcatctggaaagtatctgcaccccttttcctcttcactccagatgacacctttctacgcatcttggcctgtgttatgatgaaaaattattagaaaatagaaattacatggtcaatcttttttgagaaaaggcaagaataatattgtttctatccttgacataaaaatcatatctatgaacatattattgggcaccggtaaagctaccgaattcagtaatatgatctgcatagcttcaggttacatttcccttggagataaatttcccttatctagttatattgttttccattcaatttcaactgccaacaaaccaggcaacatatgtgatcgttgagactgatacgtgtagcttccttgtagagctgaacaacatgcaaacaaaaaaataggtcacacttcatcccatacatgaagtcaaattctttgaaagtttgaactcacctgcccttttgcatattgtatccatagtctacatattagaaacgtcccatctccaagaagcatcgattcactttaccatattatagttaaactaacaacatttgtaaactgcattgcttgcctctagcgaaggaattgtcaagaatgcatacaaaaatattaatattattgagattatggcctcaattttatgagaacttcaaaactagggtggtattaactatcaaatgtcaattataagaagtacaaaatcaatggtccattgaaattaggaataacaaggactaccactagtaatagagaccagaaggcaaattgcttcccagtacagatgattcacatgagacacttttttagtgaaagatgcacaaaacatatcaaatggcctgcttagtggctagtcatatttttgcactacaagctaaatcaaacatagttaagcatgcatggtcaactggattagaaaacaaaagaaattgagtaagaaacaactcaacgctaagacaagtgggtggctccgagaatacaactaatatttgggaggacacaaaccaagttttcagtttatgtgattcagtgatcactgaggaacaacatagactattataactagaacactacagtttataaagtggatgggggaacaatcttgaacatggaacattatctattcgtaacatatggataatcgattaaaagttttggaaaggggacaaaaagcaaaaaaaaaaacaagataatcacagacacatggctcaccgcattaaaagatgcattctcttcatctgctgtcctatcccatggaggtcgataccattcctcgatccgatctttcacaggcactctaaacatggatgctcctgcaggcattgccatcggtcctcctaaccaaagctcaccatgaggcgaagggaatgtgtcaccgcggaccggctggaagctgacggacaatcgcgagggcacatcacagagcaatccagtatcgcgctggaccttggcctccagttctctctgctcagcaatttcagcagcaatgacctcctgacgaatgccctcctcccagagctcccggcggagcgcgtccatcgtcacctgcactgaaactccccaaccccaccgctgtttagtttctgcgcatgagtaatttactcataatttcgcatgatcaatctatctctcagtcaatagcacatcatttactcaccttcttttattattatcgtcgtgttcttataatatttcgcaggaaataattttgatcttgccataaacaaattcctcaggaaattgaaaaaaaattactactggaggcagcatagaagaattgtaacgggggtgaagctctagattagcgaaaacaccaaattccccccttatttcagaggatacgaacccacattgttccttccacagaatgactgaatgagaacagcaggggaaagtagggccgtattaccgcgcggggacgggtggggaacgccgcagccgtcgtcggcgtcgaccggggcggtggctcggcgagcgaactccatggttggggtgggtggggttagggtttggttgtggtgggagagatgatgcgggaagcgggatggcttctccgctgctgatgaacgacgcgatggttcagcttctgggctggggaggcgtgcgctgcgcagaggtggtagacgagcttcgaagccttgggccctgtgcacggagtgaccgcgagccgttggatcagacaagaggtcatctttgtaccgtcggatgggggaagcccatccgtcgcacggaggcgccggatgaaagaacacggggtctgatcccctacgagcaagtttaaaatatcgtaaaatctataacgagaggcctctcgatctgctcttaagcagcgacgtctggcgcggtcatccaatttagtcgagaagcatcagagtttagaatttgagagaaacataagagtgttaggcatccatgtcttttttcccttcttataaaattttctctcaaattacttgtctaatctacaatctgagtacaccattatgtccgttgcaattaaatctttacaacaagatctcgcatgattatattatgatgaaaaattacaaattacttttataatatatctaaattactttttagacatataaaagtaaatttaataaattctaaaagtaatgaagtaacttgagacaaaaaggaagtaactttgtcgtcacattagaaattaatccgttgtagggataaaaacataattctatctagaaactaaattaatcagcacaaattaacgaattgactaaaaacaataataaaagtaatcacttcatagcattatgaatgtataggaagtaatttaatcaaatctaaaagtaatttatatatatgataaaagtaacttagtatataataaaagtaattttcaaacatttttttcatcataatataatcatgtaagatcatgttgtacagatttaattgcaacaaacacaacgatgtaatcggatcgtatatcaaataagtaatttaagagaaatttttatttgaaatttagatgggtaatgaggatgcaaatggcaggtactactacttttaggtgctactacttttagtaagggcatccacaatgtagaaataagaggggtctttaagcctccaaagaagtctatatacattgtggaagtggtctatatagaagacatttggatgagctatccttagctataaagaccggccacaaggattaaaaaattggtacatcctctccaattctggtacttgccgctatgagaagaaagaggaaggcgggaggagcaccttgcagccgctgccattgaagccatccgtgagcgtcgacgtggatctgctcacgcgagctccgccatccgcgaacacaccggggatcaacgggccgccgcggaaccgctcgcgtgtgcaagctgttgccgttgtcgaccgcgagcgccatcgccgcctccttttacgagcaccacccgcggccgtcggatccgttgtaacggtgccgtcggatacatctgatagttttttataggtcatagactgccctcacagatcaacacaagtcttttctgcacactttgtcctcactcgtgcgcacccgggaagaatttcccgatcagtagcacgcttaaccctggagttctttggaaatcggcttccggaaaagaagttgcaacttgttgatatgagtattctattaatcctattaagccatgggctgggatgtcacatctgtggtccaccgccaacgagcgccgccgtcgtggatccgctctcgcgagctgttgccgtcctcgtctgccgctgccataaatgccatcgccatgtctttcatcgatgggttgggggaaggtgtggggaaagtggccggaggaaggggttggttgggatggtaggtattttattaaaatgtggggtccaccataatgccttcttcctcccatatacattgtggagatgaaatatatttttgtgggacccacctagggcccaccataaggcctacttatgccatatacattgctcatgccctaagaagggtaacgagttgatacacactatattgtttttggtaaaaaggatagtcgttggttagcactaacgagtgcatgcgctctctgtagtc

SEQ ID NO: 13645 - DNA, 38699 bp, Oryza sativa
gtccttaaaatatagtcaatccgcaccctcttgggtaccaaaccatatagagaaggcactctgttattttttgtactcgcaccctctaaccatggatcgtcccaaaatagaacagccttgccatcaccaagctgccatcgcgttgaggccataagaaaatccttctctcgccgtgaaactggcatcggcaagccttgccaaggcttgtctggtgctgtgcgaagcgaccaaagccatcttgtacggagcacaacccctaagaggtcaaggttgaggatgccgaggcccccaagttgttttggagtgcaaaccttcgtccaggctaggcggcagtgacccccttttgcctccgccgctccctgccacaggaacccacgtcgcacctcgtctatccccttcagaacccacttcgtttttatcctgctgtttatgcatatcgaatttttaaaatgcacatatatgagggctcttctacaaaaagcaaaaaagaaaattcgcattttcgaagcggagaagtattgcatatgctaacgtcgcaagtacattggcatgtttggtagcgaaaaatggaaaaaattgacttgccccatctgaaaattttaagaatttcgtgggattttcacaagaaacaacttagatactagaagattagagaaaaaaaacacatatcctcttttctatttccccatttctctatttcctttccaatcggtttgttaacaagcaaaatactatacaatgagaataggtaaagagggcagctctcgtcatgactcatgagaggaacaccaaaactaggagtggaggcaatttgagtgcactgtacggcgaaaaaacatttacacttgaatcaagcatctcctatcttccctaaacacaataagacgtactccctccgtccaaaaaaaagccaacctagacacggatatgacattacataatacaacgaatttagacacgctcatatccaaagttgttgtactatgtaatgttacatctgtacctaggttgacttttttttgggacggaggaagtaaggaagtgggtcttaactcacttggcaaggaagtgagcctaattcactcggtgagaggtgttggcatacacccctaacacccaagttagaagtattcttaggttcaaagacacctgtttcttcttcaaattctttacgcactgtgagatgttaactgcagcctgcacagcatcgccgctatgcattgtccccaggggatgttactccaggattttgtatgtacgctccatttttacaccgtgcctgtacatattgaaagcatgactggtttcttcaacttggattatcaaagtcatcctaaaactccttccttcagttgcatcagatgagtacggaggctggactcctgtacctgaatcaacaccatgcaaagattgaattgatgttagtacattgcacagttaagtaaggcagatcatgttgtacaaatgaagtctggggtgtatgcaaggacaaagtatttctgcaaatggccagaactatggctactgatgcctactagaaattgtcagtttccaatcagataagaaccagatgttcatcccatcaaataaatccaaatcagacaaggcatgcaactcttgcaggacatgctacagggattgtggatatctatgctgccctctggctgtgtctgcagactgtttctggcaggttgaccaactaaagtggttggattaatgcagaaaacaagtcgagtaaccaacaactagttttccaaaggtgggtagctactgtggagaactaatggttaggagtgcaaatggctcggctcatgaaagctttgtgcaagggaagctcggtttggctcggctcgctacgagcaacgagctaaaactaaggctctgctcagctcgttaatgggctcaagcaggtctaggagaaatcaagcaacattttaacacatagaatgtgcaataaagtgataggtttcttcaatatgtcatcccaacacataaatagacaatatgacaatcaattttaccattttcaacaaataaatagctagaaaaggtacaaaattattgtatatgaccctattgtactgagccaaatgagcttgtgagcggctcgtgagccagcttaggcttggctcatttcaaaaatgagctaggaaggagcttgggcttggcttgtttggctttcgagccgagctatgcgagcatgaaccaagcttgagcctgagtttattgtccaccctactaatgggggttttaaagtggaatgttctttcgaaagttcagacagagattcataaatacctgtagttttgctgccgtagctaagagctctctacactcaccaagggcaaccttttcttgccttgccatgtctgaaagttcagaaaccaaagacgtcctaccttcaacctggtacacatatcctaattaatgttactaaaagcaacaaagacattgtatcctaataaattgcgggcaaattagagtatgtactaattttaaaagttttagtttatcaaacaatattctgaaaaaaaaaattgaatgttagaacctgagctgctcctctttttttgaaaaagaaaaatatatggtacgtttatatctaacctttgataggaggtacaaaattgaggaactcaaagcttgcataacatcaaccgctgagcttatagaattcttaactgcaacagcatctgcctgttaaataacggtattgtcagcataccagacaaaccaagataagagtattcgatcaaaaaaggaacaagataagtgtaactacaaatccaagatcatttgacattaagcaatgatggcttgatcacgtacctgtgctcctgatgtaactggaaggcgaagtgtgcatgcttgtaaagcttcaatagccccaatcaaagtactaccgttctctccttctagtttcggccaatgttgaagataagcaatctgaatcacaacaatatggcgagaagtaacccaccaaggattttttttagatataaaaaaattgaaatgggctaaacaccccaaatcaccaaataaccgtactttaatcaaaatctgaaatttttcaatgaattcaataaatttcgaaaaaaaaaatcagggggcacaattaccaaaaaaaatcactgaaagattaaaattgacagtacttcttccctgaatttgaaaaaatgtcagccaaatcagaagaagatttttccagagggacggtattacccaatcaccaactttttttttgttattttcagccccatatttaaaaaccacattttttttcaaattttgaatgacttcgaatcaaatttaaaggaagcatatttagaggaaaatttcaaccaagtacctgctcttttaaaacgtagtacagtttgagctcttgttgcaggagttgaacatcaattcttctgactgtaacagaatcccgcagctgcacgatacttttccacacactgtaaagaatactctgttttacatgggaggagagaaatactatattagttgaacattgcttgcccaatgaaaaaaataataataaagagaatgcacccactaagaaacaatggcttcatcaggcacaaacttgagcaaagcaattagagaacagacaggagcaaaaccaatatagcatacctctatgctactcttttggaaggttagtgtatcttctgaacgagcatttacaaactgccactgcaggcatctattatacagcagacgtaattggtgaatattctcaaactggcttgcactcttcttccctttcctcgcatcaactatatagttaaacacaagaggtgcaacgcctgattgacttgttgaacaacatcgtgatcggcaaggtgccgaaggccttgtcctcaaaggactttgaaaggctgtagaagcaggggatgcagctgacaagaccttgtttggtgacgacgagcgatgtagaacaggtgaagacagagtcctgctcgggcgagtagcagctttagagttttctgatgtctgtgaagaaacatcactaccagattctgtcttatcctctcttctgctctcatgtgtagccaatctctttgccaatccgttcaatggctgattcagaccattggctttgacttcagctggacaaatcctccttggtgaaagcccccttgtagggtttgatggagtgactgacctgataggcgtgttggcaacaccattgcttctcgaagttaagacggcagagccacggccacccatcattgccgccggccatcggtgttgctcaacgaccctcttgtttggagtctctgatggccgagcattctcacattggttgccaatgttcctccctctaagaggacttcttttcctctcagtctcggtcacgtttcttgcctgcaccttggtctggtcagaagatgagccatcagcaagcttgtgtctcttcttggcagaggttgccattgccatggactccttctgaagcaatggaggcacgctacgagctgatgcccacaagccatcagggggctttgtactggctgcacgacgagagatgccatgtacctcggtggctgccgcaacacgcaccggcgtcctgggcctcgacgcagcgccgccaccaccaccggacggcgtcgagctggaagaaggcgtggaagacctcctcctctcagctgactgtgctctgtttgtcgatgctgtgccttcagctgctgaagccctgctcagacttggagacgtgcatcgcctcaccgaggaagcagcagcctgtggcgccggcgtgccgccggacttgaacctggaggccacctccctcctccgacctgccggagcagcaatgttcttctccggtggcaccagcggctgccgcaaggcgcagtcgacggtacctgcggccttcctcccctctgtcttcacggcatccatggagtcgagtagctgctccaagaaacgcccacattgatgtactggccagctatcaccaaagctacccaccactctcctcagcaggcaatatcaccagagagatctaccaaaagacgacgccaaccaccaggataaactgatacaaaaatccaaacatgcatgcgtgcattaaccttctgacacaataacacaaacaaacaaacatgaaggctctccgcctctcccctcccccaccaggccaccacgtcaaagaacggcaaatgcaggcaaccaaacagcatggacgattgcacattattcacaacgatggatgacgacaacctagtgtcacggccatttacatgcaaaggattgtccaatttgttgctactgcccacccggtccctctcgtcgtgtgggcgtaaagtgccccaaggaagaaaaggaaagctcccgtgtttgcttggttggggcctagtacaggattgcaacagtgcagtaactgcaaatctgcaaattaatccaacatggcctcttgatgtgaaatgcgaattgctgctgctacatggtactagttacatggatgagttcgaccaaggacgaggagagaattaggttcaccttttttttcccctgaagttgttggagccgacagggacacatgcgtccacgcaacatggatctttgtatctagattctagaaagtttattctactgctttcactacttgttttcttcatcggaaacaaacattatgggaatgggatcattcttcgaagagtaaattactctttaagagttaacacctcaccattccagaagaccagaactacaaacttgcaatgcatcgtaagatttttgtactgttcgatgcaggcaagaaaacaaaatccaaatctaccagatacctattcacatggcaccagccgatgcaacagtcacatttcactcactggaaaacatgagcagaatctccaaaattctccaaaccggcttcgcgatcaaatgtggcaagaaaacgagaaggaaataaatctagctcgatggcgtatataagacccaaattgaagggcctatccgtgctcacgatgtacagcgaatcggagcccaatcgcacggaaagggacgcttagcttcggcgcaaagggctcacccttttcaaagctcactgtacgtctggatcgcgacgacagcgcacgcacgcaggagcacgaacgcgaagcggctgggccaactcgaatcgtccactacccccacaaaaaaaaaaggcaaaattggttatatagcatcgaaagttcactttttagttttatagcaccgaaagttaccggttcactttaatagcatccaaagttcaccctgttcccatttttagcacttccgttaatttttccgtccgtctttatcattattgatccagccacacacatgatattatatttctacccctcattgacatgcattatacttgtacttgtgaggggtagaaacgtcatatcgtgtgtgtggctggatcaagacggacggaaaacgatcgagaattgacggaagtgttaaaaatagaaacatggtgaactttaggtgctattaaagtgaaccggtaactttcggtgctacaaaaccaaaaacgtaaactttcgatgctatataaccaattttgccaaaaaaaaaaatctccgtttcgaaacgtttcgaatagtaataaataaataatgaacggggttttcccgattactcggaactgtttcaaattgacgagagcgattgcggaatctttgaaacgagaaaaaaaaattgaaagccgtttggaatctcgaatgtggtgaagaatgctacaaacggaaacagatggaaacaaatttctccaatgcccccaaaaaatttcacgaatccctaaagcatttgggggtttaaggatgaggggattaggatttaggaaacgctgggagaatgcagcttcacgcacgaacccaatccgatcagaggaggcgaagcaacgaacaggacgcacgagcagtggagcagtatgctactaagctgcaagttgaactcacctcggctcgatcggggatcgcggcgcgaggagccccctccgttgccggaccggcgggtcgccgccgccgccgccgcctcgtcggcctcctcgccgcgcgcgagggatcggaggttagtggcggcgatgggatcccgagctgttgccgtgcggcgaactcctgcagattttctcgcgtgcagaggaaggaggtggcgtggtagagggaggaacgcgccgcacggttactactgagggtggtggtggggccgtggagaaaaagagaaatcgtattagggttgtgtttagataaatgcgtgtaaagttttagcgtgtcacggcgaatatgccggcatacatttgaagtattaaacatagactaataacaaaacaacttacagattccgtctgtaaattacgagacgaatttattaagcctaattaatccgtcattagcaaatatttactgtagcactatattatcagatcatggagcaattagacttaaaagattcgtctcgcaatttacacacaatctgtgtaattagtttttttcatatatttaatactccatgcacgtgttcaaacattcgatgtggcagggtgtaaaattttgcgagggatctaaacatgccctaagttcatgatggttttatcagggcttttttttgtttgtttttttaattttgagaaggatttttttttacccaacctctacattcaaccgaatatatgcagccatttaaattgaaaacttagccccgcaaacaactcaatacgaaatttgctcatatggaggtttaagctcaaggcccaatctgaaattctataggcagccattttaatcggaaacttagccccgcaaacaactcaatctgaaattcgttcatatggagatttgaactcaggacctaatctaaaattcacttctatggatatttgaactcataaccttgagccgctactcatgtcactgcaattactaggctacatgccctttttacctttggttttatatcggcatatcgcgaggacgaaatttaacgattttcaaacagagatgattcttttttttttcgagtgatgattctattgacctcactgaacttgtatcgtgtgagctaacgtgttcatgacagtgaactgtgaactctttttctatgtcctagctaaatactcgtgcattgcaataaagttttgtaaagagatctcatgatagtttcttaagttgtgttggttattatggattaggaactaaatctctacagaatacacataaaatgaagcggtggattaacacataattaattatacattagttaaaaaaaacttaaaaataaattaatatgtttttataataactttcctatagtatattttttaaaaaacttactgttttagaagtttgagaagtgtacacgcaataaacagagagtggaaattaggaaattagtacatgcaaactcaccctaagaccatttcttaggagtgtttcgagaggaggagaaagaactagatacgtaaaacgagatgagtcattagcgtatgattaattaaatatgaattattttaaacttaaagataaattaatatgttttttaaaacattctttataattttttaaaaaaatatacagtttaatagatcgggaaacatttgcatggacaacgagatgaatcatctctctttgtccctcgctcaaacgcagcctttctaatgacgaaataatatttgcattagtcgagtgttagagattaattttgacacgtttcataataaccatttctcatcgtctaataaagatgttatacttatatcaatcatattatttagtgattaacttgacatatggtccatcaattgtttgagatcttacatagcagtgtggtgagtaactgggagaatcactatcaccatcaccaacatttaaagagatgaatgtcttctacatccgagagaatgtcttcctcacccatactaaaagagaggtaaatgttcaccaaacattttgtttttaaaaaaagaaaaaaaaatctaccaatagcataggtacgtaccagtgtaccagcaccactgcattatggagagttgtttcttaacgtaacttagctaaggttgtgtttagttactaaaattgggaggaagtttggggaaagttggtaatttggaaaaaaaaagttgggagtttttgtgagtagaaaagttttggatgtgatgtgatgtaatgaaaagttgagagtttggggtagtttggtgtgaactaaacagggcctaaacttgggtgtgtttactttcatttactaactttttactttctccgttcttcatgtgcaaaatattttctgaactattaaatggtgtgtgttttttttaaaaaaaaatctatacgaaagctgcttagaaaatcatattaatctaattttttcatttttttaagttaatacttaattaattatgagtcaattgagccacctgttttatatgtacagggtaaaggtttccaacccctcctcccgaacacacccttaaccctactgctagcattgtaagggtctgtttggagaccttaagattttgagaagcagctggttagaagtcagcttctgagaatatggaaaagatgggtttccctacttctgacttctaatttattttctggattctacaactacagcttctcagaatttggaccaaaaactagactgattagggagcttttgattctgggagaagctgcagcagttagaagcttatccaaatatgccctaagtaggtactatttgcacaataagccatggaaaaataaagaaagcaatgggtaacaaagggtttttttatccgtgttattctaggtttaaaagcttcgtttcaaaattatgggcttataaaaaccaatgctggaaaataaataatagtcttaaaaattgaaatcaactttgaagttagaccctgttctgttctccaacaaaagttggattaaactttggatactcgtgacacgtttttcaaattgctaaacggtgcgtttcgtgcaaaaactttctatatgaaagttgttctaaaatatcatattaatctattttttaagtttgaaataattaaaattcaattaatcatatgttattacaacctcgttttacgtgaaacacttaatcttcatctttatctttatcttcagaacatttaaacaccataaattttacgatcaaattttgactatggagggtaccatgggagaggaaacatacggatcccacaattcgtacagtattgacttctcaagtcatctgcttctacagttccttgtaccaccaccttgttgttgtgtcctcggccgatcgagaccctcgagaattcgtttcagctctgatttcgcggcgtcatcgatgctgcattgctgcgtgctacagccacgcccttgcacatgccgccctggtcccgtcgtgtcccgtggactgtagcgacgacgtcccactcgatcgggcaaccgccacgaaagcccaccaacgctttggacggaggcgcatttacgtgccgcgtgagcgggcccgtcgtcctcccgtgcacatggcacgtgggccccgcgcgggtcgctcgctactacgcctacgtgaagttgctggtcgccgcagcgctggcttttggtgttggtggtctctggctgcaatgcgtacggtacatgggagggaggttgagctgcaatgcaaaggcacgtatggttgttttaggccatttctaatccaagacactagacatagtttaaataaacttcacattattaagaaactagtactagacaatatttttctaatgcaaacaccactattccacacttaaatttaatgctacttatcccacatgatgccttggatgttgtatagaaacagtgtctcatgcaagacatggtttccttctctttcctcatttattcacttgccacatcattttttatcttatgtgacagcttatttaatgctatagacaccatcatagtcattgggttgggaatagccttagttatggctgatttgatctgaagccctatcaaaatattgataatatccaaatctaaataagtccaaacactataagtagggtagatttttctattagttaggcaaaatttgatcttaatcaaaatactattaaagtactatttgaagctaccaaaaaattggtaagccacattacggtgctctttactagtagtataaagcaatttgaaccgttgatcttatttggccgaggggtttaaatctgtttgtaccaccaccccatttagtgatagtagagatgtggaggaacattattgtcaaaaaaaaaatatacgggtgacagtgactaaatccttttttttctcctttttggctttttcgattgaacgatgccagcggaatcgattaccacatattgatatagatatagacccataaaaacataaatgatagttacctctaatcactatattagtaaattactaatttacccttaataatgaatggttcagatcatttctactggtagtataatattaccagtagagagcaccggaacatcgctcatccaaacatgcccttagtttgtaagggggtgtttagatctaggggtgtaaagttttgacgtgtcacatcgggtattatatagggtgttgcattgggtgttcaggcactaataaaaaaaactaattacagaatccgtcagtaaaccacgagacgaatttattaagcctgataaatccatcattagcaaatgtttactatagcaccatattgtcaaatcatggaacaattaggcttaaaagattcgtctcgcaaattagtctcaatatgtgtaattagttattttttagcttatatttaatacttcatgtaggtgttcaaatgttcgatgtgatatggtaaaaaaaatttagagtgggatctaaacagggcttaagtaccttgatgtagatgtggaaaaaagctcgaagctcgtggtttggattggctcatggtgagctactgagctcgactctgattgactcaaacccatggtcttaatgagttgagccaagctagaaatttaactcttgagcttaatgaactagcttgtgagttgctcattactacaaaagatcaccacatcttcatatatacttagtgtttcttaactagcgagtagtgactagtccattagttacatcaaaactatttgtattttgtgaattcttcactagtgtttattattaagtttatatgttgtaaacaaataaattactaattataaaggtgatataaatacgttaacaagcttgacaagagccagctcatgattttttgctcactttttctctcacttctgtattcaatgcatttgctcttgtatgtgaaacatttcttgtttttcgttgtctctattctccacatgtgcttaaaataagtttaatagtatagccaatttctagctataaaattaacacgtcatctacaacaactctattagcctatccatacaatagtttatataaatatgcattacaccgttaatacttaacccaccttgcctacacacataatattgtagagcctgtgctacaactagctataaatctaaatacaactattcttctctctcctctcttattttagatgtgtttatagctaacttgtaacctgctattgttcttattatactcttatagttggcatagagccattaaacttgctctaaatccctctttcaaaaaacatttataattagcaacgacgaaaaacatttataactagcaacgatgcatggcacgtgtgtggtgacgtgcatgaataaataagtgtggcatgcatgtctggccatcttatcatatatgggcagaactgtttgcgagcttggatcgagcatcatagaactggtcatcagtatatgtgtagtgtcgggggtgccttagctagccggccattcattgtatcacgggcccccgtaagcatgtgccgcgtgacataatgacatggatgcaagaacacggtccaccggtcggtactgcacgtacgggagttgatcaacccctgtgcaagctataacaaaacaagcatggttgattgggtacgtaggcgcggccgcatgcgcgcgtattgacctcctcggccggctgcgtcgacgtcggcgcgtcgccatcgcgtccggtactccggtgtgcgcgcggccatgcatgcagcatgcacgtacggtcacgcgagcgaggtgacccgcgcgtgtgtgttagccaggggaggcctagctacgtacgtgtgtgttcatcgtgacgcgcacgcgcgctggaccacccggttaaattttgtccggtcgcctagcgagctagctagctatcggtagctcgctccgttgcacgcgggattaggtcagatccagtcattaaggagggagggcggtgggctatcaacttcaatttgtagttgcgcggtgttgctttccctccgttgttcgtaggcgatgatggtaggattagttttatttagcgcggtataattgaccacagccaccggtgactaaaacgattatacctccctccgtttgagattatgaaccgttttgactttgattaaagttaaactgtttcaaatttgataagtttgtttaaaaatgttttcaacacatgataaatatattcaacttgttgttttaataaaactaatttgatgttataaatattaatttatgtgtttataaacttagttaaacttaatcatataatttgaaacagagggagtagcttgtaagggtatttgattgcacactggtatacaaaactaaattatattattctacctttgtttccaaataaatgacgttgattagtgcaatttcgaactaaccggcgtcaaacaaaaacgaaacggagagagattatatatcaaggtgtgtatatcaagcacacactgaaaaaagactactaaaacgtctaattaatatagctgccagcaaaaaagagttgtaccaatcctgattctactgctaaatacctaattagcctgcctttattattcctaacaccactaaacagataacttctttctactgcagtaggccgacgtagtcgagatcgacggagccgagccacaacttgcggtccctctccacaacctcgctcagcgtcacagccctactagcagccgtcagctcctccacctcgacgccgtcgccgttgagccggacgccgaccaggtgcttggccggagaagccgccgccggcacgttgaacgtaatcttctcccggttgagccccacccagtagccccccttggcgtctcgccggacgttgtcggggtacccgggcaggtcggcgaagagctcgtactggccggccttggcccccttgagccaatacctgaacacctgtgccggccccgtgtgcgccaccacgaggtacctcccgtcgtggctgacggccacgccgttggcgtacggcaaccggtccttcagcaccgtcacctgcttcgtcttcgcgtcgtacttcatcagccgagccgtcgcgtcgcggttcctcatgatgttctcttggtatctgcatgcacacaactcatctcctgttaatgctgatgatcaacaacgcattgcatgcataatgcaaatttgaaagtaaattaatttggattgttctcgatctgtgtatacgtaccggcgtgtgatggtggtgctgctgtcggtgaagtagacgtcaccggtgtcctggtcgacgtcgacgccgttgaggtaattgaacggcacgccgtcggcctccgtggcgagcacgtcggcctggccaccccgcggcccaacccgcatcaggcccttgtaggcgtcggcgaagtagaggatccccgtcttgaggtggaacgcaagacccagcggacgcccgcatgtgctctccgtctcctcagatgacgacgcgcacgtagggttgctcctgcacggatatatacatgttagtctcgtcaaccaatctatacgtaagaaagtattttctacacctaggtctcatggcacctgggtatatacatgtaatttaaatagttatataaaaattttaaaaaatttgataagatatatagtacataataatatcacacaccatgcaaacatacaagtcaaaattctatacatgcacgtacgtaccggtaattccggttgtacgcgaaggtagtccagccggcggagtcgccgccccacttgaggacgcggccatcggagacgccggtgaaggggccacggttgctggagtcgaaggcgaggctctcggcgccggtgacgccttcggggaggcggacgtgggaggcgcgatttgtcggggttgtcttcacctgcgacgcggtggtgcacggtggggcttcgcagatcacgcgctgcgcggcgcacggcgaagctaggcagacaaggctgaggagcaggaaaaccgtcgagaaactagccatgacgacgaagcgatcgatctgaagaggctacgagaagaagaagcgactacttcgagggactaagttacacagatcgaggaggccatcgggacgctatttatttggagaagaggaagagacagcagccgacacgacatggcgaggagttggagacagagctcgacacgccagcggcggcgaggtttatctctggtttttgaagcggcggatgaagacgaggagacagagctcgacacgcctgcggcggcgaggtttatctccgtttttttttttttttttttttgaagctgtgcggatgaagaggaagaggagacagtgctcgacacgcctgcagcgacgaggtttatccctgtcttttgaaacatagcgaggatgaggagacatagctcgacacggtagcggcggcgaagtttatactgtttctcggatgagatcgtttgattcgaaaaagatcgtagacgacaagaccggatttggttgaggacgcggcgtcgtgggcactgcgaactcccggccggaggaggaagaacgagctgacagggtggtgagctgggctgggctttggcgcactcccgcgggccggattgctgggccaggccgggccggaagagagaaaagagaaacgggccatttttgcatctgtcctcgttcatcccccacactgccccacacatccatcgccggattcgcctccgcctctcccttcctctcgtcggcggcagcaagcggcggcggcggcggagctccggattcgaggggaccaagcatcgcctgcagaggaatccgcctgaagggtaagcacccctcagctcgacgcatcgcgctctgcctccctctcgatttcctcgtctgctctagccgacgtcgaatcgtgatccctagcatcgtgtgttgatgcggaatcgtggttgaacatccagattggacttcgattccgggaggatccccgcccggatccgaattttggccgaccgggatccccgtctcctccgccgagatggggagcacctcgtcgatgctgacgcagtacgacatcgaggaggtccaggaccactgcgaccacgcctgtgagtttgcgcgcttgtgtttctctctttcgattggattctgaactctcaacgaagattgatgctgtctgccgctgttcccctccgatctgacctgctgattcggggtgttttgggagctaagtctcgcagcaggagatcgtgtcgctgtaccaccggttctgccagctcgaccggaatgggggcggattcgtctccgccgaggaattcatgaccgtccccgagttcgccgtgaaccctctctctcaggttacaagacataactagcctgttcctcaataccttttcttattctgtattgagaacgagggattaggaaaggaatgaattgggtgattgggtagatgtttgaggaatgctatttgttaatcgatgcgatgtctctgtcagaggcttctgaggatgctcgatgggctgaactttaaggagttcgtggcgttcttatcggcgtttagtccccgcgcaagcctgcagcaaaaaattgaatgtgggttcccagttcgtacttaaattctccatttgctttctgtcccggatgtctagatgttctgagaaatatgctatgttttctctgtagttattttcagggtttatgacactgactgcaatgggaaggtggcatttgatgatatcttgagcatcttgcgggatctgtctggttcttttatgactgagcagcagaggcaggtttgtgcttaagatctttggtgccatatcatatgtgctaacatatccatgttcatttatgtccataaaagcttgtgtagttgcaagtaattgtaatttgttgattgctcatgttgttgcaactacaatgctgctaaaattggtacctcacatgttgctctgagctggtagtcaagtggtcaattggtcataactgttgatcgactctaaatgcggaggactactttttttttgttccatgatcacattctaggccttgctggctgggataatttttggaatcaatagcgaattctaccttcgagtcaatttaactaaagcgtaatagtaatgtatttttggtagagcactctacagaatattttttttccttgtaagtaggattccgtctggtccgtgcttctgccggaccagcataataggttaatatacatcttggtttacttcgtaataaaataacatcatttttttatggtaaagtatactgtagtccttttctgctatactgatgtatgccacttatgcatttcagaaagttttgatccatgttttagaagaagctggctatacaaaagattcaaattttactctgccagactttatgaaggtaagctccaatctactactttattcccttagatctctttaaccttaacagataaatattttctgcactagtatcaggagcatacacattatgcttggtgaatcagatagatgttctagaaggaaaatatcttgtctgtatttgacaggtttaattttgaataagctgatatcactaaattaaaatctagttgtcatcatctccttatttgttctaaatcgagcatcccattcacttggttttatggcatttagctttgaaatatctattttgacctatactttccataccatgttattttgttaaataatgtagcattagcatgtgatcattttttcattaagaaatgaatggttttgattattgcaatcagcagatcttcgtatttacttgattgtagctaaaaattttcaccttttgtactcacgaaacttgtttttgtttccagattcttgacaattctgatgtgaagatggaggttgaagttcctattgactaagtacttgtgtcattgttctgtgccccggcatgtatgtcagcttgagaagatggattaattagaccctactagtactttttttatcatgtattaagctgtaattagtgaaacatctgtatttgatcattttcaggcttaattaacttttaccacccgtgcatcctatgacctttcaggtactgttaccctgtaaggtccccttcattttttcctaacatcttttcatattgaaaacgtctgtgatattatggcttattaatcctttctagtaccttccattatgagtgaaaaaaatgttctttgttctctcgcatcgaggatatctgcaaattggagcaggaacaatttgggcttgcttggatcattgtcaatccatgccttaccaaaatattggcatgctaaattttttttggtggagtatgattggttggtttgttgccaagttgtttgagctcatggttctcttgccatttttttttgatccccagaggcccagttcaaatgcacgtctagcttctccagctactaatcttctgcatggcaagtttagaggcagtaatccaaaaacaagccctttatctcgtcgtacaatgggcaatgcaacaatattcatttctctaggtcaatatggctaaccaaaggtggcgacgttagcttaaatgttaacttgctagactgaaataacatgccagtatgatcagcactactccatccgtttcataatataagtcattttagcatttctcacattgaaatgctagaatgacttacattgtgaaacggaggaagtaccaaaaagtcactgaggtacaaaaccatgttggtctaacgtgtttccgacaggacatgctgctctggctttttatctgccatcctcatgtttgttggtattccaggcagactggtgaagagtaaataggtttgctcagctcagatgactccaaattcacatcccaaaaataaggaacaccttcctgtctttctccctctaaagttgaggtcatcaatgttttctcctattaatagacgctaagctgattacctgcacttctccctagcagggaggaaggaatggcagaaccattggagaattggatctttggctcatcgttggggggtttcaaatatcggtgagtttgtctgggcttcatgtactccaacttgtcgttgcttattcaaaatttgttttctatatccaattgttaatccagtcatgtcaaattttgtgctcaactagtggagtaataaattatcaccacaacatccctcaacacctctgggaatcgaatgcatgatctattgtattaaccctgacagcaaaatcataacagaattcttagtcaatttgaactcttacattagtgcttcgttatattttttcagcacggctgtcaattttagatactgaattccagtttttcaatttattgcaatacttttggcatctaattagcttttatttagtcaatgtgcattatgttatgagcatagaaacattaaccctccatagaaaacatatttcgttaatctgctatcttctcgacatcttcgtaccacctttgttttgtatattctttcctcttctttggcctttctaaatgcgcttgattgacgcttttcaaattattcatagctaccatgggctaatccatggaacagccaaatggtgctttttcttcaaaagcatattgtcttgcctagttttaatttggtcctccactctcaatatatatatatgatcctgttagtcaggaaatatgtggatcatgaggttatcatccttgccaacagttatttttatttaaatttttaacatgtaagattcaattttccacattttaaattgaatacgaatatatatatatacacgtaacatgctacgatgctattaatatcatctctttctcttattcttcatggcaggatcacacattttaggctaggggcataaatttaagcattataggatacatgatatgacttccgtagtgcgtacaatgtggatggaagttttaccctatgatagaaatattaacacatcctggattaagttttagtaggtgcaaaaactgaaactcatttgtgttatttatgatatcacatatacaattacataatcaccaaactactagaaaggaatcatatgtacggtaatattatttttatggtgcggaagaattgtgacagtattattctaggctgagttgattttacacttcaaaatcaactccaattttttttcctttttcagcttcatccaatcctcgcatgtcttcagagaataaagtgaagtttttttaaatattgcaggttcaatagatgaatttaatagattctaaggcaaatagtaaaccatatactaatcagagcctttgagaaagatggcagaaactgaagatactcagttacaaaaagcaatattcgcacagtacattatgatgaagaagttattcatggagttggaagaggagagagaagcttcagcaacttctgcaagtgcagccttgtcaatgattcgaaagcttcagaaggagaaggaggagcagaggatggaagcatggcagtacaagaggatagctgaggaaaagattagccacagtgacaaagcactggagattctacaggaagtccttcaacagaaggaactggagaatttttatctgagaaaccaattgctggtgtataaacacaagctattggatgttggtattgatgagtgtgatattgcagacgagacgataactaacaatataccattatttgaaagcaaaaccgtggagaatctttgtcgtagcatcaaaaggaatttctctctgccaactttgcagatgaagaaactttttgccgaaaaggacaccgacagaaatgttgaatcaacaaagagcagattaggtggctttgtttgtaatttgagtgaagatgaattgaagcatatttctggaaatgctagtgacttcaaggctctagaggttcagaaaagcttgctgacagatggggatgccacagaagaacatggagaagaaccaaatcctccaagcagtgatctttctcaacaacctcatctcttggaagagtcaagttgttcctcctcgttgttgagtaatcatagagatacatccagtgaaagagcaatacaggttggggaaaatgcggaagatacacgacatggtgatcaactcaagcagtcacattcaggcattggaaaggaagaagtacaatcacatcccttggaagagtcatcaagttgttcctcgttctccacatcgagtaatcacagagatatatgcagtgaaagagaaatacaggttggaagaaacgcagaggatgcaccacatggtgatcaaaccaaagagtcacattcaggcattgaagcggaagaggttgcagttcatcctataagtgacatcgttgacacaatcaagattcaagaaagaagccaaggagtagaagaatcctcatgcactgcaaatgaaatcatcacaaaggagtcagaactttctcccaaggacgttccgaaagagcggcggcctcaggctctatccaagttatctgcaacaagaaaagttggctccatgaacaacctctacaggaatgtccatgtaatcaccgataagagttcgacgccacgaggaaagaattcaacgccacgagctggcactgagaggaccagatcaaggctgaagcgggtgcagagcgagaagatggttgagatgaatgacaccaggaaaaacaaggagcagatcataatgctcaaggaggtgtacgagcagcttaacatgatagaatcgcacatgaggccttcgacttcacaggagacccctcggaatgaccaatccttggaatctgtcttggaggtaacttgttaaattttcaacttgttatgaaattttacttttgtagagttctaacatgtctaatcatgccaattttccaacaggcggctctgtccttctccttatagctagacccttgtggcctctactctaccatctgaacttctgaagcatatattcagaggccacctccagttttgaggcggccatctatcaggaacatctcttccatgaatacccaacaaggggaaatgcatagagtttttatatgcagtgtaaaactgcaaactcccatggtggcgttctttgagaagtctcatacacacactcatctatcaaggcctccttcgagcggaggattttcgaagaaattctgcaggaattgaactaattcctgtaaaattctgtgaagttttcgcgttcgggagtccaaatagaaagaaatctaggtgttgggtctgtgggctgtggcctgacgccccacttcggcaaccaggcatccgttgtagcaacgttcttttcacagtggcagcggccaatgcagccgttatgttacttgtgtgagaaagttttacggttctacagagacaattttttttaccttatcacactaaatatagttaatgccatttctctcttctctcgttgagctatatcatcttaattatttatggtctaattatcttcctcattttcttcttttataaagtcatgtcgccttaattatcttccttcttcttttcttgtcttataaagtcatgtcaccttagtttcttagttttacctctagatgattaactatattacctttttttttccttttctcataaaccacggcttttgaacaaccaatccatatataatttaaattattataaacaacatcatcttaatttatatgagaaggggatggcggggaggaattaataatcaaaacccttgtttcttgggtatactcatgcatatacttgtagaacttgattattgaataattaaagttagcactcatgtgtgattatatttatacgttgtcctataaacgtgaaaattttttgtaggcttaggcacacagcacacataccctctatatagactagtagtactaggataagtccattccggtactaggttgttatattctgggatgggacggagggagtatgtttgagcttacgggggagctatttactcgcaactacgaccacacgcttcccaaataattaaacactatattttctcaaaaagaaaactttctataaagatttctttggaaagatttttctttaaaaaaatattaacctttaaattttataacagtaaatatatttaattaattatctaatggagtaatattttttcttattttgcgtatggcttataaactcatttcaaagtttcaaactctgtttagaatgggcccttactcgatataattgaactggttcttcgtagcctttttagctggccttttttttctctctctctctctctctttcagaatttttcccatcacacaacataatttttattcagtaaaaataccactgtttgtgtgccgtataacaaagaccggtgatgtaaaacatttttattaacaaaataatctatgtgaaaagtgtacgtggtcagtcggaaaaatataaaacagtcattcggacaggtgttccgtgtcggcagtcagctgtacatttcattttgcacacgtgttgtttcacaggctcacagctgcactacgaaagcgaccaaagtgctacggcatgttgggcccctttgaatcaaagggtttatctagaaattttataggattcaaatcctataggaaattttcctacttgaccctttgattcaaaggattgaatttttccaaatcctataaaattcctatgtaatgacacattgtatgcggattttggaggaaatatagcaagagctttaacctcttggaaaattccttttgagtctatctctctcatccgattcctgcgtttttcctacgctccaatcaaacaaccattcctgtgttttgcaatcctctattttacacttcaattcctattagaatcctgtgtttttcctattcctctattttttcaaccctggacttgcaaaattgcaattgccagttcacatttcaggtttggatctactgatcctggattagccacttggtgctctcactcaacggatacgtgtagatcccttcgcacggcgcaaactgattcaggttggtcacctaaacactgccagaaaaaaaaggtttttcttttaagaatacacataagatttgtgtatctttgtagtattaagaacaaaaaaaaatggagaaagttttgctttgggcttttgctcagttgacttttaacacgtcaaattttgcacagttcgtcaactagtgatgggattcaactgcagatttgtcatcttgatctgtgacgacgaatgcacgatatgactatgtaataacaattttcatgtacgtaattgaaagctaaattgagtttccaattcagctgttcatgacccataactgatgtatgatcagtgtctgatgatcaattaattcctcatggaagtacattgattcaggtcatgggattgatcaattccatgccattttcagagactgttgctttcttgagtactttgaattcaagatcaatctaaccgattccaattatttttcctggagtcacgctctttctctttcatttaattgctgtattttataaacttgaatcataatttaatcaaagtcaaaacccacagcatctgatttgtccgttgtgctgtctgctacttggttacgtctgtgttgtctgctacctgaactgaaactggaaccggtccaggatggatgccttgttttcatgtcaaaatctgctggctacacacaatcacaagtaacccagttaattagtctacaaaaataaaagtaacctaagtctaccaaaaaaaagtaacctagttgatcagatcgagaccgtggcatgccctagcagcactacaggattgatcatcgatttggttgactgctcataaatcatcataactgaacaatgttggtgtaagttcatatttgccgccttctattctgacggccaaatttgttggaagttgctacggtctgccataaatcattaaattgtgcccatgctatccacaagaaaataacaggagagattcttttgtctgcgagattgtggaaaaacacaaccttatttctctttatttcattgtttcttgcaactccacgatagtgatgtaagtatggatgaacagtttgaaatataatgtataaaatcaaggaatgggaagaggagcaagaacttgaacatgacaaagacatgacaagagaaaatataggccagtcaaacctggtattgcttcaccgcatgcactcctcttactttaacagtctattttttttataatgtttgatagtctaattaggacggctatagattattgacgtctatttatttttaagtagtcattagatttttgtttattttaagaagcacatcaagatacacgtacagtcattagtcaaactcttgttgaacagtatggaaatgtccctcaggttctcatgcaaagattgccaactaagcacgcccacatttctctcccaatttccataaaaaatactttttttctcccaagcttctttgacattaatttattatactgtaaattataatatccaatgaatggtttgtgcttgacataatgaaaggtcagaatccgagcaaatatttttccttatctactgacccgttgtgataagaaaagaatttgaggatatctaatggccggaatttgttctttgtcaataaaagaagcacgttcagaaatgagcttctttcagtcagaaaaatggtactactaactgctagctagtactagcgtgcgtgtcaaatatgaattcacgctccgatcttccaatcctaatcagtaatttgtcacgcaatcttgcttcaaaacaaccggccgtaccgttcaatacggtgcatgcttgcaacattgacatctgaattaaggaaatgttcgcccaattctgttgatgttttgatgatgggagagccattcaatttagactcggttttgcaaagacgcatgctggcagcatgctcagtttgacatcgtgtgtaaatactctgcaaatttggtcatgcagatcagcctttcagatttcagctgcatacgtacacaagtacttgcatttactgatgatcgtttggactttggaacagatttgagaatcccgagtactgtacttattactacacaattaaccttaagtcaattttcgagggctagaaaattctattattttcttcggatcatgatcagttacgttactggacatataatactatctgctaatccggtcataatcaggcagtatagatcagaacagatgtgctactactgacggatgggtggagccgttaacgaaatgaagcggacagctgaaagttgcagtcagagacaagagaatgtcagctacactcatgaagtcttggaaatttgcagaaagtctaatccgtatactgctcctggccattattaaggaattaaaatgccggcctatttcagttaacccgtggaagtagtagtcagctagtgcgatctctgtagtgggataatagcacttgcgtagccatgtcatgggataatagtagccacaagaactaatttctcacaaaaagaataatcaataactaattctatgttcctcctacagactaatcctatgattctttaaaattttctatataaattgtttagaattgtaatagttaattttattcgtttataactctcgtgcctcctcgaatatcaataaaaacccgataattcatcatttattcatctattaaaaccccatgtgagatagattattctgcttcattataggaagaaattaaatttttaagaaaggaaaaagtccaaattaccctattaactattgcgacaatacaaattccctcttaaccacaaaaccagacatcattcaccttaacttctcataatggacgaattacccccctgagtctctttagagcggttttcgtcttatgtgacacacacgtagcagtccaatcagcattaaaaatttaaaaatagtgggcccacatatcatacgtgagcaatggaggatgaggggagatatgacatgtgggcccactatatttttaaatttttatgctgattggactgccacatatgcgtcatgtggaacgaaaactgtctagagagactagggggtaattcgtccgatataaaaagttgagaatgaaggatatctagttttgtgattcaggaggtaatttgtattgttgcaaatagttcaggaggtaattcagacttttctctttaagaaataaacttaacttgtactaacttataacatgtggtctaaacaatatcgagaatttttcttataagaaaacgtactggctccatattttcatattttttttatagatgaggtcactgatttttaaacatatgtttcactattcatctggtcaaatgaatggtcaaacatctattaaaaattaatggtgtcatctataaaataatagaagaaatgtattttgtagatacatagagtaaataatcaggtgaaagaacggaaccggaacaatcaaactgggacctcaaatatgctaaagatgaagattaagtacggtaaaaaattaatacataattagttgagttttaatattttaaatttgaaaaatcgatttatgagatatttataaaatacaccattttacagttttaaaaaatacattaataaaaatcaaaataaaatctgtaacttaatcaggtttaactgttcagagagtttagcaactactcccttcgtctaaaaaaaataaatctagtactgaatgtgacatactgtagtacaataaatttaaatagagatatgttcagattcataatattatgatgtgtcacatttagtaagttggttttttataggacggatagtttgtggctggtttttcagcaacattggggggagttggggacaaagaagtcaataattcaccgcaacactgccaccggtaaatccagagagagagagagacaggacacagctgaggagagagaaaccactgcaacccaaggctagccgcctcactccctctctctgtttcctcttcttcttcttcctcccgccggtcagctcagctcgcctcgtctcctccattttggcgacgcgagcgagcatattaaagctgtgccggcggctgcaactttgccgccatttatttagctccggctcttttaaaagctctcttctcctgctgccatcttcttctggttggcaccaccattccatatataccatctccctcctcctcccgcgctcgctcttcgccaatggccaagcgacgcagcaacggcgagaccgccgccgcgagcagcgacgactctagctccggcgtctgcggcggcggcggcggcggtgaggttgagccgaggcggcggcagaagcggccgcggaggagcgccccgcgggattgcccctcccagcgcagctccgcgttccgcggcgtcacacggtgcgtgcgttggctggccggattttctcaccggcgtacgttcgccgcactgggctgacagcgtttgtggtttggatttttttttttttggcgcgcaggcaccggtggacggggcggttcgaggcgcatctctgggacaagaacacctggaacgagtcgcagagcaagaagggcagacaaggtatcatcaccaatcactccattaatccaccttatagttgcatccctcgagctgctcgtcagacaatttgctcattctgatttcgctgcgttctctcttgttgctctgattttgcgatcggattggcgtggccggacgaacagtttacctcggtgagctcccaatctgaacattctgaaaccaaaatccatggccacgcagaaggattgtttgctgaccacctcactgtctgtgcgccggcgttgcaggggcttacgacggcgaggaagcggcggcgcgcgcctacgacctcgccgcattgaagtactggggccacgacaccgtcctcaacttccctgtacgtggcatacgcctctccaaaaatccatggcatctttctctgaactgaatcctctgcacaagcgttcttcggaacccttcaagaaatgcacgcacagtgcagcttgtttgattctgtttggttttctgaggaagattgttgctgtttttctcatgttggaactctctgcagctgtcaacatatgacgaggaattgaaggaaatggaggggcagtccagggaagagtacatcggatcgctccggaggtaaatattcagttaaccccatgttaccactgactttcaacaaagagaagttaattcagatcattacaaactttcagaaaaatccaaatcaaaacccattgaaatatgcttctctgatcagacatagtgaaatattcatgtctgagaagctgtgttttgaagtagttcttcttgattaagatcataaacctttttcaccctgcaggaagagcagtggcttctcaagaggggtgtccaagtacagaggagttgcaaggtagttaatcagtactaatctacactgaaggttccagttttctactgaacattgctagtagaatcagttaattaacagctgttttattcaggcatcatcacaacggcaaatgggaggctcggattgggcgtgtgttcggcaacaaatacctctacctaggtacttatggtaagtagtttgtgactttgttatatatgtatgcattaaaatgttcttaaactggtaatcagtcatctatcttgcgggtaaaaagctttgaaatagtataaattttacaatggaatagattcttcttatctgagtcagcttgcgttatcaaaaaggtagccattgggtgtcgttgttagataggtgacacctgttagttgcaaaggaaacagagaattttttagacacatccaagaacattgctgatgtgttggcttcaagacttcagacaagtagaacctaactactaactactcctttgcaaagacgaaaaggcacttggtgaagtaaagatgaaaaggcacattagagatagtttggaaagaatgtcactgaattcaaaagagctttcaaactatggctatccaaactaggattcgaagaaattgaataggataaagttcatgatctttgggataagattcgccgagttatgtttgaagcagccgatggccatactctggtagggccagttcatctgaatgccacagaaatgtttccgtacgctgtagctaaaagccgaccgatgcggtccagctctgactaggatggacgacctttgtttgattttgtgcgcaactatgtgcaaaatttccagcatgaactgaattgacgattttagacctgtttcctttcgtcaataattcataaatcaccatggcatccgtatgaattggccaccaactgttgtgtctagttgctgcagaaaccggtggcatgatgtgccgtgcatctgcacaaattcaaatcagttttattagctaaccgtaacgttgcctctttgtcacatctgtacaacaatacaagggacgtgcaatccagaaaaaaaaaaagtccacaacgaccggtatgttgaacaagtcggtatatgtggattatttgcttcacacttcttttaaaaaatgtggtgcatttcttcttggttcacttgctataagttacttactctgtcctaaaataaatcaatctaggtgacgatctgacacaatcacacaatctctttgtccagattcattgtaccacctagattggtttattctttatgtattatgtatttattaggtttattatatataatatttaagttttcgtataatcaagtagataatctatcaacatacatatgcgagcaatatgtttgaaacactaattctaaaagtacactttgaagtcaaggacggaggcaggagtttgctaagcctaaggctcaacaaatgtaacttgttagattttcaaaattttcaattttttttggatgaatttaaatgggattgatttagcaagcgcactttatagtcgttatattccctcctgtccgtggggcccacagacagacaggcaccaagcagtggcaactggcaaggccactggttcactgggcctggacgcaggcaggatggcaggagacaggagtcccaggcagccacacgccacagtgacccactcccacacccaactcagcaatgcacagccacaaaaccaaaccacgctctttctttcttcttcttcttttttttttccttttcttttctctttttttgcgggagaaacctcgctcatctcatctaagccaccatcttgtttttttctgaacgaaatttaccatttcatatggatttcctctgctatgttttttttatttgttcatggctcacggtgctcttttttccgtacgatctgtcagcaacacaagaggaggcggccgtggcgtacgacatcgcggcgatcgagcaccgcggcctcaacgccgtcaccaacttcgacatcaatctctacatcaggtggtaccacggctcttgccgctccagcagcgccgccgccgccaccaccatcgaagacgatgatttcgccgaagccatcgccgccgcgttgcaaggcgtcgacgagcagccgtcgtcgtcgccggcgacgacgcgccagctgcaaaccgcggacgacgacgacgacgacctcgtggcgcagctcccgccccagctgaggccgctggctcgcgcggcgtccacctccccgatcggactgctgctgcggtcgcccaagttcaaggagatcatcgagcaggcggcggccgcggcggcgtcgtcctctggtagcagcagtagcagcagcacagactcaccttcttcttcgtcgtcgtcatcgctgtcgccgtcgccattgccatcgccgccgccgcagcagcagccaaccgtaccgaaggacgaccagtacaacgtcgacatgtcgtcggtggcggcggcgaggtgcagcttcccggacgacgtgcagacgtacttcgggctggacgacgacggcttcgggtacccggaggtggacacgttcttgttcggggatttgggcgcgtacgcggcgcccatgtttcagttcgagctcgacgtctgaactctcaactccgaccagggtgtttcgggaggcccacaatcccagcctgttcccgtagatgggctggaaagatcgaatcaaatttgggcctattcaggggatgggctgggagaattgatatgggccggcagggatggccgaaagggaaggcctcccaagttttggctgtcaagaagctagaactgagttctctctcaaaagagagagagagagagaagctagaactgaggattagttgcttactcgcaaatactagtagtttggaggaagagtaaaatattggtttatttgttgcccatctctgcgaaggggaatttaccgtaataaagagtacatattgccgtttttatacgaaggctagtttatgcgtttcatcgcaagttatttcctgttgcaataaacctgcattgttatacatcatcaattctatttttttcgcattaaaaaatctaccttttcttttttatgttaaaaagaacgcttcaataacttccactaaaaatccgcaaatcctagccatccgattagagatcaagggctgaaacgatctccttccccaacggccggtgccaaaaacgaaccattacttccactaccccacaccgcagcgcacgcgcatgtgggattcccctcctcctcttcctcttcccgccctccccctccactccacctctctcccctctcctcaacccaaccgcccaatcgaatcccccaaaccgcagcaacggcggcgcggcgcggcggaaaccctagctctaccctcctcctccggtcgcatcctccccggcatcgccgccgatggcgggccctcccggcccggcaccgggcacctcctcctcctcctcctccctgcccagccgccgccgccgccgcccccctccgcgcctcggccgacgccgcggcggcgatgatcaacagcccccgcatcctccaaaggcctcgtcggaggctctcccctgcgcggcctccccgcccgcgcggtgccgcggcggtgatcaccagcccccgcatcctcccgaggccgcgttagaggctctccgcggcgcggcctcccctcccgcgcggcgccgcggcggtgatctacatccctcgcatcctcccgaggccgcgtcggaggctctccgcggcgcggcctcccctcccgagcggcgccgcggcggtgatcgacagccctcgcatcctaccgaggccgcgtcggaggctccctccggctcggcctccccgcccgcgcggcgccgcggcggcgatcaacagcctccgcccgctgtggcggtggcggtgactagtgaaggcggcgtgggtccccgccgctcgttccgcatcagcctgcggcaccgcgtgcgtgtggtcccgtgggtgaagccacccgtggcgaggaagcccaaggaccccgcgaagcccccgcgcccgtcgatcgaggcgctcgcggcggaatgggcgaaggagaaggcagcttccggggcccccgaggaggagtgcgtcctgcctttcctccagaaagatgcgcctaagaaggtagcgagctgaaactatcgaattcgttctcttctagtagtagcatttggctcccagggttcgatcgttaggttgcgtgggtaattaatgcactagttcccctcttcgggcttccttgcgatgttctatggtggatttgcccctgcacactacgaaaattgcagcctattgctgttgtggtgctttgatttctccgtggaagggtggtattttggcaatctggggttgtatgacctcagaattcaactattagcaaatgtagggtccaactttgtgtataagggttacaactagatatgtcttcattttggtaatatgacagtatgttgatatcgccttctacttctaggatatgaaattaaagtatagctgcctccatttattttaggcaattttacaccgtgtcatctgaaacgtgtttataaacgttcatgcttttggttaaaagtttttgtttcctgttactttttgacacgtgagctgtgagaaactcattgtctgcatcgcctgaagtgtatagaactttatataactctgggtttcttgatggttcagaaatctagtgtagctgtatatggtctggacatttgtagcatcactgtacaatctgctgattcaattttggactatctgtataacacccttttgttatgctttatattacagaccagctaatagcacaaatgtttgattcactgttagcaccactgtatattgtgactggttagaatgactacaattgttgtcatgggtcacccagaaatttgagaaatacaacataagatttttagctttcttgagaagaggtggatggcagagaatttggggtacaggctgaaatttcatatcggttttcatcattatataatcttgataagctcgacattgtaaaagttcttggactagatggatttggatatatggatacagtgatattgagcttgaaggtatagcaagggctgcaacagggatatggatggctaagggttaaatcttcaatttttgtagagttacaggaaaaacattcccattacagtaggaaatgtaagtggaatggaaattcattttgtgttaggacagttggactaaggacaccaactgtatttccaagaaagctagtttcattaaattttgggtagctggttattaaaagcataatgagaaaccaagttaaatggtgaatggtgatggaattcaaagtttgtaaacaacagataacgatttgtagaaatggtacaaatgataggtcactttctgtacatatatgaatatggactgaactgatcgtggaaagcaagtaatatctgaagagaaaatatggaagagttaagctctatgcaagaaaaagagctggatgtataggagtaaacattttcttaattaaggcagggatggggcttgaactgtagtcctcaactactgcgcataatcgcatatgggaatgggatgtcgatctatatgcatgcaacctgaagaaactgaatttttgctgaagaggtcagatatttgtatggatgtctccctctcccatgagaaaccctgatgtatattatatgttgctcaaatgttctccatacagtaattattcagtaacctgtatagaaattgatgactatgcgattatttaactaataactggtagaagaagctcatattattagagtctgaatagatggaggtttggaggcattgcttgccgctgttattcaaatgtctggttgctgataaataacaggaaaggaagcttagaactgctgtataaatgaagtcagtgtgtggacatcttcagtgtagaattttaaccagagaatcttattagctaatacaagaaagaagaaagcttcatcaagaaatgaaggaagaatgacaagaaaatcttaccatagcattctggtccagctggaaaattttggctcataggatgttaatatcaagttgtctctgctcagtattacttgaatgtatactactcatctgcttttttattgaagtacaaaaggtattgtgacacctcctgattactggaaaaaaggagtcctctaaatcattttggatttaggttgagtgcctggtttgctcaaagagtattctgcctgatgacaagatgtgttgttcagttcgtgattgtgatgcaaagctgcataaggcttgttctgaaaaaggtgatggatgctgtcctcgacatgtacgcttctgaaaccaagttactgctatatttcagttgtttctcaatgttttctcattgcctgaaaaatgaagcagattgaaatatccatatgtacataactgagacttttgacacatctcagccctacataatagcaatcaataattacagtttattgataaagagaaactgagagtttcaaattgcatatgtgtgtcaaccacttatccttatctgcatatgttgcttatttaataaaggggttaatacaagagttggatattggctgatcagagaatgtggatgtaacttgaaaccttaaaccattggcatgtatagctgcaaatttaatgtttcatcgtttcctcaccatgaccaggcgttaaaatgattttgcacttagtgaagattaattagtaatgtcatgagaatagagtgcctcattgaaaacgccatcctactatttatgagtttgcttactatatgttgcaaaagattactgggttgacttagagtttttcttaaatccttatttaaaatattaagaatttaatacctgtacctgctttgtttctattaacattacttgattctctgttagatgtctttatttctgcaatttttttctgtcttttgatggtaatttcattgatatcgtgatatcttgctaattacaggatgcaggtccaacagatggtatagaggtgatctatacttccttttcataggtctcatctgtattattgaacactacaacctatctatatgtgtaaggtgcatcacctattctttaaagttggctgcttagatgtgactgagtctgatgcatagcattatgttagatcacatgtttttgtttcacttgctcagtgaagaattttattagttgctaacttgatttttgaaaaatgatttgattctttactcattctatatgtgcttgtttgaatctgtgatgatttgtttcgtggaaacaaattgaaggataaaatgtgacagcaatggatgtctttctagtttttcagttcagtattttgtttctacaatttttctttgatgtgtgctctgattgatttacaggaagccttccggcgcttacccctcccacacactttccaagagttcaacattgaccctataaagaaagaggaattggacaatgggacagaaccacctccatatgtacacatgaagcgtagtatccttttattgcttgtaatttaaaatatgcacctttttctatttacaggtagctctatttagtgtaaaaggagtttatgcttatccagtttttactccttttgctttgagtgcttcaacaactattgttcccttaatgaactaagatctttatcttgtcaagaacaaatgtgatgatgattccattgaaggtggatgcactaattgtctccctgattttacctgtaaattaagctgttcatgcaggtacaaagtatccattccatttattatgtgcagcttatcagactttctcctgttgctcattggatatagtgttttctcttatgctcattggccataaatgtatgtggatttaaaaagaaaatatatattttttatttttttacagaaaattaagataattcctacaggtctctattggttagctgctctcgggcttgtcactgctcagatgagtgcactaacaaaccatttcgccgacagaaaaagattgagatcgttaaggtaaggcttgtcatggactgctgagtttttggagggcagttaagttccatagttgtcttggtgatattgatacatgtaaggatcttttcctaaagtactaatgctgcccttttctttatgtgttcttatgctgtgcttgattgtgctttggagatctgattttgaaattattttctgtcactattgtttctctttgacaacctacttattagtggaatacttctgcagacacaatattgtggatggggatctagagcactggaagccattgagaaagatgattttgtcatagaatttgttggagaaggtataagatattcattatttggtttgcttagacattttattgtaatttattcagatcactgcttcttcttacttatgcttttgtggactattttatcaaaggattttacatatgttaaacctgttaaattactttcatagggcagtactgaaggaacttgcctgaaaactttttagctctgcttacttttgtttattgcagaacaatagttctacctttcgtacctgccaactttcccaatttacctatctagatgatttggtagaaacacactaataactgggctttgttttctccccgaaaaaaaaactattaccaggacaaagttagatctattttagcttattttccaacttaatattggaatacctttttccacatgataatgtatatttcagcatagtttgatgttccatactattgcctctgtaacacttttttatgcagtgctaagatatgccctttgtttgttgtttattatagcagtctatcggttaattgtatatgatatttaaacttacctttttatccttgctcctttctggctgctaataattaaattaatgttatatggtcatgcgtcatgaatcgttttaaaaccagatctaccaggcaaacctgttactgttaagtaaaacatagtataatccagttaacaattataacttgctgagttatcggtataatcacctaacaggccatttgcaaggttagtgtagttaagcctcacttgtcaagctcatttatggcttatactccctccgtttctaaatatttga

SEQ ID NO: 13646 - DNA, 41765 bp, Oryza sativa
  unsure (1)..(41765): unsure at all n locations
gcgtcaaatatttagaaacggagggagtattttatttattttgtgcgcaacaacttagacatggttttattttttagttgattaccccgtgccttaccatctttgcaaaattgtaatggaggtattagaaaattaaagaatcaagatccctcattttgtggatctactcatgtagaaacatcccttctaagttccatgttcaatgtccattgaattagtagtgtgctttggagcaaatggttgttgtgatgaccttcatagtgtctattgatcctagtgaggcactgttcataattttcttgcaatttttgctatagtatttaataacactattctgaccagatcattgatacaatcttcttccagagctgtttgaaaaggcagtgtattttaaattataattttctttccagatatcagttctattgaagagaatgcttttgagtggcgctcactaatatactggtctgtcttctatgttttccaaatgatgcaacttccttttaattctctgttcttaacatgctataccagttattgatgatgagacttgtgaagaaaggcttgaggacatgagaaggcgtggagataagaatttctacatgtgtaaagtcaaaaaggactttgtaattgatgcaacattcaaaggaaatgattgccgcttttttaaccacagttgtgaacctaattgccagttacagaaatggttagagtgctctttactcgctgatgcattatatcaatttcacattttgcttagggttgttttcttgttaaattggtcatttggtagctaagctttctgcttaaacaaattaagattgtttcaattacttttttttttgtttttccaggcaagtcaatggcaagacaaggctaggtgtgtttgcttcaaaagctatagaagtgggggaacccttgacctacgactacaggtacctgttcttatcaccatgaagggtttttgtcctttacagcacgagaattttaacctgatttttataacctatctttttaccatcaaagatttttcttattctcgcattattcagttttcgcctgctgaagtgcataactcagaactgttagctcagcctacaaaatattatgaccataaaaatatatgttgagacttctattcaattatatgtgtaatactaattactccctccgtttcacaatgtaagtcattctagtatttttcacattcatattgattttaatgaatctagatagatatatatgtctagattcattaatatcaatatgaatgtgggaaatgttagaatgacttacattgtgaaacggagggagtactaagtattggtaattatgtttcatagttctttttgcatgtttatcccagtttcatttgagtacttggtaaatccttgaaaagtactacctccatttcagattataagactttctagcattgcccacattcatatatgtatgcctagattcgttaacatctatatgaatgtgggcaatgctagaaagtcttataatatgaaacggaggaagtatatattacctatcactatatgacaattgaatctgctttctttggcctcaaatatatatatcttttgtacggagtacatacacgcaaccgagattttcaaaacttagtatcaatatcttattttaatattttgattggtaaatatgagaatcatatgatatttgcatatttctcttgaaaaacactatcagaatagaatattatttctactccctctggttattaatatcacttttgggcataaatgcaatgcaaccaaaattcgaaattttgagtatcaacattttttttccttatttggattgcatatatgaaaatcgtctgctcatttgtcatgaaaattactttcataggattttttttatttgggtcgtacatccccttgtgtgaaagtaatttcttagtatatatttatactccaaaggaatttttcatgacaattactttcttatttgagtatatatttaatacactcattagtgaccatcaaagagatttttccataaacaaaataaaaaaaacagttgtcatattactttggttcaaaaggtgttgaacagaatcacaaagagatcctctatttgcttgaaaaaggatatgcatgatgcagttgatgaccacagtattctggcttctgttttgtagattcgagcaacattatggtcctgaaatagaatgtttttgcggggctcaaaactgccaagggaatatgtctgtgagtggtaaagattgatttaagttgtatgctgttaggaggtacatagaaggtccaaggccatggcaaatggcagtaaattcaacatatagtgaatattgattgggaagcacattctattcctgtctttacaatgtgtcatagacaatttgttcgtactcatccttctggtttaggcttgcaatagtgttatacaatagggtaccctatacaccattctttgatgtgttcaaattttactactatgtaagtacgacaaacgcatagtgtaaatattgatacagtgctatatactattctttagactccatatatcctaaactttgagtgaacgtctgtctagcaccctacactataaaaccatatgcatctgaatttgttctgagtatactccatttccctctagatagttggagggtgtttttatacctagcaaggacaagtattggaggagattagaatttgcagtaactatttactgaatgtttttgcaagtgtttgttattagtatgtctgaagttagggctatcaaccaagcaagcttgagctggatagaagctcaggtcgagcctaaattggcctacaagctagctttcatgtcaggaggctcaatgaagcgctcgataccagcattttttagcatgaaacctcttattgaagatgggagatcagcttttaataaatcaacagctatattttaatacagtttgtaaagaaagcctcagtgaaatcaattataagttgcaaccataaaacaatctgaagcattgtgtgtcatcgttttgattatcatagctcatagatgggcactccgccactccgtagttcagttgtaccatacagattcctcatgaatgacccactggcccagacggctccccaagaaatcaatcgcctgggccatgaccatgacactgccaagcatgcatagcatagtactccttttgcagattaaggaaagtgacaatgctgcaccctagattttcgtgagaacaatgcatccaacattcccactatcagattcgatcatttactgttgcacatacaaaaagaaatggagtgattatctttacaggtcacaaagcagtcaaaatgactccatgtctctctcaaggctctatcaacatccctccccttacatacagtgatacagataaggagttcagaattcagaagaagcccatacatatatgaacaggggtgtactgcaaaagtttgctcgagatcagggccagaatgcaaaccaaaggtcttctgcagcgctgcatgtgccatgtccgtccccaaatcaacaaaagaaagagagaaaagaaagcagcagcagcaaaagataaagaagcctgtgaaaagaagcaaaagagaaaccggagaggaggagcccctttttctttacatctttctcggggaaagggcctctctttgatcagacagaaactacacactgtggtctaaaactaaaaagcatctcaatcactttgaaactactcgtactactccagctagcaacaaatccaatcccttccctctgtaatatatttttcttctctttttttcctgaagtactctccctgaatatctgattctctgaatttctttttcagtgctctgaatgctctgctgcattctgctgctaccttggccctgacagctccatctcctctaccatgtcgatggaccgcacctcgtcgctgctaaggctgctgtcgttgtcgtggaagtcgttgaagaagacggagccgttggagtcgttgcggtggtcgtagccgagctcatggggcgccgccgccgccgccatcgccgccggccggtggttggcctcccatttctcggcgagcccgtctccctccagcatccggaccacctccgacatcctcggccggtgagacggctggaactgggtgcagagcagcgccacctgcaccatctccgccacctctatcctgtcgtagtgaggccccaaatcttggtccactagcaagtcatgcagcttctcttggtgcaccttcctcaccttcattttgataacacgatcgaacgaaaacaaaaaagaagaaaattttcagatcatttacacatggagattaagtagttgaagacattgtcatttttcagaagcaagtcatttgcatgccatatgcagagtgaacagtacgtgggaggacgatcagcattcaaacatgcagtggcaatgcttgcaggattgcgttagtatgtcaggttcatagtactcgcaattaatcttagactgacagttggggcgcctactgactactgtcattcgagcatcagattcactagaagttgctattgaatgagcagcgcctcaaagtgcagtgagccagtgaccgcgcgcgcaatgaacgcacatgctagtgtactggatggatctttcgcaaaagatttgcgaactttaccaaagacattcacgtacgggctcgatcaaagcaaccgaggcttttaattcgtcaaacaagaactagtgcaacatcttttcgatcacggctcaaacagcagctaaaaaaagctgaaaattggagaagaaatgtggaagtgcatgcttacccaatcgagcatgacgcccttctggtgctggatgacgccggagcccttgccgacctcgagcgcgcgctggccggtgacgagctcgagcagcaggatgccgaagccgaacacgtcggtcttctccgacgactgccccgtggagaggtactccggcgcgatgtgccccaccgtgccgcgcaccgccgtggtgacgtgggagtcgccgtggtcgagcagcttggcgagcccgaagtcgccgacgacggcctcgtggcactcgtccagcagcacgttcgcggccttcacgtcgcggtggatgatctttgggtcgcactgctcgtgcaggtacagcaatcccctcgccgtccccaccgcgatccgcttcctcgtctgccagtccagcggcggcttcccttcataaattttttgcgtaacaaatgtttcaacaaaatttgctccaaacaatttcagttctcaatgcgcagcacaagacaacaaaacgccaattgcttgtgagtataaatgctgcatacagttgctatgtttgaaccagcaaggtacgtagggtatacagaacccgtacgtccccctgcatcgtgaacaaaaaccacgaacgcggccaacgtacgtactactgaaataacgacgtgtacagtatgccacaaacttgttggcacatgcgagcacgcagcaacaagccggcaacagcgaccagacacacgggctcgtagcgtagctggggcacgtatagcctgtgctgccgctggctgcctcccctgcaacagctgcggctagggagaggaggaggccggccccctgccggaataaaagaagaaacaaacgtttccctgcaactcccctgaccggtggccccctcccacccggaccaccacaccgatctccaaaaaccccaagcaccgtggcagcactactcctactgttactccctctgttccaaaataagtacaattatggttttccgcgtctaactttaaccgttcgtcttatttaaaaactttttgaaaaaattaaaaacataagccatgaataaagtactattcatgttttatcatctcataacaacaaaaatactaattataaaaaaatttcaaataaaacggataatcaaagttgggtacagaaacttatggctacacttattttgggacggaggtagtactgtataaaaaccatcgcaatgatcgcgttacacccagacctcaaccctgagcccctgatgaccactcgtcatcatgtttgcccaatttactgctacagccgcggcggccggtgaaccagccgcacgccgttgttgcgccgcgcagcgaggaaggacgcgcacgccggtgaagcggacaaaacgtgagtgcggtggcgcctggcgagtggggcccgtgggggaggaggcaaagtacaggacggggtggaggcgcgaccacgcctgaccacgctgacacacagggggacggggactacgactgatccatccccatgactcctgcgtgcaccccaacgcgcacgcgggacccacacaccacgcacccacgaaatcgacactaccactgtgttgcgtgtgtcacgttaagcgtacgtaacgtacctcgaaggcgggaggcgacgctgccgttgggcatgtaggggtagacgaggaggcgctcgccggaggccgcggcgcagaagccgacgaggcggaggaggtggcggtgcacggcgaggctgatcatctccacctccgtccggaactgcgcctccccggacgcggtcgggtccttgagccgcttcaccgccacgaccgtgccgtcggagagcctcccccggtacacgtccccgaaccctcctttccccagtatgttcctcgcgctgaacccgtccgtcgccgcgtgcagctccctcagcccgaactgcctcacgttccccagcctcgccatcacctcccctcctcccccatcctccacgtctctccccttctctgaaatcaccaattacactcacatattaactaactgatcgatcgtgcattttagtactggtgttgatggggacgtggcgtaccgaggatgccgaggacggaggaggggcccgagaggaggcagcggtgccggcgcctgcgcctccagagaaagcaggagacggcgaggagcacaagcgcggaggcgccaaggcttgtccctactccgatcggcaaccgcgcggcgcctcctccaccctttgacctccccaccgctgccgctgccgcccctgcagtgcacacgtacaccgcgcatgcatgcacatacgcccaaacgaacacgattaaactccctccgatcccccaaaccgatcgatcccaagaatgcaaagacaagacgagaggaggttggactcactgctgctgctgctcggagtggagtccagcgggaatggcacggtgaccggggcgaccacggtggcgcactccgctgcgttcgcgttccccgcatggctgccgctgctgctcccgcatatcattggattgcccacgacgctgcatgcgtgcacgcataacatgattgaaaaaggaaaaaaaaacacggcatcagattcgaaaacatccaagggatatttctatagtattttataagttgtaacagagctatagctagtggcggctggaatagaataagaagacgaatgcacgagcagtggtactagggaggagtagtccatacttgaatgttcttgtggggaagtgaggaacagggccagtgaggttgttgtaggacaagtccctgcaaaatcgcatgcacaccaaaccataccaagatcaatcacatcgatccgttcatcggctatgcaagacaaaaagaattgagacgatttgacagagttggattaattagcgtacaggaaggagagctgtgggatcttggccagcgacgacgggaacgccccggacaagctgttgttgtttagcctcctgcggcaagattaacacgcaagtgagacaaccatgaagaacttaaactattttagctttagtgtagagtagtaaagtatggaatggaatggaatgtgttggggggagagaagtgactgacaggtatcggagggtggagaggcggccgagcgtgtcggggacgcggccggagaagcggttgttggagaggtcgagcgtctgcagcctcggcagcgcgcccagctccggcggcagccggccggtgatgttgttgttctgcagcagcctgaaaacaaagtcgaagacaaacgacgtcatcatcaccatttgatgctctgctctgcttcttcctcctccatttctcccaagaacacgagatgaatcgattggaatctctaacagaagcaattaaacaagaaaacaaaagtttctttctcttgcttacacttgttcaagattggtgaggttggcgatcctgccggacagggtccccgacaatccctggctgggcgctcccctgagacgaggtacacaagcacgcattagtggagctgatcgagccggtcggctgccatttccggtctctcgctaagttgctcaaaacaagcaaaagctagacgacgacgacgaagactgagagagagagagagagagagagagagcgagcttacaggccgatgacgaggttgtgggcggagcaggtgaccatggcccagctgcaggggtcgacggagtcctcgtcccagttgttcagcacgccgtgcgggtcgaccagcccctgcctgatggcgatcagcgcctccactgcacgcgcattcgccgcgccaaatacaaccaacatgcggtctcatcagccgcagccatcttcggttccaagaaacgtcagacaagggcacgtaccttcagggttgaggggctcggaggagaaggcgaggaacggcgcgtaggagacgacgaggaagaagaggaggaggaagaggttggaggccattggaatgggggagcggagcagtgggaggaatgatggagaggagaggcgcccgagaggaagaaaagtgagaaggagggagaaggagaagcaggggtgaggggaggcaggcaggcaatcagccgtcgagcgagtggagtagtggctctgctttttctcgtgtgatggaggagggaaaggagaccgggggcggggagtgatgtgactgaatgccatggcaatattgggcatcttttggatgaagatgaaatgatcatgccatggaagctgacaggtggggcccactttgcagtgatcaattttggcctattggggtgagaggggagagggggagagaagaggctttgttttgatcttccaaagggggcccatgatgcagtgagtatgtatgtatgagcttctgaggtgaacattgttttgttttatctttcttctttggcattttatatgggagaattgtagggtttgtggatatacaagagaaggaggcccgtgaaatcgataagcaataatgctattgttatggatatgagtattttcaacacttcattataacgtgttgattcgcacggtacattagggatgagcctccgggggagagagagagcgaggatgaagtctagcggtttgtttggcagagctacaacttccaaatttagctttaggaggttggtctgcagtgaagctgtggaggagcctaaacctagcactctctagttcattttgtgagagagctccatccagctccgctcctattttaggtggagctgaaactgtttggctaagctccagcttccagagagatagagctggagttgagccaaacagacccctaggtgtctttcaatgcatgggttcctaagtgaagagagaatgttgtttatgatcgaaggcgaagagaattgaacaaaaaagttcaaaaattgaaccaagaaagaatttaagagatgttaccaccaagcaggaggtcaccatgggcagcagcgccacaacagggatagatggatcataggtacacaatgccagggacggagatagagtatgggagggggtgcctaggaacccagtcaaaaaaagttataactaccgattttcaccatatatgcacccccctaatacaaatttagacacacccatcagcttaaacttgatataaagtagagtaaattaagcaagaggcaccctcttccatttcgttctagctccgctccagtgccaaattaaagctctcatgctcgaaccaaacactattgtctaaggggtgatcaggggaacaagaggggtttcaacccgtactacccgtacaaaccagtggataccttttttttataaagacatgttcatatttgctaggtataggagaatgtatcgaaactctattcttctaatatattgacgtgcaattcttttgtgcgttcgtgaaaaaaaaggtataggagaagcttaatgatcgtagcataattagttcttttagttttctgaatagatacttataatatattcatgaatttgtttgacttctcttatatttaatccacttaattatatatattagtttgcttcgtttcattggcacctcctaaagtttggttatgcattcgctattggttgtctccttgaccacattcactgtggctacattttcccgagaccgaaatgtattggaggtaaccgaggagagatagagataaaggatcaaggttgatgtcttatgttaaattttcatagacaactctgtcaccactaggatagtgagctagcatcaccatatgttgggtttcaaattgcttattgctgaggacataagaagggtttcaaattattgtttgaccgttgacgagaacacgaggggtgaaaattagttagtatgtctgataagagcaagtttaataatatagtcaactactagctccaagtcaactatagtcaatataatagccaattcatacaatagttatctataagagcagatataatagcagactattagccgactataaacatattttaatgagataaaatatgagagagaaaagcagcagactccaagacgcagcgtgtgtagacaggtgggaccatatattaataatatagtaagcaactattgtatgaattggctattagattgactgtagatgaattggagctactaatgagctatactattaaacttgatttaaacatatactacactattaatacatggtctcacctatcatacacatattgtgtcttggagtccgtgctgcagctggctacagacttgtagctcgctgcttatctctcttcttttatcttctcgatgtgtgtttatagttggcttatattctgctattgtatctgctctaaatgatagtatcctgaggcaaattacacggcacaaaaaaaagtgatcaagtcgatgtatatgaacatacttgatgaaaattctaaagtgtagaaaaatctaattgttgtattatgttattttgtaatctattagattgaccctctcatggggtatatataggagtataaaggagatagagacttggagtataatacaaataagggtagatttatctctaggattctatctctaggactctattttatctctaggattctatctatataatttgtatttggctcttatctctaaccaacatatttgtacttctaacattccccctcagtcgtaacggaagcgaagcgaacaattacgactggatttgaaattttctatttcttcatcttctttgactcaccatcatcgattgcatctctcatggacggtcctccacctggtacctgcgtccccttatgtttcgtcccttgactctcctctattctccctcccgcaatcatagctagagtggcatggacgatagcgatgacatggacgctttgactgaagtttccgtcaatgatttttgttgtggacgttcatcgatgttgccgatcatgaagtagccatggttctaggtgtagccgcatgtagccgaaggcgaaaatttttttacgttgttgtgaagacgaaactgcaattgttaacatcttgcaccttgtagatgtcagaggatgtcattggggacgtcttgcatatgtcaggggatgtcgttggcgatgaggccaccacttttgcttggtccttctgtgccgtgtagtagtgatcacaatagtgataccgagttgatgcagtcgttgtcatcgtaaatgacgtgatcgatgtcgtcgtcgttgatgcggtcgttgtcgtcgtagaggacgcggtcgatgtcgtcgaagaagcgccatgctgatgtatctgtcagatgacgtgaggtgtccatctatatggacgagttggcggcaggaagttgatgaagaccactggtgacgtagaatcggcgaagacgatcgcgtagtcgtacaggttatcgatgcagcggctggcccgatcttgctgtagacttggcgatgatcgataggtgacgttggtcttaaagtagatcagtagatgtacatgctcgtagctgattagatcagtacaatacaagagtatatttatctctaaaattttatctttaggactttattttatctttagaattttatctctagtattatatctctataatttgtatttgacttttatctctaaccaacgcatctgtacttgtaacgtgaagtactaatgatagttccaacttccatgcatgtacttattcattagttagccaattagattccgttgccgaggggagcaatggaattcagaatcagtggcgttttgattcgtttgtcagggatacagagctgccgaacctggcccagggtatctcatgaaaaaaagaagggaataaaagccgttcattcaaaaaagaacgggaaggaaaaaaatcatattaccaaatgacatgtcgaccccgaaaagtgctgggcccacatgccagtgagacacggtccgtagtcgcgtgaagcaacaggtcaggtcaaaggtcagaagcgggtacactgggcgctactggccgtaggagttgtctgcctctccgagtccgggcagttgtacaattgtactataagccaatgtgctagtataccactagtctactctagatcagtacaggcagcgcactcacacacacatactagaacgcacatacatggaaaatgcattgctgatccagatacattctccggttgcgaaacacatggtgtactacgctacgcgaacgtgatgatctctttttcacgtagtactacacatacacccctctctgacaaagccaaagatgcaaaagatgacaagagtgaaaaaagaagcaaaagaaagacagaggagggggaaaggagagagaaacgtttgctgggaaagagaagcaaaagcaaccccccaaagatgagtgaagagaaaaagagacatgcatgcagatgcagtagtaggacatgcatgcagaggggaggcactctggtctctgccgctgctgctgctgctgctgccgctatctcgatccgtggctctcgtcttcctggccggccggccggccagccggtcgggggtctctctgtccctcactccctctctcgttctcttcccttgcattctctcgggccaaaagccgtgcgatccgctgggacaccggcgtgtggagcagggccctgccggctggccgcggcgagaaggggaatcatggccggatggaatggacgtgtagtagtagaatgatgcgtgttcgatcgagaggcgcgcgaacgcgagcttgtcatgatatgttccgcaaccgcgcgtgtcgcatggagtgttcgcggggtctgagttgttcgatcgtgtcggccgcgctagccctgcttcgcggctgctcctgcgtgccaatggcagccgcgaccggtgcacggcgaccgggctgatcggctaaagcgagctagcgagagcgcgactggtgctcatgcataaggtgacaagattaaaggtgcggtttcactagaagttgtgtcgtaccgggtgtatggctgtgtgcactgatcgaatttgtcactggttcctccctgaaaccgacagggtttcaggtgctgatcgagatgaaccaaaatgaacatatatgggttgcagtgtttggtctggctaccgtgttgcttagaagtaaccttgcatcaaccagcatcggtatacatacagacatgccacttgctgactttcatgcgggcaaccagcatcggtatacatacatacatacatattctcgttaactagtattcatcgaaccgagtaactttaagttagagcaaattaatactttaaattggacaaatgaaaaaaaaacatacatgtagattttctccaaaaattctttttttttaaaacaatcagaacaagatgagggcacgatgattcattgaatagtgtattaaaaaattgcaaggtcagtaccttagaaggcagtaataccaggaaaaaataccaccaccacacatcgagagcacctacacaaagtcaaagagaaggctagcacctgatcgaccatcactaaacgtgatcggtcaccgctagaccaataaaggaaggtatagccaggacggctcaaaaccaatccctagactgaactcaactctagccacgcctttgaaattgaggaggagagggtgagagaaaaaaaatggatccgctctccccctatggcccgtcaacgtggccaacttgcataagctaggacacagttgcaagaggataaaacaactagaaagagcttgcatcagctgccagagggaagttttggcaagggacctagatgatgtctccagcgagatgaacgatgatgagcaccaccgtcgccgtctattgaggtctcaaggaggaccaagataaggttttcacctggtagtcctaccagagtaagccatgttcttttttctaacaagagttggatgaagattaaaattttcgtggcacgtttttcaaactgctaaacggtgcgttttgtgtgaaaactttctatatgaaagttgctctaaaatgtcatattaatttatttttcaagtttgtaataattaaaactcaaccaatcatacgttaataccacctcgttttgcgtaaaaaaacttaattttcatctttatttttaagagaaaagaacctgctttaagttgccatatcttggacgatcgctacttaaaaaaagaagaattttcataggccctaccttggaggcttggactactaatatgatgctaaaagaaaacaacgtacattaatttcgcctacaatgatttacacaggcaaaatgtcttaggcaacaactcacattaatgtctaatagcataggtgtgccacaggcaaaatgtcttaggcaacaactcacattaatgtctaatagcataggtgtgccacttaaggtaatgcacgtgaaaattacacataagatggtcataaagaggcccgcctagacaaatgtgtatctgtgtatctttagacaatgctcctaattgtccgtccatgacttacacctttttattttcctcatgccactacttccactacctacacttccatcagtgatcacgactgggcttctcaaaattcgaatcacccgactcctctattgccacgccacacctcctcgcctccaactctttgcctattttccaatacatagagtgtaatgcaagtttttcgccgcaatatctccctctctctgcattctcttctatctctgccatattgggttcgagatgccaacactagtatgtcaccgttagcaaatacttttctctgtctcaaattatagagcactcctgtttctatgaaaatcaaactcgttaaattttgactaacaattacactagcaatatttatactaagtattatgcatactatatatttcaaaatattttatattatactaattttatagttattgataacataatattaaataattaataatcaaattatatcgttgaaaaccatgtaaaaaaatagatcttataatgtgatataatgtgagatagaggaagtagaatgtaaagacagagttgaacacaagaggaccgcctcgccccaacaccatcaccatcacacagaacatcgaacggggaactgacgagtatttcttcaacgggtcgcatatgctcaacttggtgtcacaattcaacaagctgaaggtgctagcaaatcatcaacacaaagttcgtttgaggcaaagacatgtgtcttttggttttcctcggttcatttccttgtggatgtaatgttcgtctgaattcacatatgaaaagagagaaaaattacaccgttggtgtaatttttagttgaagttagttcgttgttctctatgttcaggaggggtactgcccctgttgaatgatgcccaataaaatgtgattaacaactgagaagacatgaccaacagattaaccactacttttcttttagttattttgcatgatgtttgtagttcagtagattgttactgattgcttggtatagttatcaactcacaggggtacatcttcagataattcaaaaatcatacaaccatatccacaatttcatatatatgcataaacaaattctatacataaaaataaaattctattatgaattattcatccacataaatgtgtacatcgataggcaagcgcgtagcgcttattaattagtcattcatcaacacctacacacttatttatgcatacatgaataaggtgatctgaacacatagaacacaaactacacaagctaggaacacacaacaatataatctttggtaagcttcacgcgggtcgtgacgagcttacttgccatggccactgcccgcgtatgagccggctctggaccctgcatacgagccggagccggcaccagagcctccatgcgggccagcaccggagcccgcgtacgagccggcttccgagccagcgtacgaccctgcgcctccgccgttggagccggcatacgagcctgcactggaaccagcgtacgagcctgcgccggagccgccatctccaccattcgagccagcatacgagccagccctggagccggcgtatgaccccgcaccacctggccccgcgttcgagccggctcctgactcagcgctcgagccggccgatgagcctcctccacctgacctcgagctcgaacccgagcttgagccagaccacgaacctgacccagaccctgaaccggagcccgagcctgagccagagtaagacccggagcctgagccagagtaagacccggagccagagccgccgccaccaccaccaccaccaccaccaccgatgcccactccaatccccgagccgagtcccaggccaccgccggtgccgacgcccaatccgccgccaccgccaactccgaggccaccgccgaggttgacgcccaggtccttccttgcagcgcggccctcagccgcgagaacggccgccgcgaccaccgcgacgcccaacacgacgccggccttcacggaagccatatcgcgcaaacgcagacactctagccgtgcacacgcaggtgtctcaacctccggtgaccagtgctcctctgctgtactgctgtgtgtggtgtgatgaactgatggcttgatggattgatgagttcgtggtgggatttagcggtgaaatttatagggagcgcgcgcggttgtggtggtacgcatgcgtgcggtagctagcgcggctcgtcgtgtcgtaaggttttagtgggatttgcgtcggtgtcgcgaggttgtggccgcggccggcggagggcgtcgcgtagtggagcaatccggcctgtcccgcagatttgggcgcgctctcctcagcaatccgagcgacacgtacgtaaggcagaccggaccgagctgatcaacccatgtacgtaccgatcgatcaatcgtacgtcgatcattcgatccactaaacacggctagctagcttccaatcgattgaacgcacgagtgtgacgtattcgatcatgttggggcgtgtgagccaatgtaggtaaatctgtaggatggaatgcatgcagagatgagtccatgcagagcacttcagtttggattacggaagcttcgagagaaggcaatcgatctgaggactcgtgtcttttcatctctggttgaccactggcgctcgtactgcatgattagatttggtggtctccagctagctggtgcgccttgtcgttttctcttgttgtcaacgaaatccatgccacctggagtagttttgatttgacgaacaacgaccaaaccattagttctgcatatgggccgccaagaagcaagcagtgggccgagcttcaacttgacgggaaaaggtataccggaggtccctcatcttaccgccgagttacaaaatcgttcataaaccgaaaaaaacagatatatatatatatatgcatctcttaacttacaaaaccagatcactctaagtcgttagacggttttatccttggttttacctgacgtggcagttgagtcagcgtgtgacccacgtggaccccttcccctcctctcttcacctatctaactactgggtcccacaccattgttcacgctcagttgccacattcacatgccacgtgggcaaaagtagaaaccatctctttagagtggtaaaaaagagagcaaatctaaagggacatttggataactgccaaacttattagtgatgaaaattaaatttcctgtaaaaattagtcgccaacagctcatacacactaaaatgttactattccccaagaaaaaaggttatcgtcgaacacaaattgtgaatcaataataaaaagtttttataacatggccctggcataacccacaagttttttactccctccgtctcataatataagggattttgaatttttgtttgcactgtttgaccaatcgtcttatttaaaaaattttgaaattattattattattattttgacttactttattattcaaattattttaagcacaactttttatttttatatttgcataatttttttaaataagacgaggatggagggagtataacatggcattcatgaaaggaatttttttggcggggcatgaaaggacttcaatcttgacttacaaggacaatcttaaaaattgtagtaggtggtacgttcagaagaggtagatctctggtctctgacacgtaggtggtacttaaaaattgacgggatataaagaaacacgtatgaaacacgtatggatgagtcgatgcatgagcagagtattataaattgagataatttattgtatcggttttaccccgttatataatagacaaaatttaccacaggacacgtaaaaaaacgtgtaattggctgagagacaccgcgaaaatataatacggctgatggacactaaaaaagtataattagccataggacatcggtcgtattattttattatttccaggtcaaaagaggtgagatattttttaaatgcccatattgccccttctctttccttcttttcaccttcccgttgacttcgccgggaacgacacaacagccacagagagcgcggtggggtgaggtcagcacgacgagttgcgacgacattggcggccagggcggttgatggcatggcgccaccttggaggtgtggcgtctggccagatcgatggcgggcggttgacggtagtgccgatgtggcggggcgtggccgagtggaggaggagcttggccgggcagcggcaccaagcgcagggggaggcgccgacgcacggtggcctggcggcggtgccagtcgagctattctctcgcgtgcgctagctagagaggcggttggatcggagggagagcacccagaggccgcgtgcgccgacgagctgtgggcgacgagcccccatctccaactcccttatggccgtcctcgatgaccccttgtcagcagtgtcttcgccgaggccggattccgtagtggggacatcaagctcgccatcctccgcccagctccacccatgccgctcctcggccgcctccccacgcgcacccacccgccgtctctcttcctctgcagcttcgccaccgtggacgaccgacgtcccttcacatgttgtgaatctcgccagcgccggggaggactacgaagccgtcgacactcggtgggcaatccgagcatttcaaaaaaaatatcaccagtttcatcccaaaaatgataaaacaatgtttctagtatcttacagccaattacacaacttttgcagtgtccatgagcagtgtcacgtttttgcgatgtcccgaagccaattatacgtttttttgcgtgtcttgtagcaaaattttcctatataatatgtcacgatagtgtatcaatcatttctgtaatgtatcacatgaccaaattctttctcaaaatatacctaaaacatccttagaaatatagaaggctaacaattaatttatcctacaagaacttaaaaaaatgatatttttaaggcctccttgcacaacataaggatttgtatttgtttgtaagtttcaatatttttacaactataacttatcttttataatctacatacaatactttgtgctcattttttttaatgtaaatcatcatacatgtgctatacgcaatatttgcatggtactatcttttgagtaaacaattcctcgttcatatgtcacacacaaataactttaaaaaataaaacatgaaaacaaatcttaacccatatgctaaaaattctatgcaagaaggctaaaaaattcatatttttaaaaaacttctaacgggattaatcaatctacaatcttctatagtgcattttggccatgtttgagaaagtatccaatcagacgatacattgtagaaacaattaataaacttgatcaatggcatattataaagaaggcaaagttgatggtaaattattaaaccaatacaatgtcagtaatatcctacttcacttcttcttacagtttcttaggacacagtggctcgcaactggctccaaatgttggagatacataaaactttttaagagatagctacaacctactaattcttcatatccttcagcacgaaatttggatctatttgttgtcgctacgttggagtattataatgtcactatactgcaaagcacaaccatgcctacaagcaacttaggcgaagaaaacaaagagctataatctagcttaccttgttaaccacgatcaactggtcagtcgagttactaattgctatcttcccggagtatcttccatgcttagaatttgaggtgtttaggagggagctaggatggcacaatgaataacatattgcacaaaatttccaatgtttgcattttggttctccacatttcaagaatgcatgggatcggaccttcaccaaattagtcaattttatcacagattcagtgttaatcagaaaaatatatggtgaaaccacatgtagggtgaaaattttgaactttcttataaagttttcaaaagaatcacacatatgtcggaaatatgtaaatagacaaccatgcaaaattgcagcaacaaactcaacttcatcagctatataatactagaattatcttagataaatgtgataatttttttaggcgtcactacaaattagaccatcatgggtgtattaggtacagtagtatttaataattggtgctaaccaaagaatttctttttaaaaaagagtcagttttttaggctccaccccaaatgtacaacaaatatacacacggtctccaacccaaataatcaatacttgattttttttatatataaacatcttgtattatattatgatgaagatattttctacgaaaaatctattcattttcataaaaaataaatacccttaatttatatactgttggcatatataattaaatatataattaaggaagaaagttccactgaaaccgtacatttccaaacaagtaaattgcattagcggtaaacgaatttgttaggtgggtgcaatctagcgcatgaacttgaaaaacgcttgttttaatgcacaaacttgtttggtgcgtgcgaaccaaggccaaaatcacacgacaaggtttgatcttgctgatttttttatttgaatgctatgtaaacatgtatcttagaaggattcaaggatatcatgtagacaaagatctgtttagcaaaacatacaataaaggcatagtgattgtataaagaatgaaataaaaaaacaagtaataatgcaaggggtagaaacaaagaaagataaaatagaaaccaagtttacaaatatagcctttctaccatatgtgcatgcacatgatgtactaatttatgatgttcaacttagaagaattagccttttgtgtcgttttggccttagtagtgacgcaccacataagttcatataccaaaacaagcgttttataagtttatgcattaaattgcacccatctaataagttcataaaccgctgatgcaatttactctttccatacaaatcgttaaattaatctattatctctctataatacatctctcctattcatatatcatgaatgaaaatctacttgaatcttctttacatgatttaatcaaatgtatcactttttatttcacagacagcaatggaggcatggagcagtggacactctgaatttttatggcgattggcgacaactctccatgaacagtatcaactgggacatttaatttctgtcttaaatttcttttccaaatacgttactcttatggtgttattggtcacttcggactgtttgtctaacgagctttgttaccgtccatcatcctttttaagtacctcccggtacttgcaattggggctatccgttgagcctgatccaacggttcagaagcctcggtaccacaaggtacaagaatttggaagcctcggtactgcatgcacttgaacaggtggaagggcaaatttggatttttgacatagtgcatccgttttagtagagtccgtacggccgccggcaaccagctcctcccgatcccctccctggagcatcatctgcacagcggcgcggccaagctcgccggttgatccaagttagctggacacctctccgcctcccttattgcaacttgccgccgccacccaaccaacctagctccattttctgatgttgggcccaaaaaatcggtccgtcttcctcctgatgcagatggccattgaagatgatacaaactgctgaatttgtatcgtcaccatgagtcccgagggacaacccagaagacacttcatgcgagccttatgttttcaattttttacgcactctttcttttcttcctcttttttcattcctcccaagcaaaatctctagggagggtttgttttcttactcaccgtatcttttctacaagcaagatctgggccggggttgccgcaccaccacaactgaccggcgaacaacgtcaacgtccctgtgcgaaggccaccgcgtcggggtcactacgccaccgcagccgctgaacgaaatcggtgtcgccgttcgctgacgcgacacgcgtgagtgggaggataggaacgaatcgactagcagtcgccaccccgcccacactagtaactcgtttccttctttggaataccgatcatgaccctgatgacttaatggcttgatttcatttggtacctggcagtactagtaccttgaggtaccacttgatgatggaccgtagaaactctcctctaacatcttgacaacagaaactagaaagcaaacggcaaatgacaattagaacatttttatgatagtatggtaacgtccagaagaatcaacctttttttaagggaaaattgctctagacacacacttgagtgtccatctctccactttagcacaaagttgattgcaattgttattttgccacacactcgcggagtcatcgttttgcggaataagcaaaatgacatatttgcaaacgaaaagtaatttatgaataaaacttttatacacgtgttcttagtaatttaaaagcaaaggttgaaaaataaacttcgatgaaaaaacctcaaaattagctccaaatttaaaatttaaaatttaaattttggctgataagtataagcataagagcaggtacaatagcaggctataagccagctataaacatattttaaagagataaaggaagagagagaagagcagcgggctacagatctgtagccagctgcagcacggactccaagatgtaatgtgtgtatgacatgtgggaccaggtattaatagtatagtaaacaactattatatgaattggctatagatgatttggagttaatactattaagcgaaaagatgaggcaggtggtactcggtacatcataccattttttaaccggaaggtaacattagcaccgactctaccgcccatatatataaccacatgtgtcgggtaacaacaggcgtagctaccctttgccccctctctcacacaatttgactaaacagtggctcatcgtcagtcatcaccatccgcgcgcctagcttagctccaccggtgggctaacggccgtgccactcatgtccctcgcattcactgccgctatatgggctgcggcggccggtctcgccggccacgacgacgacgagcttcctgatcaggcggctgcggaaaccacgccgctcctcctgctgatcctgtctatcacttacttcctagcggtcgccgtgatgtaccgcgagctggccggcggcggcggcgtcaccgtcaccgatcagaagcaggacacggtggtaagacgagacgcttgctagctctcggttgctccttagtacgtgagtgtgtgcacgccggccgatcgacgtcgcggcgacgcgtatagctatatatgtgtactgacgcgtataggtatgtatgtttgattgtatatgctagagtgagatttcgcgcgcggtagaggttacttcgtttttcttttattttcgtggcttgtctgaatgtgaatcggttgtgagacgatgatgtattcgcccgtttgtatatgtttggcccaattgcgcgtttgagtgtgtgcaactgaaatattattttcgttttcatgggttgattgtgaaccgtgatgctttattttgtattccatccatccacaaaagttacacatatttcacatttaagtttttccaaataagttgtttctatttataatctttatgcattcaagacttagatgaagagataaattaaatgtttgattagaacccaaaaagtcatctaaatatttattggttgcatggttacattcactctttaaatttataacatccaagatgatttaatttctttttgattttggtgacaaaagtaatatgtgtaacttttgtggatgtggatggagagagtacaattgtaattctactggttaaaggatttgcaattataccgaatagtagatctagggacgagtataattactagcgtaatacgagtgtcaagcgacaagaaataaagacaaacactcgaaaagttggaacacatagtaaaaaaatcagaagaagcaacgatcgattgcttaatggctgacctgaagtacgtatcattgatttgatcggttacttatgggccaggcaatagctaatgtaacaacttagtactgtatattgaaacgaattccaggtgtcaggcaacacgggtcatagctggtctggctagcccaccctacctaatgggtaggtccgcctagatgcggagctaaaacgagatggagaggatgccacttgtttaatttactatgttttatattaaatttaaactaatatagatgtctaaatttatattgggagagatgtacacatgataaaaaatatgtcagatataggactggttcctaggcatcccctaaatactctagctccccctaggtccacatcatgttattttgtggcaacttactctccggtaattcaaagaacaacacaataattatgatactcgttttcaataataaacggacatttatcctgctaatatcgtcaaaccagcacaatgttcagtaatgagttttcatcagagacttcttctactctctctgtcccataatataaaaacatatgaccagataaaacatttcctaatactatgaatctggacatgttacatgttcagattcctagtaatagtaaatgttccatttgattctagattcttatattttataacgaagggagtatacttttaaaatgtttttgtcggaatagttttctagaaaaagcacaactatttttgtttctttatagttttctagaaaaagcacaactatgtttacattttcaagaaaattatagccgtgaaaatttaaggctgtttaccgacccgtcttcaccccctacttccacaaataattgagagcaaaatggactgatggcaaacatcattcgagtattccagtagattggaaaatgtgagagctatgaagctaggaatatatatatagtattaatattacggatttgctgaaaaagtgtctccatattttgtggctgagtacagtcgaattttaacggctggaatgcgctgtgctggacatcgtgtgcacgatgcacatccgtttctccacctgtttatccctttgtaatttttttactttatttgttgatccggaattgctatgggtttgtagcagtcaattttgttgttgtaattatgtatttatacaaatttacatactagttacaccccacttacaaatcacttatatatgtaattttgagatttacatatgtaattttaagacttacatatgtaattatatgtaattttaggacttacattgtaaatatactaaaattacatatgtaatttagagatttacaatgtaaatacataccgaatattttttgataaaaaatatggtgtcataaatatagctagtcccttaatattatccctcttgctgtccaaatcaagcttaattagctcggacaagagtcccgcggttaccagtagctttcgtgattattattcttattccatccagctcgacgttacatcatttttctaactgaattggttgcgttggtaaattacccgatactgactaattgactacgaacacttgttcttttgctatctaacgtgtactacaatctgctgtgaggttaagttagcaaccaaataccaagggggggtgcgcactgcgcagtgatgctggcccgttttgacagatcgggccaacatgacagcattgaccgaaacctaaaaggaataagttcactttgagtccctctatttgccaccaggacgattttcgtcccttgaccacaaaaccgggtatgacccgtcccccaacttacgaaaaccgtacagacgagatccctcagcagttttgaaggtggttttggctgatgtgacgcctacgtggcttgtttgactagatattcgtcacacgtggcattggcgtgacgtttacgtggcaattatatctcgaaaaaataataaaaaacatgggacccacatgtcagctaaaaataataattttaaaatggtggccccacatgtcagctactcctcccttcttccccctcccttctctctcatattcatcgtcctctcttcttcatgtgcgcagggggaaggaggcgaggcgaggcgacgggaccatcccccacaccgacaccacccccagcgcgccgccaccgccggcatcttcgtcttcctcctcgccgccgccgctgccgctgccgccagcatcttcgtcttcctcctccgccgtcaccgcctacatcttcgtcttcctcctcgccgccgccgccgccgcagcaaccgcagcaagcaggccggcgacgacgacgtggagatggccgaggggaggaacaacaaggtcgccgacggcggcagcaccgatgactcgacgaccagcggcaaggcggacaccaaggtgtagctctggcgtctcaatcgatccatgagcgatcgagtagctcagtagcatgcaatcggctaagatttcctgcatgtgttctagtactacaagtaataatattagctagcctaaaaggctaaaacacataacgtgcatgaaaggaaagtactatcctaactgaataaaacagcttttgcaggcacaagtttaacataatatgtctgctttgatctttatttggaagttgtaattaaccatgtttgtaataacgagataattaaacgagagtatccatgtgtcaagaggtcaagcgtgacctctcccacaccgtccatggcttccccgccgatgagcaccacgtccgggaggtgattgcgctcacgctccactcctgcgcctgcgtcgcgtcgctgtcgcgctgcctgggcgtcacgctcaagatgctggtgctcgtccaccgtctcctcgccgacggcgacccggcgttcgagcaggaggtgttctacgccatgcgccggggcacccgttccgtccacccccgccccccagcgccgccacgatgtcgcccgctccagccggcctcctcgttgctcggccgccgtgcgccgttccagccggcctcctcgtcgctccgccgcccatgagcgggagagagacaagagggagagagaggggacagagagaagaggttgtgaggatgacgtttgggtccacatgggcccacctttttttattaatttgtgtgtgcaactgacatgtgggcccccacaagttttttcggatttaattgccacatcagcgccatgtcaataacacgttggacaaaaatctagtcaaaagaagccacgtcggcgccacctcagccaaaaccggagtcaaatactgacgagggaccttatttaaacggtttcgtaagttgggggatccgtcgtacccggttttgtgattaagggacgaaaatcggactgggcaacaaataaaggaacccaaagtaaacttattctaacctaaaatggccgccctggcgccaatcgcggatcacagcccaaggcctagtgcccacacgatactgggccgagctttgccggattccacagcccaccattagcacctacccaagaacaccgtttacaaaaagaacaaaaaaaaaacacacacacacacacaaacttacaaaataatcgattttatgatataggagttagggaggaggaagaagagaagaactagaaatagtgttctcttaactcttaagcatgaatgttagtaaatttgggctgttggcccaggtgacacctttagctagtagacaatccatttaattgaagacgtcatcacgttccatgtattcactaagtagagaaggatcaaatcaatagttcaatataactggaagttacaaatcatacaaggacagcctcatcgtcaaaatcgttctagctaaccaggcacgaagcatgcgcctggggcacaatacaaacaaccatgccaacctctacaacctgaacacacatatgtcggactcaagcagagcattctctgcgacagcaagcacactctagcgacagcgagccaacaagaaggtgggcacgggaagcatgctcgggtccggagcagagaagtaggcggcaggaccagcgaacggcagcagcgccggcggcggcttcaccactgtctccgtgtgaggcttgctgatcatctgcgcactcgtcgtcgtcttcatcgtgcggcttgtggagttgctcttcccgctgcagagagcgtagtcttcctctgggcgaggcttcttgttgatgtcccagcgctcggccgacgacgcgcggctcagcggccgcttgctgctgtcccagcgctcgacggagtcggagcggcaggcgctcccgttgctgccggtcgacgacgcagggctgccgggtgtcttgtgcgcgtcccagcgttcgcaggagtcggcgcgcccggggctaccgccgctggctctcgacgacgtcgacgacgaggctgccgagccgccggctttcttgttcttgtgcgcgtcccagcgttcgcaagcgtcggcgcggcaggggatcgcgctgccggagctagacgacgacgacgacgctgccgaaccgccggctttcttgcgcgcgtcccacctctcgacggcgtcggcgcggccgggcttgggatcggagaccggcggcgcgcggaaggaggcggggaggatgatgaggcacggcgtcgggagcagcggcagcatctggctcctcagcggggtcgggagcagcgccggcaacttgctcgcgggcggcgtcgggagcagcgaagggagaaccgctgccgccatggctagctgctcgaaatgtcacgaagagggagatagttgtacgtgccgcgacgcgaagcgatcgaagcaattaaccggagacgagagcgcgcgctggaatcgcacgtcgaattgatgggctgcgtcatccacgcgcgcgcgccttatatcctcgcgaatcaattcgactcccattctgattcggagttcgcaccgccgatctccgatcccttcggaagtcggaataccgcagaagaggtgactccgtgactgggattcggactggaaaacaatgggtcgaactcgggccgctgtggcatccaggcccatcttatcacgggccgttccttcgacaggccactctttaggcccagtccgtgccggcccacatttgccagaccagcggatcgagttgctgacatccagtccaacatcggaaaattgaaatgctctcttttttttttctttgtagtgcattgaactgaatcagccaatatgaatatgcatattgggaatgctatttgacgcacgtttgctacttatgattctagtgcacacttagaaaaaagagagaaagaagccgcataccaccccctcgtgcggcaggcaggcgttccccatcaatcgattccaaccgtgactccgcgtgagtcttcacaagtggtccgaagtggtttttccttaaatctgatggtaactttcaacccaaaagtcctgaaatttttaatttggattggaaaaactttcaatccgaaagtatagaaacttccattttgaattggaagaactcccaaatcgaacttcaaaagactttttaattgaagatctgaaacttgaactaaaaattcaaaaacttcacatccaaatccttaaaattttgaatgaaaattctcccaattttcattccaattctcccaattctcccaatggagatggagtgcacccccggagactatacaatatcctgaatccctgactgcacctgactttcgcagaggtgctccctggaacggtggtccaggaagagggaggagaggaggacgatctggtaggggaaggggaggacgtggttggactcccacagaaaataaatgggaaacggacgatgagctgatggatactgcatcgagtccagtaaagattaatcatggaccgaccagatcttcgtcttcaagcaagagaagacttgatcttgaggaggaacaccaaaaagatgcaaccagtgatattctgcttctggaatcatctgagatggtggagaagaggacccaaggggtacaggagtctggtgacgagatccaaaagatggaagagttcggggcaacaagtagagatgtcaagaaacaaaagatggagggttcaagtaataattctgatttggcaacatcggcgggctccttggaggagcatcgccgggcctaatgtgtttttaagctggaactgtcggggccttgggcgaccccgagcagttcaagagcttgtctgcatggtgcagactcatcgcccaaaggtggtgtttttatcagaaacacgacagaatcaaggttttgtggagaatattaaatggcaaattggccttcgaggatgtctggctgtcaatggtataggaaaaggaggaggaattgccctgttctgggatgaaagcgtaaatgtgactatcaagtcctacaatttgagacatatcgatgcagttatcacagagcagaatcaggatccttggagagctacctttgtttatggtgaaccaaaggctcaagatagacacctgatgtggacacttctaagaagaatcaagcaaaatacaagtgatccttggttaatgattagggatttcaacgaggcaatgtggcagtctgaacacttgtcacaaaaccgaagatctgaaacccaaatgagagagttccgatctgttctatcagattgtgatcttcatgatcttggtttccatgggataccttggacttatgataacatgcaaaggggcgaccgcaatgttagagtgagacttgatagagcagttgcctcgccaaaatggaaagattgattcaaccaagcagttgtgacacatcctacttccccgtgttcagatcatgcacctctgctactgcagaaggaagaacatataagataccaacgacaacaaactatgagatatgaagaagtctgggagagagagtcatccctcccagaggtcatacaaagtgcatggagtgatggcaacgctatcacaaatttaggcgacattagtgcgaagatgaaaaatacaatgtgcaagttatctagatggagtaaagagaagatagggaatgtaagaaagaagattgctgccttacgagacaagttaagagagtgcaggagcatgggatcccttgattccgatgtccaagtccgacaaataaaaaaagaattagaagagctcctgcatagagaggaaatctggtggaagcaacgatcacgtatcatgtggctgaaggaaggtgatcgtaacaccagatacttccacttaaaggcctcatggcgatccaggaagaacagagtaagaaagctaaagagaaacgatggcatggccacatgtgaaataggtgaaatggaagagttggcacacaatttttttcagcagctatatttgaaggatgacagacttaatcctgagaatttattaagcttttatgcacaaaatattacagaagaaatgaatgggaagttaactgaaccgttctcggaggaagaaattagtgatgcactcttccagatcagaccactaaaggcgccggggccggatggttttcctgccagattcttccaaaagaactgggggatacttaaggaggatgttgtcagggcagtgaaaaatttctttgttgatggacagatgcaagaaggagttaatgacactgcaatcgtcatgataccaaagaaaagcctagcggaggatatgaaagatttcaggccgattagtttatgtaatgtggtgtacaaagttgtggctaagtgtctggtgaacagattaaggccactgctacacgatgtgatttctgaagctcagagtgctttcgttcctggaagactaatcacggacaacgctttaatagcgtttgaatgctttcattccatttagaaatgtaatcgtgagaatcaaaacttctgcgccctgaaattagatctctctaaagcttttgaccacgttgattggcaattcctagatggtgtgatggaaaggatgggcttctgtgataaatggcgaagctggatcatggcatgtgtgacttcagttcaatacaacgttcgtttcaatgggcacttgctagaacctttctctccaacgagaggtcttcgccaaggtgatccattgagcccctacctttttctgctagttgcggatggtttatcaaatataataaagagtaacgaatctgaaggtctcattcaacctttgaaggtatgtagaagagcgccaggaatttcgcatctcctgtttgctgatgatagcttgttattttttaaggcggatactgagcaagctagcagaatcagagatgtgctacaaatgtatgaaagcagcacaggacagcttattaatccttctaagtgctccatgcttttcagtgacttttgcccacagcaacatcaggaggacataaaacgaatcctgggggttactaactcctcttttgaggagaaatacttgggactcccaactcccgagggaaggatgaaagctggtcagtttcaaccaatcaaggatagattatccaagagaatgtcagattggaatgaaaaatacatgtcttcaggagcaaaagatgtcttgataaaaagtgttgcccaagctctgccaacgtatacgatgggtatctttaaaatgacagacaagttttgtgaagaagtatcccaaatgattcgcaatttctggtggggtcatgagaaaggagagaagaaagtgcactggatagcgtgggaaaagatcactagcccgaagatccatgggggtttggggtttagggacatgaaatgtttcaatcaagctttgttaactaaacaagcttggaggctgatcacaactcctgagagtctttgcgcccgagttttaaaggcgaaatacttcccaagtggaagtctgctggacacagccttcccgacagtttctttacctacctggaaaggagtccaatatggtnnnnnnnnnnnnnnnnnnnnnnnaatttggagaagatggtggcacagggtgagcgagtcaatgtcctgtggaaaaatgcaaggaacaggctaatctatgtgaatgaactaatggaaccggggttgaaaagctggaatgaaaacctagttcgtcatgtgatgaagaaggatgatgccgaagaggtcctcaagatcaggttattggaatgccaaccggatgattttccagcctggcatttggagaaatcaggactgtttaccgtgaagagtgcatgtagattggcctggaacttatctaatcatggtaggtcagatgcctcgtctagcgatgcaccatcgggtgagaggaagatatggttcgttttgtggaagacgaaagtaccagcaaaaatcaaaatctttgcatggaaattggcacagataggttaccaacttgggacaacaagcgcaaaagaaacattgaaagacaaggtatctgtcaaatatgtggatctagtgtggaagatggttttcatgcaaccgtggcttgtccgagagcgaaagcgttgcgtgaagctattagggaaatctggcacttacctccagagaataagtttgtaaattcaggtccagattggttgttgctattgttggacggatcaaatgaagaagaaaaggctcatacgctgttcacattatggcgggcttggcattgcagaaatgaaattatccatggcaaggagatgagccctatagcaagctctgtcaactttttgatgaactacgaagattgcactctaatgactcggcaacaacctgatgatgtgaaagggaaaggaccaatgtttgtcgagacacacatacaacgacagctgaacgaaaagcaggtgtccaagtggcaaaccccaccagaaggtgtagccaagttgaatgttgatgcaggtttcaaaccggacacaggtgaaacaggcgctgggataataattagggagtgtcgagggctcgtgctactggcttcctgtaagaagctaccgcgatgcagttcggcaatgcaagctgaagccttggcgtgtttggaaggtatccggctagctactgaatgggtgaatatgccacttatcttagaatcagataatgcaagtgtcgtcgctaagttaaacgcgaccaatgtctcaagagcagattggagtggcataatttcagatgttaaagcggcaatgttatgtttagttcaggtgcaagtgcacaggataaagagagattctaataagatagctcatgctttagctcaactggtaatgggatcaggaactaatgcggtctggagattatgctcccctgcagaaattcttgacctcctgaaccaggaatgtaaccctttgttttctcattaatgaattctctctttactgtcaaaaaaaaaattaattcaaacttagacccccaaaacttctaattgatgatataaaatttttaactcagaaggcaaaactttgtacttcaaactccaaaactttcaattgaatttaattgttgtccaccttgttgccatcggtgaggatgagccttagggcttgttggcgaggagggaagaaacaccgacgccccaccaggaggaagaacatagacccaacttgctagggataaggggatatcaccggaatcttgttgaggtatggggagcaacacaccatgaggaaggagagcccggactaactaacatatcgtcgaagagaagggagacaagggtaggccttgcggccgctcgccgccatcacaacaaggaggagcaataaggtggggagtactggttgaaacttccgtacaagctcgtcaccatcctgccgaggaggaggaaatggatggggagcggcaatggcccttccgcttttcgagtatgcaaacaactggtgggagaagccgagcctaagcatgacactgtgttgagggggaggagatgaaggataaggatgttcgtgcatgggccaagtgttctctcgggacaaagctgcacgaattagcatttccatatgaacatggccattctaattggatttaattaatcaaatacgattatgaacatgttcattcttttttttttcattgtagtaaggcatcaaaaattcaatttttgaatcattgtctaatcacaatattgagggggatattttcttgaagattagtgatgatgatgcaattgagtgtttctatggtatgaaaacacactgttaaatgttatccaattcaattcgttgtgttatttaagacattattcaaactatttttactgttcttttgatcaaaagttgtagcttgggctatattttattacccaagttttattttcgatcgctatttatcccattttttttactttaaactagataagtttgttttttaattaatttggatcaccccaaaccacttttttaagcacatcaactatatttaacacattgactccaacataccggataaagtctctcacccatgcacaagccatatctttgcggggggagtggttagacacagctaaagaagaaagttgaggtggtctaaagtgtaaaaaaaaaagtaaaattaactacttcatagtgaaaacatatgtcaatgagttgtgcaaagtgaaactttggcaataaaagataatgcaaagtataactcattttgataaaaaaaaagaccttaattctatttattttgcatgaggattttggtttgactaatcttaagatttgtggaggcacacctagcataataagaatgaaaataaattaggtgaattccatgaacaccaggtattatagtgtgagttacataaaactggaggggtttttgttggttgcacaaaatatataatggctttatagttcataaaaccacaccattaactattttcttttatatactatacatatgacttacaagcttgtaaccaaaatatatgagttattcaaattcaacgcataatgttgcagccatctaaacttaattatttgtttattttgctacagtattaggctaaattggttaatatatatagtggttttgtgaaattttagaaccatgatatgcgtgattttgtgaacctaaactgctagacaacctgttgaattatgacgtcataatgttcgacgtaatcactaagtactgaagcttcaaaacaatggttcaatgtaactggaagttacaaatcatacaaggacagcctctagctagctaacattacaagtaccagtgttaattgagcacacgaagcatacggctggggaaccatacaacaaccattccaatctctacaacctgaacacacccatgttgaactagaatctagtactgcgtagaagcaaagcattctttgcgagcaagcacactagctagcgagccagcaagaaggtgggcatggaagcatgctcgggtccggagcagaaaagtaggcaggaccagagaacggcagcagcgccagcggcgccttcaccattgtctccgtttgggacttgctgatcatctgcgcactcgtcgtcgtcttcatcgtgcggcttgtggagttgctcttcccgctgccgacagcggggcgaggcttcttgttgatgtcccagcgctcggccgtcgacgacgcgcggctcagcggccgcttgctgctgtcccagcgctcgacggagtccgcgcggcaggggctcccggtgctgccggtcgacgacgcagggctgcccggtgtcttgtgcgcgtcccagcgttcgcacgagtcggcgcggcctgggttcccgccgctggccttcgacgtcgacgacgaagctgccgagccgcctgctttcttgttcttgttcgcgtcccagcgttcgcaagcgtcggcgcggcaggggatctcgctgctggagctagacgatgaagctacagaatagccgggtttcttgtgtgcgtcccacctctcgacggcgtcggcgcggccgggcttgggattggaggccggcggagcgcggaaggaggcggggaggatgatgaggcatggcgtcgggagcagaggcagcatctggctcctcggcggggtcgggagcagcgccggaaaattgctcgccggcggggtcgggcgcagcgcagggagaaccgctgccgccatggctagctagctagcttggcgagatgtcacaaaggagagagacagttgtacgtgcggcgaagcgaaccggagacgagagagcgcgctgtggagtggaatcacacgtcgaattgattggctgctacgtccccgagcgcgccttatatcctcacgaatcaattcgactcccgttctgattcggagttcgcaccgccgaggcgccgcgatatcctctcctcggagtaccagtgttaccacagaagtgatgactccgcgacagagattcggactggaaaaaagtgggccggccgtgacatccaggcccagttcgatatgggcttaattcaacaggccgtagtttaccacaatctgtggctctgtgccccggccacattcgccagaccagcatagtcactgacagtccagtccaacatcggaaaccggttttttttttgctttgtaggctttagattaaattgaatgaaccgaatataaatatgaacatggtaattctttttatgaaacctgagccagctttgctggttttatattaaaaggggaggaaactgtacagcaacactaccgataacggtgagaaacaaaggaccaaaagaaaaaacagaggagacgcatagacaagagggagcagagaggaaagcagagctacaaggatcacgggaaggctacagcactaatctcgctaaatcttttgccccgcatcctatccatttgttgatttcatccatgatcttcgtcagcaagtgtggcattgcgagttctttgtttttgaaaactcgccggtttcattcacaccaaatctcccaatttatcatcatgtgaaagggagcacatcccttttgttttgcccttttcggtttggttagctcttctttcccaccaatccagcagagtctcgtcgtcgttgtgtggcgtagggatgtgattgtggtttagtcttaaggagaccttgtcccacacttcctttgtgaaagagcagtccttgaagaggtgttgtgcagtttctaaatttctgtagcaaagctgacaaaaataattgttgggccattgccggcgttgtcggcgatccgctgtccaaatccggttttgcagcaacagccatgtgaagttcttgcacttggacggcgcccaggtcggccagattaggttggctgctcttgatccaattctgccactgaattgacccaaatatgctgattttgctgaatatttgccattgtttgtctatctccaaagaatagtgtcttcggttttatctgttaaggtaatttcaccttcccaaatctactggtagactttgatgaattcatgaactagtgccaaattcagctcgtgccttatgtccctgatccactggttgtcgattagtgcatcgcagactgttcgatgcttccctttggagtggttatatagcgctggtgcgaggtacttgagcgactggtgtcccacccaattggattcccagaaatatgcttttctaccatttccaattgtcaccttggttgttgtagcaaaaacttccttgtcaagatcatcacaaggtggcggtgttctgatccacggtttatttgggcattgccaccgaaacaacatggtaattctttatttcattttagcaaggaatcaggaatttgattcttgaatcattgtccattcacatttattgagagggatgtgtttttaaagattagtgacgatgatggaatggagtgtttctatggtataaaaacgcaccatgactataaatgttattggattcaattccttggttatctaagactttattcaaactatttgtgctgttattttgataaaaataaagaatgtactgctacttgggctacttttattgcttaagtttcactttgaccatcattagtttacctcatctttagttaattttgtttgcattgcaatttgaaccaccccaaactactttttttttaccacatcaacaaccatgaacacatgggctgcagcacaccgataaactctctcactcatgcagaagccatgtaaactagattgaacgcatcattagatctacacatgtaaactaagcagtaaaacatgaacatatcaaatatgcgcaacatgtcgaacacgtaccgaggtggcggaaagaccggttgctcggcaggaactactcgcggttgcgagcatcgacgaaggcgcgaagcacgcgagcggagaggaaggcgagccgtcgcggacgaacagggagcagttgcgcgaagcgcttcccaaaaaccttattgccgccttctcccggtgcaggacgtcgaaggcagaggttccggagacctgctcttccgatcgccggtgcaagccggcgagcgggatggagtagtctacgagcgacggcgcagtacagagtaggaggaaaaccctagattgatttcgcgtgtgttgcgtgaaggcggcggctcggtttatatagagatagatcgcctaatcagggcgcccgtgtaaaccgaaccggataagtcacgcgtaacctatccggactccatgccgttttcacgcaccggattttttgaaatgtttccaaaacaaaacaaatccgaatttcccgtagcaaaacaaaactgcaaaaggaggctgcatctgcgcaagggtgaggagccaattttgcggaccattcgacgcgtacgtcgtgcacacgcgccgcttgccctaccctgccaggccaggccaggcgaggcgaggcgaggcgagtgagcgcgcgcgtgtttcccctcttctctccaccacacatgcttcaagtggctaggagggcatcctcccttttaaggaggtccccctctcctagaataagcaaggttgtactaaactccacatgcatgccatcccatgaggtgggtttttgtgattttccaaagaattaatcttcgaatgggccttagcccatctattaattccaacaatcccccaccaaatctcaaaatccctcgtagatttgccttttccaatgtactgtttatataccagctgttcgatggagaccgattaaggttgaacatccacctagaactccaagctacacttactcacaacttgaacaatggactacgccttgaattgcaagtcttgtgcaagcaagtttcactcagagtcttatctggtcctagaccgactgtagactaccccttgggtggagcgtataagtcatactcctaggtctttagtaagcttcctagaagattcacccaaaatctccatagactgcaaccaacagtcaagcttacaaaggtgagttctttcaagaatgctctgcaggacagcatcttcgctaattaaagccaacagaactcattaaggcacagtgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaaac

SEQ ID NO: 13647 - DNA, 1925 bp, Oryza sativa
ccaaacactgtccaacgctaccccacgttgcaacaggcccaaccaaccacctgaattacaccagttcattaagctaaactagggatgagaacaatcacggtgaatggttgatcgcccatatccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggaaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaaccaacatctagtcattttgatacccaagttatcaacggcatatggtaaacaatatgtggctgaggaataggacccatcccacattacattgtaaaagaatgcaacatttaatagaaatgcgggatacttgtaaattgggtacaatatgatcaaacgtattgcatgacttgccttgctctcgaactgatgggacctcagcaacgtcttcgagaaacttcggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgaattttagaagataaactgtgtttttactaataaagaaaagttcttaatcaatttattgcgcaataagtcccagggctgacgtcagcgaggggagggggcggcgccgacaggcggggcccacgggtcagcggctcaaagcggccggtctaccgtggaccaggaccacgcgggtggtccaccgccggtccacgggaccgatggtccggatcggccgaggggccgatcggacggcacggcggcggctaggcacggctcggctcggcttcaaaaccggccggccggccatggcaaccggcggcgacgcgcacggtcgccggcgacggcaatcggcggcgtgggaagcgacggaggacggggcgaaaagcggcggcagcggctgaaggcgacggcgcacgcgcgaaggacggcggcgcacacgggagagagggaaaaaaagggagcggaggggagcctcaccggcgagcacggcgaccaaagcggaggatgaaaggcggcggtgacccggcgatgctgaggtgcggacgggcggcggcggcacgctaggagaaaacagagagggggttaggggtagggagagcgaccacggcggctagagcggccggccggagttaggtggaaatggagagctcaccggcgtgcgagagaaacggcgctccggcgacgattggcggcaaccgaatggtggccgaggtgcaagcgggctcggtgagcgtgacggtggcgactacgcggcgcggcggtggctctagcggcggcggcgcgcggccggagatgggcggcgggcggcggagctcgggtgcgcggcgcgagggcggtagacggcacgggagagtgcgg

SEQ ID NO: 13648 - DNA, 8084 bp, Oryza sativa
gtggggggagagagagataggggtgggatttgaaatcgaatcccgccctctcgagcgcgcgcacgggccgggagatgtggggaaggtgggcggcgacgcgggcgcggagtggggcgcgaagaggggcggagaaggcgggcggcgtggggaggtggggcgccggcggttggggctcggctccaaccggctagaggaggaagacgaccgacaggtgggccccacctgtcggcgcccgaaggagagagggagggagggaggacttcggggaggggagaaggaacgggccggccccaggaaaggggcgccgagcgcggggagagagatgggccgacggcccatctagagaaaaaggaaggaaaagaaaagaaaaagaggggaaggattttcctgggattaaaattgcactttggtgatttttaattggttaaaattatttccaaggctctgaaaattccactaaaaatcttgttaatgcattggagcatggggaactcaagaaaaattccaccacgccgaattcaattattaattgcatttattaattagggaattagctctaggttaaataagataatttcttcggacgatttatttagccaatttttaaatcaaggagagggggaaacttcagggtgtgacacacagccaacctgtcttgcagctcacgagagtacatgcatcttcacttagagagggtatagattggtactctcctctagtttactaatgatttgttcttcccaggttctaattcacgggatctccgatcacatagactgggttaccaccatagtataactcacatgggtctcaaacccatctccttcgatgcattatctatcacatttcgtgatagtcccttcgtgaagggatctgccaggtttctagctgtttggatgtaatccaacgttataactccagagtttctcaatttcctgacagacttcaatcgtcttttcacatgtctagacgatttcatattatccttagaactatttactttgacaattaccgtttgattgtcatagttcataaggatagccggcaccggtttttcaacaataggcagatccattaatagatcacgcagccattctgcctcaacagtagcagtatccagtgccgtcagttctgcttccatagttgacctcgtcaaaatggtctgtttgcaagacctccacgaaacagcaccaccacccagtatgaagacatatccactagtggctttgatctcatccacatcagagatccagttagaatcactataaccctccagtaccgcaggatacccagtatagtgaagccccaattccatattacctttcagatagcgcattactcgctcaagcgcacgccagtgatcatctcccggattagaggtaaaccggctcaacttgctcacagcaaaggagatatcagacctagttgcactagccaggtacatcagcgagccaatgatttgggagtattccagttgattcctagcaattcttttgttcttgcgaagcaacaagctaggatcataaggtgttagagaaggcttactatcactgtagccaaagcgattcaagatcttctccacataatgggactgcaagagtgtaatctcattctcacctctaattagcttaatgtttaagataacatcagctacacccaaatccttcatatcaaaattttgagacaagaatgatttaacctcatttatcacctcaaggtttgtcccaaatatcagtatgtcatcaacatacaagcacagaataactccctcacccccaccatggcgatagtacacacatttatctgcctcattgactgcaaagccggcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacaaaatatgatcaatcgagcaacaggtgagtaagtgtcaaagaaatcttcgccttctttctgagtatagcccttagcaacaagccgagccttgtacttttcaatagtaccctcaggcctaagcttcttcttgaacacccactttcaccccaggggtttacacccatagggtcgctctgtcacctcccaagtcccattagcgataatggaatccatttcactacggacagcctccttccagtagtctgcatcaggagatgcatatgcttctgaaattgacttaggagtgtcatccatgaggtacacagtgaaatcaccaccaaaggacttagccgtcatttgtctcttacttcttcgaggagcttcactgacatcctcctcagagacatgttcatgtgtatgttcagtttgttctggtggtgtgattgaactgggaattatttcagaaggttggctcgaaccactatgtgtatccttcattgggaaaaagctctcaaagaaggtagcatcacgagactccataattgtaccaacatgcatgtcaggtacctcggatttaactattaaaaatctataggcaatgctgtgatgatcatatcccagaaagacacagtccacagtcttaggtccaagtttgcgctttttcgttattggtacattgactttcgccaagcacccccatgtgcgcaaataagaaagtgatggttttctcccaatccatatctcatatggtattttgtccttatttctgttaggaactctgtttaacacatgattcgaggtcaacaatgcctctccccaccatgcgttaggtagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgttcgagaaaaactctccaccatgatcagacctaagcctttttatttttctgtcaagttgattttcaacttctgccttataaattttaaaatagtctagagcctcgtctttcgttttcaacaagtacacatagcaaaatctagtagcatcatcaatcaacgtcataaaatatcgttttccacccttcgtcaacaccccattcatttcacaaagatctgaatgtaggagttctagtggtgccaagtttctctcctcggcagccttgtgaggcttgagagattgctttgattgcacacaactatggcacttagaacctttgacaatggaaaacataggaattaaacacatgctggaaagccgagacatcaagccaaaattaatatgacataaacgtgagtgccaaacattagcctcatcatccacactggcacaaatatagttcacagacttattgcagaaatcagaaagggaaaagcggaacaggcctccgcactcataacctttaccaataaaatatccatgtttagacacgactactttattagactcaaaaactaacttaaatccgtctctagtcagacgggagccactaacaagattcctgtcgatagaagggacatgttgcacgttcttcagctgcacgatctttcccgaagtaaacttcagatctaccgtgccaactacatgaacagaagcatgtgatccattccccattaggacggtggaaccccgtgcgacctgataagaagaaaacaatgagatgtcagcacaaacatgtacattggccccagtatcaacccaccaattagtagactgattaactgaaaaaatagtaggtaaattaccatacccgcttccatctccagtgttgccaatggtcacattagcagacttagaagtctgccctgcaggtgccttcatccccttgcgttgtggacacttcctagccagatgaccaggttgcccacacacaaagcaagtcctctcatcctggttaggattgttgttgttcttcttctgcttcttgaagttggtggtctgttgagctttgtatttccccttgctcttgttctggaccttgtgcacaacattggcactggactgcccaccatcgcccttagacgcggcgtctttttcccgagctttctcctcaacatcaagagacgctatcaacccctcaacggagtattcctgtctcttgtgtttgagtgcagtaccgaaacttctccatgatggaggtagtttcgcaataatgcacccggccacaaatttgtcgggtaagacacacttaaggagttcgagttccttagccatggtttgtatctcatgagcctgttcgactacagaacggttgtcagccatcttgtagtcatgaaactgctccatgatatacagatcattgctagcatcagtagcaccgaatttagtattcagtgcatcccacaactccttagcgtcggtcatatgcatatacaccttgaccagacgatcgccaagaacgctaagaatgcatcccacaaagagagtagtggcttcctcaaattgcttctggtgatcagcagtaagaattccttcaggtttgccagtactcacccagaagcatttcataaccatcagccacagagtgaccctgatctgccatctcttaaagtgcacaccggtgaatttattcggcctcagtgcatcggcaaaaccagccatagtaaaatcacagcgcctataataaggtttttggattgttaaaattataaacacataatgatttaacttattccataaataaattatgacattgcagatgtaaactagattgaacgcatcattagatctacacatgtaaactaagcagtaaaatatgaacatatcaaatatgcgcaacatgtcgaacacgtaccgaggtggtggaaagaccggttgctcggcaggaactactcgcggttgcgagcgtcgacgaaggcgcgaagcacgcgagcggagaggaaggcgagccgtcgcggacgaacagggagcagtcgcgcgaagcgcttcccaaaaaccttattgccgtcttctcccggtgcaggacgtcgaaggcagaggttccggagacctgctatcccgatcaccggtgcacgtcggcgagcgggatagagtagtctacgagcgacggcgcagtacagagtaggaggtaaaccctagattgatttcgcgtgtgttgcgtgaaggcggcggctcggtttatatagagatagatcgcctgatcagggcgcccgcgtaaaccgaaccggataagtcgcgcgtaacctatccggactccatgccgttttcacgcaccggatttttcggaatgtttccaaaataaaacaaatccgaatttcccgtagcaaaacaaaactgcaaaaggcaaaacaaaacaaatccgaatttcccgcagcaaaacaaaactgcaaaaggacgttttcacgcaccggatttttcggaatgtttccaaaataaaacaaatccgaatttcccgtagcaaaacaaaactgcaaaaggcaaaacaaaacaaatccgaatttcccgcagcaaaacaaaactgcaaaaggaggctgcatctgcgcaagggtgaggaaccaattttccgcctaccagacatggcgagcaagcgcatgtttcccctcttctctccaccacacatgcttcaagtagctaggagggcatcctccctttttaggaggtccccctctcctagaataagcaaggtggtactaaactccacatgcatgccatcttatgaggtgggcttttgtgattttctaaagaattaatcttcaaatgggccttagcccatctattaattccaacagaaaatataacaaatcatacaaggacagcctcatcctcaaaaccattaattcgatttatctagctaacattacaactgcaattaggctaacacaaccgtgtgaaatttccagtgctgattgagcacaaagcatgcggccggggcaccatgcatgcaacgacgaccattccaatctctacaacctgaacacacttacacacgacacccatgttgaactagaagcaagcattctcagcgacaggaaccacactagtgactagtgagccaacaagaaggtggaatgggaagcatgcccggatccggcgaagcgaagaaggccggaccagaaaattgagagaacggctgcggaggcttcaccatcgtcgtcgtctggcttgtggagttgttcttgccgctgccgacagcgtctttcttggggcgaggcttcttgttgatgtcccagcgctcggccgacgacgcgcggctcagcggccgcttgttgctgtcccatcgctcgacggagtccgcgcggcaggggctcctgctgctgccggtcgacgacgcagggctgcctggtgtcttgtgcgcgtcccagcgttcgtaggagtcggcgcggccggggctgatcccgcccctggccctcgacgacgacgacgctgccgagccgccggctttcttgttcttgtgcgcgtcccaacgctcgcaggagtcggcgcggcagggaagcccgctgctggagctagacgatgacgatgacgctgccgaactgccggcttccttgcgcgcgtcccacctctcgacggcgtcggcgcggccgggcttgggatcggaggccggcggagcgcggaaggaggcggggaggatgatgaggcacggcgtcgggagcagaggcagcatctggctcctcggcggggtcgggagcagcgccggaaaattgctcgccggcggggtcgggcgcagcgcagggagaaccgctgccgccatggctagctgcgcgaggtgtcacgaggggagagaccgatcgatcgggtgactctgatcaagcaattaaccggagaggagacgagagagcgcgctgcggagtggaatcacacgacgaattgatcggctgccacctcgaggcgcccaccttatatcatcgcaaatcaattcgactccagttctgattcggagttcgcagatcgcacccgccgaaataccacagaagaggtgaacccgcgcgactgagattcggattgcagactaatgggccgggctttccaattcgtggcgctgtggaatcaggctcattttcgtacaggcctctcctttgagaggccgtagtttagcccagcccgtgctcggccacatttcgccacagcagcggcagagtcgcggcgcgagagctaattcgctcctccccacgccacgccttttttggcctttttttttttttttgctttttttccctttttttctgattacgtttcttaatctttagcacacatgttttttaaaaatattttgatttgaaagttttaaatcttgacttaaaattttttcaaatcttaacttaaaaatttttaaatctcgagttgaaaagtttttaaatctgagttgaaagttttcaaatctcgagttgaatgttttcaaatctgggttgaaagttttcaaatatcgagatgaaaatttttcaaatctgagtgaaagttttcaaatatgggttgaaagtatttcaaatttgagatgaaaagttaaaagtttttaaaatttgacttaaaattttaaatttcgagttaaaaggtttcaaatatgggtttaaaattttaaaaattcaacttcagttataaatttcttttcaatttgttattaaaaaaaattgcgaaaaagaaaatcctaactactaccgttattaccttttaaactgtaattatagtcttgtagaactagccaatagttattttgagagttattttttttagcacaaggaaatagccattcaataaaatagctctaaattgtttggatccaagtgttatttttcagagctatttggcctttaatacactttcctattaagtgagaactgagaaagagaaaaatactttttcagtgagccccaccccagatagcaccaattagcaccctttaaagggatagtttttttagtaggttatttctaaatagacttgaaatagctcatctgtttaaaatttttgggctatttgagaatatttaagagagagctaaaaaataacacatggatcctaatagtgcataagactaatagat

SEQ ID NO: 13649 - DNA, 8901 bp, Oryza sativa
  unsure (1)..(8901): unsure at all n locations
ccccccccccccccccctccctccaaataaccggtcagcccatcactccgtcacagttcacagcctcagaggcccagatcacaaccacaccacgcacacgtacttgcagtgcagttgcagcgcgagcgaagcgagcggccatggcgttccggctcagcaacaacgtgatcggggcgctcaacctggtgacgctgctgctctccgctcccatcctcagcggcgggatctggatggccacccgcggcgacggcggcgagtgcgaccgccacctctcctcgccggccatcgcgctgggggcggtcctcatggccgtctccctcgcgggcctcgtcggcgcgtgctgccgcgtcacctggctactctgggtctacctcctcgccatgttcgccctcatcgtcgccctcctcggcttcaccgccttcgcctttgccgtcaccaaccgtggcgccggcgaggccgtctccggccgcgggtacagggagtaccgcctcggggactactccacgtggctgcggcgccacgtggggagcaccaagaactggnacaagatcaggagctgcctcgccggcgccgacgtttgcaggagcctgcaggacaggaacgagacgtgggcgcagttcgtcgccgacgacctctccccggtccagtccggctgctgcaaaccgcccacgagctgcaacttcacgtacggcggcggcacgcggtggggcaagacggcgaggctgagctccgccgacccggactgcgacgagtggagcaacgacgccgacgaggtctgctacggctgccggtcgtgcaaggccggcgtggtggccgcgctcaagagggactggaagcgcgtggccatcgtcaacgtcgtcttcctcgccttcatcgtcgtcgtctactccgtcgggtgctgcgcgttcaagaacagccggcgcgacagtgtccaccgccgcagcggcgggtggaagcaggccggatacgcctagcggtttcaaaagtttgagtacgagcagtaacataactacttgttaattaggaatagtaatatagtagtagtattagtttctgatgcttctgctgacgctatatatgttcgtactagtcttctgacaccgtgtttagctcaggatggcgtgttactagagttgctggtattagtgttttatctatccaacactgtagtttgtacatgggatgagcatattatgagttaacgatcacatgatattagtatatttattgtctatctttatgaccagagttaggctatactatcatcgaagtcacttccttatgagaaaatccattatattgctctgagtttgttataggtatatgatttgccactgattttctcatgttctacaatatgatatcgacttttacgtaacttctacaatttactatcgccttccggttagccttcattagtaatgtacatttttgtccaaacgacaaaaatctccttgggacaagaacttccaaaatttgaaaaataattcagaaatattatattataaacataagattgtaaacatcaaattttttttgccaaaatttggttaaaaatttcaaaatatcaaattttaagttttttgccaaaatttatatgtttacaatcttatgtttataatatgatatttcaggatttttgtccaaattttgaagttcttgttctagggatattttgatcatttagataaaaatgtacagtactagcgaaggttaaccggatgacgatggtaaatcgtagaaattaagtaaaagtcaatgacatattgtagaacatgacaaaatcagtgggaaatcataaacttgttgtaaactcagtggcatataatggattctctctatctttaaagaaagaaatgtgtctgtatactactccttgcctccttggtatacgtgttttaatacagtgctctaatgggtgtgtttggttccctgcatcgcacctggctcgcatccacgggtgcaggcctgtggtgtttggttgcctgcacggccactctagcctggctccacgcgtgcaaatcgggcttccgagccaggcccgagagaaacggtcgatctgagattcgctcctcatccgggctgagcacgtgcaggcgggggacgcgtgggtgcaagctcggggacgcgcaggtgcaggaggcgagaggggttccagcttctgctcaccttcccatctcatttgtcgctcggtgcctcccgtctccatcgccgcaccgtcgtcgtcatctccatcatcgtgccatattcgacaaagccatcgaagcttcctcaaccagaaccgctagagctcctcccctcaaagccgccgccgccgccaaatccagctccgcttgaagccatcgaagtcgaatccggctcctaccaaagctaccacttgctctccttcatccgaatccagatgtgacgacgagagagggttgtcactgctgacgcccggatcttcctcctagtcgccgctgtcaccgccaccatcgccactgccttcgtctacagctgctgcatcgggccctcttcctctcccttctttcgtcagatccagagcccaggagctcgatctagtggcctcaggcttctggttgccggatccggacgcttcctctcccttcttccatcagatccagagcccaggagctcgatctggtggcctcaggcttccggatccgaatgcttcctctcccttcttccgtcagatccagagcccaggagctcgatctggtggcctcaggcttctgattgccggatccggacgcactgatggcggcgaatcgtcaggatcccgctactgccggatctacgccctgccaccgcggcgtagttggctgtctcggcgacgaggccacagtcacctgccctctttttccttttatttatttgctgttttttctcaccgcttggatgaattaattgaacataacaaagttgatgcaatactgtagcacccgatatggttcatatactattttattcgtcagtgcaagaaatccaatgacttgattttatatacagtgatacactgactaatacaatcctatgcatatttcgcatatgttaaaaatcgatatcatatactgtaaaaagatcagcgttgagatgatagaaaatttcatccattagttatagatggtaatcttaccctcaaagaaaggaggtatccaaacctccgatctatacaacgaaccaaacaaaatctcgttgaagtcgtatttctcatgcaagcaatcaaacagaatctcacaccaaccaagctaaactcatacaaacaaccaaacagctacatatgtatcccctcaaccagatcaaactcagccaggatgggagagatgggccaggctagatggatacgagcaaccaaacacacccaatgtgtctgtatcatctgttccttcagaggcttcccagttcccacctagtatgcatacagtgctctattgtcgccttggtacgtgttttaacgcggcggctgattgtcgttgatcccagtacgagaatgaggtatccgtagttattgtattgtttgtcaccaacgcggatagactaatagtgggccagcagcattcattgtgctgtgtttagattcttaactttttttttcttcaaactttcaactttttcgtcacatcaaatgtttagacacatgtataaagcatcaaatatggacaaaaagaaaaactaattgcacagtccaactgtaaattacgagacgaatcttttgagcctaattacgtcatgattagccataagtgctacagtaacacatgtgctaatgacgaattaattaggcttaaaagattcgtctcgcagcttacatgcggaatctgtaatttattttgttattagtctacatttaatacttcaaatgtgtatccatatacgtcaaaaaaaaaattgacaatgaactaaacacggcctatctcaatctaaagattcaagtttgcttaacttttcttgattaggaataggctaggctttattttagagctttataccaccttccacgaaaggattggcactttcgttttggcacagccatatacgaattactaagaagagttaattggatccatgccactgcaaatataacattagatccatgccactgccatccagttttctgtcaatctccgtcagctctctccctcttcctctccttgcttctcctccaccttggcgaccggcacgacgcacacgatggcgcgcgaggtgcgacatccaggggcggacgccgaggcggagctcaccgtcgaggaagcggcggcccatgcctactccaaggagcccacggcgagcctcccacctacctccccaccacgtggcctacctacctccccacctcgtacgttggtgatggcaaccggcctcgcggctcacttccagtccgtccccattggcgatgccggcgccgacgcccacgctactgctgccgcacttcaccctcccaccgctcgccggcgaggacctcacctcctcttcgtaaccgccctccatggccacctctccaccatgctgtcgcccgcctcccgcctccctctcccgcttcctcccccagctcaccccactccgcctctcccgcctcatcctccacctcacgccctcgccccgccacgacgatggccacctccttgactccctcctgcaccacgccttccagacctcctccagcacgtcctcctcaccgcccgccttgccgttgttcgctccaatggcgccagtggtggcgtgcagcagcggtagaagttcttcgtctgcgtgcaggggaagaagctctccttggccatgctcgccttctgcgtcatgcacacccacggcctgctcccttgcgtcgagtcctgcaacgtcttcatcttcaccgcgctcggcctcaggctccccaagatcgccgagcctcgcaccaacgcacagcacccatccaaccatcgcctcccaggcagacaccccaccgtagcttcatcgccactgctgccaacgcccatctcgtctccccgccgagagagagaggaagagagatggaaggagaaggggggcaaagtgacatttcacaggtgagattagacagagattgacaaaaaaaaaactagacgggagtggcatggttccaatttccccaaatttcagtggcacgtagccgatatagcaaatagtagtgatatttttctaatatgccatatttgcagcggcaaggagcttatgcaaacatatgaatgatcgctccagaaacattttgtccctcaacattcaccttaactaaaagatccgttacacacatgcgccgaacattactgatgaacatgttcgaaaagggtacacagagtgcttcagatgttcaagatggacagagtcttacatagtagtagtaggtggctaggcaaagattagtttgatcttgctttggatatcaaactgatactgaaccctaggttccagtagttgcagtaacactgaacgccagacccgaaggccacctcaatcttcgtctctctcaggaggcagaccacacggaagtagcattttctgcaacaccagaaaaatgaatcatatataaatttgcaccgtactatcacattgaaatgactgcatatttaaaaatggccacccgtgcaatgatgaccatgatcacccatgtacagctatttaaaaagtgaccatctctaatgatggtatctatgatagttagaacacttcaagcttgctgaatcagaagagaaccaaacaatatgtacttggaaaagccattggagctcatatggtagcaaatggcaatgcaatagcttatccttttacattaattgagcacaaaaaagaaagattacaaagcttggctaaaagtccacagccctaaaattttagctgcaattttcttgttagatattcagttgtgccctagcatattttcttagccaatgctgtcgcagtacaaaactgaactatagatagtcatataaccataaaaacaacggactgctaacaaacatgccaaatatgtaaaatcatcattaagacaaagatctccgcatttccttgcccataccatatagcatataagctggatcctattcaatagtaggtgaataaataaaataaagccataaatcctgatttgcatcaaacattcagccttaagggctaagaccaaagggaacacttaaagctatattatcaggaagttaacgaaatatgttctgaatatatttcatcattaaataagataagaaattaactttttcaccacaacttttgcttaggtaaaaattaacttggacaatcaaagccactacaagtttgaggacagaagatagaagttgaaatgtacaggttatctcatttaagatgtcagcgctttttaaccgactagctatttgcccatgttgcttaggtaaaaattaacttggacaaccaaaaccactaaaagtttgaggacagaagatagaagttgaaatgtacagattatctcatttaagatgtcagcgctttttaacagactagctatttgcccatgtgttgcaacggatggaaaataaatatagtataagatctaagttaaaacacaaaaataatctaaaaaatgtatattatcatcgcataaattttttttagcactacattcgtacatgcatagatcctacacacaaatccaaggagacccatgtctatcgctggtccttgcgcagttgcgccagaaaaccattgattcagtttgacatgtggcaacacggttcagtgattataccaactttggttgtctacctgtatgattgtctctgcaagtggaatagttgaactcaagtgtaatgatgctatattttgatgagctaccacagaccagatgcaatacatgtccaagaaaacgattttctttcatttttttcctattttaggagcagttctacatcaatattaataaaccagataagtccaacataattttcaactaccgtacagaagacatgttataataagcttttaacatacctgcataaaattgtaacgctctcttccaattgattcattctcagcaatggaaaaatatgccagcattggatagtgcccaatataggatgcatagctatccctttggatgtttactgcccattcactgcaataaaagaaatcctcaatactaagttactacattcccaacaacacatttttgtttattttggaaaaagatatacttacaatcgattcaagtcagcatgccctgtgcccacatatttcgcttgaagatgctcaagttgagaatttatgttgaacctgtcgctagcctttaaagaagatgatttatcatatcaacatcatggtcaaaatacaaaaggatattaccaaagttcattgaaaaggtacaacatatttaaactgaataaagcttaatgcaaaaacaaaacaaaccctagcaatattcagtagagatctccaaaatcagtaaatgaatggaaaatgaacatcaaggtatctgatctgaagtatacaatagcaggtgagctctaagactatcacatgacagataaggacctaaccaatggtaataatacgaaaatgaaaagataatgtaaatatcaaatatctagaaattttgattgcttgacagaggtattatcgtcttcaagtgaactactatgtcaaatacttatattgaaaatatcaatcaatcaaagaagtagaccatacagaacacagtctgttctcacaagcagactgatagatccaattggtcctatcacaagtattgacttcatgttaacatcaatttcccaaaagtaaaaaaccttagtatgcccattccaaattgtcctaagagggaatcactaacctgaacacataactcagttttgaatcactaaaagtatatgatgccacgtagcagggtgtgcacacccctgtaaattgataacaaaccagaggctataattactaccgaaaaactcaatacaaaagcagtcccagataattgatgattcaagatcaaaaaggaaaaaacatctattcaaacgtgaactcaagtgttccagcaccaaatacatcatattccaaacagatctgcatcagttgggcagcacaaaaaagaaaagaaaaccacagtagtgagtagcatggtgatatgggtcagagacaactaacctgcatgatggctgacgggtttggtcttgatcctggacaggatagttgagatccctggagtcagaaccaagctaaaattaagagaacacaagcatgaattagggcatattccacagtaaacctcagtcacaaaacaattggtatggggcacaatccatatgaaaaacaaataccaaaagcacacaattgatacagatatgcaaataagaaaataaaaagttaagaggcagaaagtgcaaaactgaactatggcaaacagtatgccagcaattttacacttgccgatggaactggcacatgtgggatccatgattgccattcactcactcactcacaccaagcttgactcaataagaaattcgatgtgatcatcatgcagtgctcatcaaacttcttacaactatgtacagtattatcttttaaaataagtagtgtgcaccataaaaacactattactaactaggtcgtccttctcacaacaactaatcactgaggatatttcttcatcagacagcaacgaaatatagaagtgtactgaaaggaaaaggttttttttatataggcatagacattctagttgtttcattatgcttaggaggacactaataaagcagaactttccatctctcatatccaacacatcatttgtttgccgtacatacaaaacagggaaaggatcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13650 - DNA, 1045 bp, Oryza sativa
acttcccgttcaaaaaactttaccttttacctgccctcaatttatgcacaattaatgaatgccacctgggtggaagcgagaggtggaaatggaaggtcttatttcggaggtggaatctctacctgatagttgcattgccattcatgatgatcccttggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaaccatttgttgctatctaaattccatttaaggcggtcccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagacaccttggcgggcactctcagtgtctatcagaatgccacgggcaagatctgcggtgtctggcgacgagttccacgtgattacaagcgcatcctgcgcgacgatcgtctccatgttgtcctcctctggggcaacaaacagcaggccgagttggctctggccggaaaggggccaa

SEQ ID NO: 13651 - DNA, 1411 bp, Oryza sativa
acacccatgctgctcaggcccaaccatcctgaacgaccatacccggctgtacagatctatctccaaaccaggaatataccattccaaaccaggagctaatcaaattattaccaattatagcatcatttattatggtgagaagtgtgagactaatcacgaaagacattgttagacccgcccataaccgcgggcatggctattcgaatagttttactctggccagaggtgtaccactgtacccacaagacacagccccacaacatgtcaccatgcgcctcaataccaccacggtacctcggaaaggagctgtgacagtacccctcgcacaacacaatccaccatagcgcaccgttcctggatcataatcacccccttataaacaaggcatggactccccagcgacccccgtaggcttatctccgctacttctcagtctgatgctccgcaatgaaccatgctatacaaaaggtaaagccgttgtccacgctggcttgtggttggcacggttaatgtttcacaaccgaaactcgtgaaccggtccttaattgtcatgagcacgaccatcaaaaccatgtgctcacaacccaccattatcaagttttagttggcaaattaattaattaaccaatcacgatcaaccatcgtgagcttccattaaatatccataagtgatagtgaagcatgatttatcccattagtgagctattgtttctaagcatggttaagcatctattataagcatctagctgaaccaaaccaatatataaggttctagctaatcaaattataacccataggaaaataaagtcatctttggccataattaaatgggaaaggctcaccacccggtgacattcgaaaataaatgcacagttcaaataaatagagaatttaaatataggatcaacatgctcaaaggaattgtgtttgggatctgtgtgacttgccttgcaatattcggtcttcaattagtcttcttgaatacttccaacacctcacgaatccttcgaaacgacataaacgacaagctaacacacaaaacgaggaaaaagactaataaaaaccaaataaacagtacataaaagtaaacaaacatgtagatcatgattttagataaatttagagacttgaacggtctcattccgatttcgtatgaattaattacgaattttacaagatttaattccaattaaacctattaaagaaaaagactattccacattaattaaaccatttacagatgatttataacggagatgaaagattaaaacaaacttcggaaaaagattacattatatttggtagatgacatatgataaaaagaactaatatgccattggaaaagtggaaatgatttatattgattttgggcggctgatattaatcttgaccgagtctaccaagatcggat

SEQ ID NO: 13652 - DNA, 1651 bp, Oryza sativa
catgacggcaacccactggttcatggcgagacggcttccggcaaagtttcggcgcaaggggaacggcggccggggtgaacctcgaccttgcggagccgatggaggtgacggcccaggaaggaggcagatgaggcggcggctagggacggctggaccggcgccggcgtttgaagagagaaggagagcgcggggagagcgtttccggcgacggcggcggacgggaaatgagaggatagggagaggacgactagggggtcctttgtataggcacgggagctcgggatcaagcccacaacgacgggaaaaactcgggaaagtctagggttctcgccggaaaaaggaaggatttgatccgcgaaattggaaagaatttccatagaaaattttggggatttcttggggaaaaggaagaggagattgaggggattccattcccgcaactaatttggaaagaggagcaacggggaggtcggattggtgggaggaggcggcggcactgtgcacgagcacggctggctcggctctgtctggaggaggaagatggagtactgtagcgcgggggaggcaaaacagactttcggccgggctgagaggaagggagggaatgggctgaattcggcccaagactaggaaggatgattttattgcttttccaaataaattaaccaatgagatgatctttcaattgttaaaaatactttcaatgctcaaataattccaagaaaaatcttgaacatacttggacactcaaagtatttaatataataatatccagatcatttaatgattaatttattatttaaataattgctaaactgtctttgtattattaagaattgagctctgaaaaatccaagaaaattccagagagtataattaatcatggagaatttaataaaaattaaatccaaccatgctttacatttaggaaattttatttcccacatttaacttcacttgtaaattcgattaataatttattaaataatttataaatccttaaacgaaaatcaggctgtggcatcatctaaaggagcatcatcccctggagtgtaatcactgtcaggttcaccgtcagaaggtggctggctatcaatgggtgttgactcaaagtggtcaacactatcctcctatatggtgtttactctaccattgctttacccttacatccactaccagcagccttagtaactcctttacctttggatacatctacttcaacatccttttttgcacactcttcttcactgtccatttttaattccatgtatgcctcataatcactgtcatcatttgacccatcacacaaatcaataatttttggctcttcaacatacacatttaccacatccaattcaccagtacaatcacatatcaatttgcaagccttgtaatcataaaacgcacgaaaacatgtttgcaatgctcaagcaggtgtccaaataatgttccagtgcagcaatgcttacgtaggaaacaaccagtgcagcaatgttctagtcatcacattgcaatgctcacgctggtgtccagataactcaggcaatgacaccttatttcaatctatatatgacagtgccttaaatccatcacaatatttcttctcaataccatctagcacatatacccccttcatatgaaacctccccac

SEQ ID NO: 13653 - DNA, 450 bp, Oryza sativa
tgggtgggtgtaggtgggatgcggcgatgtcggcggtgacgccggagggggaggaggaggtgttctacgtggtgtcgctgctgttctcggcggtggcgaacgacgtggcggcgctggaggcgcagaacaggaggatactgaggttctgcgacctcgccgggatcgggtacaaggcgtacctggcgcactacgacagccgcggcgactgggtgaggcattttggcgccaaatgggatcgcttcgtgcagaggaaggacaagtacgaccccaagaagctgctctcccctggccaggacatcttcaactgattgattaattaattaattaattgttgcctaattaattaattaattaattaattagttacagcggttaactttagtcaaaaaatgaaataaacataatgttgtcgagaacttacctgtgataagtagttactgtgacttgaaa

SEQ ID NO: 13654 - DNA, 748 bp, Oryza sativa
atctcttcctacctcccttcttccctacttgttctagaagcgccggtgggcacccttgtcgatctcttcctacctcccttctttcctgcttgttctagaagcttctggtgccttctaccacttgcatctatttagttttccctcttccaactctcccaaaatatactaacttgcactggtagattaccaattgagttggtgttaagattgctgattgggttgctaacagcatgcaggatgaatataatatttacgacaataacttaagtttctgaagcgacaaatcaagctcatccttgtgctgctgctttccacagtagaattcggtggggtgcagaacacgtccgggcgggcagaaggcacagccgccattagcggcggcggtggtgagatcggcatcggccggccgctgctggagcacggtgcatgtgtcgacgaagaagctgtgtacgtagggggtgaagcggatcgagctcagcgaaaaccaggcccgatggtcacgcccgcaccgacagcttcgctgctgcctgccatgtccggcctcctctccttcgcctcgtgcccttcctagccttcccttcccgcgccgagaaccgccgccgctcccaggccgcgcctccgcatcgcaggctccgccgccgtgtcccaccgggcatcttcctcctccagagatcgcctccgctagctcgtccgccatggggagctcgacaaggcgctccggctcgtcgggtgcgcgcggaggcctgat

SEQ ID NO: 13655 - DNA, 659 bp, Oryza sativa
atgtattaatactctgatttgggaagaaaagaagtatcaaaaccctcaaatatcttttctcagtaagtaaattagatctaggaaccctagttttaggtctttgcggcgtacacatatcgtatcgatctctttcgggttccatttctagttctctgaatattgagggcttgacaaaggtatcggagcaaagttcaatccttggctctcggattcgaaaggtgcaggttggtggcgatctgaggatctgccgctgtaaaatcccgacgctggaagaattcgatccggtggcgacggtgggtctcaatctttggagaagggttggcaggaggctgtaaagtccccggatccaaatccttgagacaggcggcggtagaccagttctgtgaggcgatacagggcgggagaaatcctgaactgccgtcacagatcggagagattccatgtatggtaagcaagactcgttctcacggttcactggtggatatggaggagatgaacgaggtgcgtactgagttggctgggatgaagaaagacttattagatctgaagaatcttaaatcagaagtgagggaggtcaagaagttgctacaagaactttgcaagcagaaagggggagaaactggaaatactgaggcaggaggaggagctacgggtggaat

SEQ ID NO: 13656 - DNA, 638 bp, Oryza sativa
  unsure (1)..(638): unsure at all n locations
ggcttcaaggaaaggctgttatttttgtaatttattttatttgaactcttttctaaaacgactaggtgagtgcttctcaaacgactcggatgagacagtgcgtctcgtccggtcggagtatgtgcaatgcatcaatctttagaattgaaacagaattggcacccggccaacagcttttcaaacggccacccgggccaacaacttttcaaacggccacccgggcctagctgatcccgtcagctgctgatttttcaaacatcgaaccccttttcacaacagcaatttcacaagcagtagtcaaacaaaactacgctaggaaacacctcacatccgcccatgaccatgggcacggctgttcgaacagtttgttaacctctgcagagggggtacactttacccacacgacattactaacccggatcacccagctcgtggggatcagccacgtcgggagacctccaagctttcatgacaaggcatttcgaaagccgatacaggtttaccatatgccgacgagaggtgtccccaaggaaacccccaannaacccaaaaaaccccaagggggttttttaaagggggttccccccccagaccatactgtgccaggaagcccaggggtcctccccgacaccaccccg

SEQ ID NO: 13657 - DNA, 1550 bp, Oryza sativa
aatttgaatgatatctgattcaaatttgaatttcaagtcaaatattttctatatatagtatttctatacatctaaagtttatagacctaaagtttatagatccaaagtttataagtcaaaagtttacacacccgattcaaatttgaatttgaattatatctgattcaaatttgaatttaaattatatctgattcaaatttgaatttgaattcaaatattttctatatatagtatttctatacatctaaagtttatacacctaaagtttataaacccaaagtttataagtcaaaagtttacatacccgattcaaatttgaatttgaattcaaatattttttatatatagtatttctatacataaatttttctaacttttgttttttaaaaaaatttgtgtggtgtactgtagtagaaagagaagaaagggaggagtatagaggaggcggggccaaccgatcgctgcgcgatcgcccattagcctcccccgctcgtgggggccaaaaccgaaattttgttccgaaattgcaatcactggtcccatctcccatgcttagaaaaaaaaaaaaaggttgttaatagacagagcaaggactaaacgagttattgatatgtcaggaagtaaatatatggccgtgagtcttgtgacatattttgcctgggaataaatgctgttgcgatgcctcctcttcattatgtttcaagattttgcatttcgattcaatgtcatacccttggttgaaaggaatgtgcactagtgtttcaacaattcagtttcaattgctcatgcgataattctttccctcacaatccacttatattaagaaacaaaacaatgacacaactactggcatgtcgtgatgatcatacacacagtacttcattatttctaacttgacttgactgctggagaacccgaatagccataatgttttcatgaaagaggtagcaagtaaatcgataatttgagatgtaggaggttcttgaatgatgaaagaggtagcaagataaatggtccgccattcatgcttgatgtgttgtgtgtggagtggatgttgcagaatgacagtgaggctggcctactacagctggattcattctgctaagtcgcagccgcctccggcctccgggctcgccgccgccctctcttcccgccgctgtgcttgcatcccgtgtcgaccaccgagcttgcatcttgccaccgccgggctcacctctcgcactggtcactgcattcgaccctcgcaccagccgcagcctcactcgcgtcgtcgttgtttttgcttggtaaggcgtggtgcgacccaccttggtcgcttgccctgctgatacggccggcaatagggcggctgcatcggggaaaatcatccggatgccaccatccggcatctaaggggaatattcttctccgggccgccgtatcccgaccctgcccaccaaccaaacacacatgaaaaacacaaggctggctctacaatttcaagggtcctagagcaaacttgatgctgtaggcccttaatatgtgttttctatttacatatttttaaacca

SEQ ID NO: 13658 - DNA, 5413 bp, Oryza sativa
gacttcatcagcaacgtacacatggaaagctggcgatcaacggccacaacactggttcggccaaaccaaaaaaaatgtcttcccggcccctcctttggccggtaggtatcttaatgggcccccaacatcatgcattatgtcaaagccctattctaagtggttttaattgagttatggtgcctccaatccgtgtaaacgcgtcctgatcgtgcagatgtgtattttgtcatgttgggtgtgttttctccttaaaatacctacatacacatatataccaacactagtggaaatgattagtaataaaccctaccactaagttgaatatattttattccaatatatgcatgtattgacggtaagatattatgatttaaggaccgtcaacacaaatcctacagacaattttcctatttggccttcgacaaagcattggagatttccaaatcctatgaaatttctatggaatggtttattgcatgtagattttgaaggaatgttagcaaaagcttcaacctgttagaaaatttcctttgaatgtaattctctcacccaattcctatatttttcctatggttcaaacacatggtcgttcctgtgtttttcccgcgttttgtaatcctctattttacacttgctttcttatcagaaacctgtgttttttcaattactatgcttttccgttgctgtgattttattttaccgaaacaataaagataattatgctatggctggcagggttttcctccctataacccagccccctaatggcataaccacaactcgatcatcaggtcaatataacacctggcgaatataattcccgaaaaagggagaaggcctaaacctgtctaaaccttattccatttactcgtcaaaatttagatctcgtgcgctagccctttttcattgcctatttctaggatcaacatagctggtcaattatatatccgctggattcgttttgtttccttttcttttcacagccaacctctttaacagagaggattaagcgctacttgatgccctttggtgcctgtttctcttttttttttttcattctcaactttgtatctgttttcaacagaggatatggtaatctatctatctgttatattgttgatataaaattcatcattcacacgaaggcctgggagatttacgtagctccagtacaaatcttatcaatagggtttaggatgtaccagttagtttgatcctagaactaataagatagatagatggatcgtataaaatcaaagagtcgattgggcaataagtcgatgggatgtagcgaggcaagctgatgttaatagggttctgatcaatcggctataataatacaaaatgaaaataagtattatattatcgtaaatcattgtacatcctctaagtgcacttaaggcgtcatgtgttacgccttgaataaaaataaaactttacaaactggaagaaaaatcatctgaccatcagtttccacttaaataggtagatccattactttcaaccaatagatatactttttagaaaatcttaagccccaatgtgttatgtcttaaaaattagaaaaaataacaaaaaaattgagaaaaaaatagatcatcggttttacttaaataatttagataaaatagcaaaaaacacccctccactttgccctctccccaaacatacgcacaacacagcactactcgtcccatcccttctcggcttgagctctccactctaccccttcgtgtttatatagccaaaagtaatcaaaaatattaaaacatgcataaatttgaagctatgcatctcatttctaatctaaatattgttgtatttataattaaaacaatgatttaaagatccaaaaatcctatattttgaactagtataaaatataaaataaagcaggtaatagaaaatgtaataagttcgtaaaaaaatgggttcttacattacactataattggaccaaccattgcatgttccattttcataacaactttaaaatacttagacattaatgatcttacatctatcctatatcatagcattatgagtttctccacatatcattatatatataaaccgcactaaggttcgcagtatatagttatttgaaaagttatatttgttagtattaaatttaaaattttggattcatgttaactaggtatatttttttgaaaaagatagtatagatcgcacaaatcagaaggaagcgaggtatatgacatgtctttattaatttatatgtaagtatgtaacaatttgcattaacttaaacctactagaagaactacttgatggtacaaataaaacatatttattaacaatatagttctttagaatttgtaaaaaaaaagcaagtaaacattctatcaaaaaaagggccaagcaccttacttctaatttacacttgattttttagacatgttttccaaacaaactaaatcgaacttccttctatataataaagagatcatagataattatttatacagatatattaaatatgatatatttttaaacctaataaatatcttggaaaaattatcaaagcaaattgcaatgtacaatcagggttggaaatttcggtcattttagacccctctgatacgatattatttcggccaaaattttggtaatatttgttcaaattcaactatttttttcaaaatttcgaaccgaaatttcagaaatttcggtgatgcatgctcaaatcagctaaaccgaaaagtttaatcccgtgtacaatacatgccggcgcgaatgcacgggctaccttcctagttaagtgaaaggttatatcgtgaagcacaactaacttgtagtcaagactacatcttatagataaagttgtacatatctaatcagagtataaaaatggatgtactactatgtaaggaagcatttgcatcagagcacaaaaactttcagagacacaccaatgtgacgcacagtagtttcgcaaagatttgtgtttgggcttgggttcaaaggctagagcaattaatcatcaattaattcttcttttggtccacaagctgctgcgcttgtttcacgagggaagcgagagtactgattggcttcaatgagcccagattacgaatgacttgaaatacctttcctctgtaataaccactggtgagaaacatagagccgtcgatatgtcagacatggtcttggaagcaagtgacagagactgcatcaagctctgcaagtcttcatccacatagctgccttcatttttcatcattgatatgaccatcttagtggtgtgttgagctattctaaggctgtcgaccttagggtcattgtttgtttctacaatctccttgagcttcctccaaacgctaaattatcaactccatggcaagtcgcatagaactgttgattcagatcttgatatgaaaatgtgaatttgtcacagatagtcacacaaagctgcaacaagaattggatgcattggctcttcatattgaaatttggtacgtgagatgacaaactgtcattatcttgtaaataatcacttgggttttcgatgtcggtttcttgtgctactatggacctaggttccgtttctgtttgcagttcttgtcctgttggcctacaatgaaggacttctgcaagaacctgagatggtaaggacttttaatctgacagtggtaataaatctaggcaggatcaggccaatttacatatgatgctaatcaaaaggcagcaggtctggagggaacttacctttggcattgccttggtcatcactcccttcaggttctggagacattcatcgtcttcggtgtaattggcacatagacgctctagaattactgctgtagctactctgaacaatatgatgttgtcacggtctaggagaatttttacgagattatcaacagagttattgtttgctttcatgatgatcatggcactaccttccattttggaagaaagcatcaccagtgcttcagctgctgccgccgctctgacgccaatacccctgctacaatcactgaacgcgcatagcagcatctggacgaattcttccctgcttgcgcaatccttacctgaatccacaatcgccagtgcagcgaggatctccatggctagcatttgcagcttctcgccgcattggtcacactcgagaatagcttccatggcgcttattgctttcttgttgcctaacatttcatggcgcaggtcggtgccagcttccccgggagcgtccacgagcaggttcataacttgcagagacttggacattatcttggaccaagcgccatggccgacgctgtgaagtaggtccaagctgacgggcgcaatgagcttcgcaatcagaccacgtgagttggccatggccgtgcggttgacgtcgtcgacggcgagggccccgaggatcaacatgccaaggaacatcatgtctttgcagtgatcatcatctttctcatcactctcaggcgaaagacggtcaggccgatcatgttcttgatcacatcctctactactcttccatgtctccattaaccattcgcgctcgtacggctccagaaccgtgcttcgaccatacgcctccggtagccaggctggtcgccggcgatcatgcgacaggcaacattgcccgtatgggtcaagcaaggaagatatgcaatggatccctcgtcggaactgctccaccaggatctcgccggcgacgtggagcacgatcgtcgcagcacactcccggatcctcctgttgtatgggcttctcggccccagcgtcacgagcagcctgtgaacaatgtgaccgaacgatgccgatgcagttagctgctgtctgatcagcacaagctgcccaagctgcacacgacgccgcctccggtcgccggagttcgccgacgtctccatgatcggcagcctcaacagcgctcccagtatctccaacccgcggacgtagccgtcacctgacttggactccagcaggtcgacggcgaacgtgaccaggttcctccccgcagcgaaggacgggttcttggcacatccacttctgatttcctgcaaatactgcagaacggcaactccaagatcaggttcatcgtattgcagcgacactgcatcaaccagactgcctttgaaatttgcaaacgtctccctgtaaccaaagatcacgccctgcaggagagctagcgtgtacaggacgtccagtgccgattgcttcagattgtcgccgccgtagtcgcgctcgattagccgccacagagaaatcccggcggagatgtacagtccatagaggtagatggcgaacagaagccacattacgatgctcaacatcgctgcttggatcttcatcaccgtgatgtatgtaaaatcgaaggtgtttttaattattattctgtgatgaacaattgggtattggagattattggttttgctatttagaatttactct

SEQ ID NO: 13659 - DNA, 1672 bp, Oryza sativa
ccaacaactacaacaagtcaaagggttctaaccaagggaggaagatggagaatcttaggaaggcttttcaacaagtttgcgccgctttcgagccactaagtgatgtagatggtgaaagtggagatgatgataagggaaagaacgtctccgatgtttgcttcatggcgcgtggtgaatctgacatagagtatgaagataatgaggtgagtgcttttgaggaagctattaatattttgagtgctaaaaataaaaagtgtgagaagatgtataaaaaacaggaatttatcattgaatctcttaagtctgaaattgataggttaaaatctcttattcctaatgatgattgtgaaaattgtgaggttttaatgaatgagatttcaaaaattagagatgttaatgctgcacatgatttgaaaaatagatcttctcttgcttgttgttttgctttgcacacacgcactttggatgagttgtttttaacaaaaaagttgttgcaaaaatatcaaattgcttttcatgctagtttgatgtttaacatgatttctgctaaaatgttaaaacaacatgatgttttggattgctcaacatgtaatttgaataagatgaaactaaaagatgctttaggtcgtgttgagtatatggaagatgttgtgaaaaaaaatgaagtgctttcttgccataaatgtcgtaaaagcaaaggtgtcatggtagattgtgaaaattgtgctaatttggaaaaagaggtttcttatttgaaaaattccttgctaaaattttctgatggtaaaaagaacctcaatatgattttggatcaatcaaaggttagcacaaataaccgtggtttagattttgatccttatgctcataactctagtcatcctcctgtcgtgttaggtgttagtgctagaagtggtgagattttgattaaacctgatacaaataaaactgtgtttaaatctgctggtatcatgtctactatgagtgcatcttcttcaaaatccaatgttgtgcatgcaaaacctcctgtttctgcctgtgttgctaaaagttctagttctaacaatgcgtctaaacaacgtgaaaaatatacttgttctttttgtgtcaaagatggacatattgttgatttttgtttcagattagctcataaacagaaaaaggagagagagattgcttttgcaaaatcaaagtggcaaaagtcgggttttccctcgaggaaaccggtcagaccgcagtgggttccgcggtcagaccggcgaccggtcagaccggctgcagagcctcggtcagaccggacaccagtcaaactggcagtacagaggcggtcagaccggcccccggtcagaccggccactgtacttcggttagaccggcctcggaggaatttttctgaaagttctaaaattgattttgcacgtggatatatgcctattggatcttctggtcgtgtgtctcagtactggattcctaaatttttattatctaaccccagtactgaggcttcgacttctgcttgtgtgtaggctttggtggcaaggaaggagaacgtgtggatcgtggattccggttgttcgcggcacatgaccggtgataaaaattggttctcctccctcaaaaaggcatccaagactgaatcaattgtctttgctgatgcttctactagtgccgttgt

SEQ ID NO: 13660 - DNA, 1943 bp, Oryza sativa
  unsure (1)..(1943): unsure at all n locations
tgcccaccttaactcgataaggcagtgccacatgatagtgcatgcatgcgtgagaattataatgtagacaggctacacctgacagacaatagagtatgtcctcaaattttcatggtatcacatgtgtacaactaggacttttttttacataatggaatgtaacatctcggcctttacttaaagagctacagccaattattacaaaactcacatggaagaaaactcacgcagaaagttcatgataccagaaagaaagctaagcaaacacaaactaatagacaccaacagaagaaaaagatcccctaactactgaattctattagagaacctccacccgaagttggcaaatagatgaataattgtcgtctcaagtttacgacattcatcatttattagcttgatatcttcatcatgcctttgtaattgagcccatccgcgaagccaatacattgccctgaaaagcacctgcaaataggattttgatggtgttttatcaaaaaccatgtcatttctactaagccaaagagcccaacatacagcggaagctccaacaagaataagtttcttgattaatttactaacacccacaagccaattcccaaacatatgagatatactatgtggaggataaaatccaaaagaaaattgtacagctctccaaagaaatttagaaaaatggcactcaaagaatagatggtgtattgattcatttttcatacagaagcaatatctcaaactaccattccaattccttctagccaaattatctttagttaaaacaatccctttgtcacgccccgaactagtcccgactggaactagcccgtgacgctccaaattaacctgttaatcgataccagtcccaggaaacagtgctggtatcacaggaagacagaatatcacagcaacagaagtctctttattatagagtagaagtacagtcatgttgggctgcggacagatcccgagctgacaactgcattacaaaagggaaacggaagccaggacttggaccacacaacacaggcgcgacttgggaactaggccgaaaccctaaaactcatcgtagccggcttgctcctggaagaactcctcatcagcaggatccgcttcatcttcttcagaaactgggggggattatttatatagagcaagggtgagtacgggagtactcagcaagccaggggaaataagtgtttattgcaggcttcaaggaaaggctgttatttttgtaatttatttttttaatttttntggaaaaaacccttttcttttttttttttcctttaaaaaaaaacgactaggtgagtgcttctcaaacgactcggatgagacagtgcgtctcgtccggtcggagggtgtggaatgcatcaatctttataattgaaacagaattggcaccctgccaacagcttttctaacggccacccgggccaacaacttttcaaacggccacccgggcctagctgatcccgtcagctgctgatttttcaaacatcgaaccccttttcacaacagcaatttcacaagcagtagtcaaacaaaactacgctaggaaacacctcacatccgcccatgaccatgggcacggctgttcgaacagtttgttaacctctgcagagggggtacactttacccacacgacattactaacccggatcacccagctcgtggggatcagccacgtcgggagacctccaagctttcatgacaaggcatttcgaaagccgatacaggtttaccatatgccgacgagaggtgtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgttcggatg

SEQ ID NO: 13661 - DNA, 10979 bp, Oryza sativa
cacgcggcgcacgcgcgcgggcggggttgggacgcggtgcacgcgcgcggctcgcggtggacgcggatgcggcgggaccacgcgcagcctcacggctcgcggtggaacgcgcgcacggggagggaccgactggggtcggctcgacccggtctaggctgagctggcgcctacgtggctgccacgcgggccggcgggaggtagacgacgacccggtcgcgaatggacggcgggtggcggcggcgagcggcggagcgaaccacggtgatacaggcaaaagcgagcacaccgggcggttgcacgggacgaggggagacgagccaacggctcggattcgccggaggttgctcgacggcggcggattgcggcggcggcaaccggcggcgagggaagagggaaacggcgacgaggccacgaggggccgattcccggcggtgagaccatctacgcggcttcgggaactcgacgctagcgtcgggttgggcggaactacgccgagcgaggccggcgacgagcgggtgctacggagctagggcggcgacggcagcgagcacacggcgagcgacggcaatggtcggggcggcgccggctaactacggggaggctactcgagctactaccgaaatctaaggggaggagatggagcgaggaggaagaacggagggaggcactaccgtgcgggacggggcgctgtgacgagaggccgacggcgcgggagtaatctctccggcctcgggccggggaagaggaagaagaaggcgcggccaaagtcttcttccgcgtccttgctcgtgccggctcctccgacacgcgcgatgacgatcggcgacggcgaaacagagggcggcaatggcgcggaggcgaaaatgagagagtttggagggggagggcttgggcttaaatgggcggcaatgtcggtttgggagaggggaaccgacattgaacggtcaaggcgcgagcgggcgctcggcgcttgtagccaaagcggcggcaggaggatgacgcccgcgaggaggaaaaaggggaaaaggagggggagaaaggggcttgcccctttgccgattcgggaaaaaagggggaggggagcgggagcgtcgcggcagagggaggaggggcgcggctccgtcccttggcggcttgcgcgcggagtggcgggggccgggcgatgacgacggcgatgacggggggacggcttggagcggagcggcgacattggcgacaggcgcgtgcagaggctgacggcggcggcgaccgggcggtcggccactcggcacgcgcgcgcggcttgcaacgggcggcgtccgcgcgggcgcgcgcgaacacggcccgcgggaagcggcagcgagggagcggtgagggaggacttggctcgccgcgggcggcttacgcgtgctggctcacggggccgagcggaggggcacagggcgcggctctcgcgctcgcgcgcggcgcgcgagggaggggcgctcggcgcggcgacgcgcgctcgcgcgcgcggcgcggggcggagcggagggagagagggagagagcgggggcgcgccggggaaagcgaaagggagagggagatgggccgggggagaggggaagatgggccaagggaaaatcggcccatcgaccctgggggaggcagaatggacttttgcggaggaatttgatttggagggattggattcggaattgaactcgacgatagatcggggattgagatcttgagatggcacggacactagacaacaagcaaagaaacaaatttcgcaattagggtttttaagagataattttcccgctaggcgccacgacggaacgggcgctacagaccaaccccctaacaagaatctcgaccccgagattcagcacctaagggagcagctccgggaactcggcgcggagaagatcttctcgctcccaggttgcctcatcttcagaatgattgctccattggaccttgtagaacttgatggtcttccttcgagtatgacgttctgcctcttcaagaaccttgatcggtctttccttataggtcagattcttttccagctcgatattacctagggggacttgctcttctggaactcgaagacatttctttagctgggatacgtggaacacgttgtgcacatctgcgagaccttcaggtaactcaagctgataagccacttcgccacgtctggcggttatgaggtaggggccgatgtagcggggtgctaacttgccggacatcccaaacctcctcataccacggaggggtgatacccgcaggtatacatgatctcctttttcgaactcaaggtcacgcgttcgattgtcagcgtaattcttctgacggttctgtgctgtcttcaaacgttctcgtatcagcttaacttgttcttctgctgacttgagtatgtcaggaccgaataccagcgcttcgcccacctcattccagcacaagggagtgcggcactttcttccgaacattgcctcgttcggcgacatctgaatgctggcctgatagctgttgttgtatgagaactcagcatacggcaaacaacgatcccaagtgccttcgaaatccagggcacacgcacgtagcatgtcttctaggatttggtttaccctttctgtctgaccatcggtctgcggatggtaggccgtactaaaatttagatcagttccgagagcttcatgcaactgcttccagaaccttgaggtgaactgagtgcctcgatctgacacaattttcttgggacagccaaatctacatacgacatgggtcatgtagagttctgctagtttctttccatcataggtggttttcactggcacgaaatgagctgatttcgtgagtcggtccacgattacccagatggagtcatacccgctgggggttcttggcaaaccggtgatgaaatccattccgatctcttcccatttccactcgggaatcagtaggggttgcagcagaccagctagcctctaatgttctgccttgactctttggcaaatgtcacacaaggctacgtattctgcgacatctcgcttcattccagcccaccagaagtatgccttgatatcttggtacatcttcgtacttcctgggtgaatggagtaggcggactcatgagcttcctttaggatgagatctcttaactccttcttggccggtacacagatgcgtggaccgcaccaaactgtgccttgatcgtctatggagaaattggtgtctttcttctcctgtattctttttatcaactcttttatcccttcgtcgtctttctgagcttcccggatttgcgactctagggtaggatgtactgtcaagctggcagggacacctgactgtaccacggtcagccttaacttctctaattctctgcacaggtgatcttggtcaggccgtatttgagctacattgcaataggccttgcgacttagcgcatcagcgaccacgttggctttaccaggatgatagtggattccaagatcgtaatccttgattagttccaaccatcttctctgtctcatatttaactcggtctgtgtgaaaatatacttaagacttttgtgatcggtgtatacttcacatctgttcccgattaaataatgcctccagatcttaagagcatgaaccacggctgccaactcgagatcatgggtgggataattaacttcatgaggcctgagctgcctggatgcataggccacaacctttcgttcctgcattaggacacatcctaagccttgtcttgatgcatcacagaagatctcgaaatcttttcggatatctggcaaggtgagaactggggcagtggtcaaccttttcttcatttcttgaaagctgtcttcacaagctgcagaccattgaaatttcttttccttctttaacagctcggtcataggtctggctagcttagagaatccttcgatgaatcttcgataatatccagctaagccaaggaaactgcgaatctctgacacattcttgggcgggttccaagcaagtacagcttcaaccttgctgggatctactttgacaccgttggaggagatcacgtgtccaagaaatgctactcggtctaaccagaattcgcattttgagaattttgcgaatagttgatggtccctgagcttttccattatcaacctcaggtgttcagcatgttcttccccgttcttagagtatatcaggatgtcatcgatgaataccacgacaaactggtccaggtattccataaagattttgttcattaagttcatgaagaatgctggagcattggtgagtccgaaggacataactgtgaactcatatagaccataacacgttgagaaagcggtcttcgggatatctgcagatctaattttcagttggtggtaacctgacctcaagtcaatttttgagaaaactcttgctcctttaagttgatcgaataaatcgtcaatccgtggcaacgggtacttgttctttatagttacttcatttagggctctatagtcgattaccattctctcagagccatcctttttcttaaccagaagcactggggctccccaagtggatgagctaggtcgcacataacctttactttccagctcttcgatttgtctcttaacttctgctaactcattagctgccattcggtagggtctttttgcaattggtgcggtgcctggcgccagttctatggcgaattcaatctctcggtctggtggcattctcgttaattcttccggaaatacgtcgggatattcacagactacgggcaccgactccaaggaggtgacttgtaaactggttagaatagaccgatttgcggtaggagtgttaggggtaaagcggacttgctttcctccaggtccttgcaaggtgatggacttttcggcacaatctatctgtcctttatgcttagccaaccaatccatccctaggatgatgtccatgctttgcgagtctaggactatcggtttggctaggaagtcaacttcctcaattctaaggttaacttccgggcatatttgagttgcccttatattcctcccaggggaatgtactatcatcggtacacgcaaattttgggttttccaaccatttcgtttcacaaaagcttgcgatatgaaagaatgagaagctcctgaatcaaacagaactattgcgggtacggagttgacagagaacatacccatcacaacgtctggagcatcctgagcggtttcagcttgaatgtgattcacacgtcctcgaccaaagtggttggaagcacgtgaactttgtccacttgcctgagagctaggacgagacagagctgccgctggagtaggagttctagcagtgctgccattagcatgccctgagttggtgttggtaggattctgaggacactgtcttgcatagtgacccatctggttgcaccggaaacactgaactgctgacggtccttgcggtgacttgaaagaggtaacactgtttggcgcagtattgccactaggggcacgctgctgtggctgaggtgccggtcggttcatctgaggacgaggggcgtagcctggctggcggttagcctgagtgaccgactggtggtattgcatggattgaccgtagcgagggcgaggtgtgcctcgggaagaatttccctgatggttagacttgcgtttcttgtattcttcggtagcctcttttctggcatcctcaagcagaagtgccttgttgatcatatgttgaaaagtggggaagacatgagcaagtaactggagtctcattccaactgcgatccctttcaagaatttcctgatcttcttcttatctgtgtccacttcttcaggggcgtgctgagctaacttgttgaactgacttaggtactcattgacactactgttgccttgcttaagtctgttgaattcttctttcttcatgtcaatagtgctttcaggcacatgagctgcacggaaagccgtagcaaactcatcccaagcaatgttagtgggttcagggtgtgcattgcagtaattctcccaccaatctgcagcaggtcctcttagcttgtgagaggcgtagagcgtcttctcaaccggagtacactgcactaagttgagttttctatcaacatctttcaaccaatcgtcagcctcgacgggctcgacggtctgagagaactctggcggacgtgacctcagaaaatctgtcagcttggatcaattgttgcccacgtgaaggtggccatttccatgcgcattatgctgaaaactggctatggctgtggttagtccttgcaagatttgtgtctgaactgccattatgtgttgcatgttgttttccacatgaggtggggaagggaggcgttcttctccagaattgtgactggtagtgcggtgagagcagtgagactgtcccatctctgcatcacgggaaactgtgcgatgcgagcggttgctgcggcggggttgctcaacctctgcgttgcgggaaacagtacggtgcaaacggttgctgtggtgtgactgctcattagccgactcatgattttcttctggctcaactctaccatcttcaaaaccaaagcgggctggtgcacgggctgcatggcgggggcggctagccatctaaactcccagaagagggcgaggtaagagtcagacaagcacttaggagggcaaggagcaaagtaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaacacacgcacgcactacctcgccacgactccaatagagttggcggcggaacaaaaggggcctaacacacggacggctgctgaagactgcctcctctactcctcgtcggcctggctgcctcctgtagtcggctcctcagtcgaagaaacgtcgatcggctggcgcgaagggaccggcggaacctgtcgagggccggcagcagcacgggccgctggcggtgggggagctgggtggcggaaacggaacatggtggaagaaccaacaacacgcttccgcgcagtgcggataaagcgtgggccacggcgggaggaagcaactggggtgtgtccgggggtgtaggaagggctaactgggtgtgggtagggggagtacactggtgagtacggcgcacgcgagctgggggagcgcgggccactgggagtgcgggcagagccgcgggagctgtgggaggacaggtggctggcgtggcagaggcggcctgagtcccaggagatagtgtcaactgaggtgacaccctcctcggccagacgggcctccaaggcggcgtagcggcgggcaagggagcggtaagcctcaaggagtaggtcgtgctgagtggcctgagcctccgaaagctcaaccatgcgagtcagcactagctgagactcgctgtacggacaagggtacctggcgtctgagtggccagaaggaaggcgtggaagctgccggaaggcggagcctccgagacggtggttgtagtcgtgggccaggcgatgaagcgcagtccaggagaggtcctggtacgcgatctggagagtgggcctggccacggtgaagtggtgtggacgaaggccggctccgtgtatacctccacgggggtaaaggtacacagagagctcacagtgagggggaacacggtccacggagtaccccgtgtactcgggacacgagaagccaaggaaacaggcgaggtcacgaagctgagcgacgtggtgaccctcaccaaaaccgtgggaactgaagctggcgctcactgccatctacaattttgaaagagggagaaagatcagtaaccattttagaaacaaactattgaaaataaagaaaacaaaagaaaccttagcttttcgcaagtagttttgaacttagtatccatagggtcgtcctaaacgtcgggtttcgccttagggccaagcctgtgctctgataccatctcttgtcacgccccgaactagttccgactggaactagcccgtgacgctccaaattaaccagtcccaggaaacagtgctggtatcacaggaagacagaatatcacagcaacagaagtctctttattatagagtagaagtgcagtcatgttgggctgcggacagatcccgagctcacaactgcattacaaaagggaaacggaagccaggacttggaccacacaacacaggcgcgacttgggaactaggccgaaaccataaaactcatcgtagccggcttgctcctggaagaactcctcatcagcaggatccgcttcatcttcttcagcaactgggggggattatttatacagagcaagggtgagtacgggagtactcagcaagccagggaaaataagtgtttattgcaggcttcaaggaaaggctgttatttttgcaatttattttatttgaactcttttctaaaacgactaggtgagtgcttctcaaacgactcggatgagacagtgcgtctcgtccggtcggagtatgtgcaatgcatcaatctttagaattgaaacaggattggcacccggccaacagcttttcaaacggccacccgggccaacaacttttcaaacggccacccgggcctagctgatcccgtcagctgctgatttttcaaacatcgaaccccttttcacaacagcaatttcacaagcagtagtcaaacaaaactacgctaggaaacacctcacatccgcccatgaccatgggcatggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccaacgagaggggtcccagaccaacaacaggttagttcccagaccatactgtgccaggaagcccaggggtcctccccgacaccaccccggcgaatccacatgtctctcggcatcaaggctcccctgataagctagttacttagccaggggtgtcccattccacccatgtggtcgtacttgtcttatgttcggatgaaattccaaggaaacggtccttaagtgcaagagcgggaaaccgtacacccggtacgttcccggtccgcggttttggaaattcatttaattcacaagcaccgacccaggtgtcgggttttccaagtcttttgtaaaactccagttttacccaagttgttactcagattttaagtttgaaggcgaccgtcgatactcgcacagagtgcacgaatatcgaggcgtaactgggtggttacaagggacatggtacagcaattaacaatggaaggatcaaatgcaacaagttaggtaggtccgccaatctgccttgcagacggaacaatagattaagtgcgatcctatcaatgcataatattttgcaagcaatctaattagatttcaaatataggctcaagatgttcaaaggtggcttgccttgctcgagatctggagcttgatcctcgaaatcctcgcactgcgggtcttcgggctccgaaactacacgcaaaacgggacaactcaacaaacggcagaaataaagccctattaatgacctctaagcgtgccattagatagatctcgagatttgagaaattttggaagttgaacggagtcaaacggatttacggttgggaagatattgaatttctaagattatcggatttttggtctaacggaaaaaggatttaattaaatcctttttggaaaagaaaaagaaaagaaaggagggagggaatatagacttttctcaggcggctagggtgcggcccaagagatttggggcggctcggccgagcttaacgggccggctggcccaagacggcccaagcgcgcgcgcgcgggagggaggagagagagggagccggtggaccgggctcaccacgcgtggtcccgggtgggacccgcttgtcagcggctcgactcaccgtgcggagggagcacgcggcgcacgcgcgcgggcggggttgggacgcggtgcacgcgcgcggctcgcggtggacgcggatgcggcgggcccacgcgcagcctcacggctcgcggtggaacgcgcgcacggggaggtaccaaccggggtcggctcgacccggtctaggctgagctggcgccgacgtggcgcctacgtggctgccacgcgggccggcaggaggtagacgacgacccggccgcgaatggacggcgggtggcggcggcgagcggcggagcgaaccacggtgatacaggcaaaagcgagcacaccgggcggttgcacgggacgaggggagacgagccaacggctcggattcgccggaggttgctcgacggcggcggattgcggcggcggcaaccggcggcgagggaagagggaaacggcgacgaggccacgaggggccgattcccggcggtgagaccatctacgcggcttcgggaactcgacgctagcgtcggattgggcggaactacgccgagcgaggccggcgacgagcgggtgctacggagctagggcggcgacggcagcgagcacacggcgagcgacggcaacggtcggggcggcgccggctaactacggggaggctactggagctactaccgaaatataaggggaggagatggagcgaggaggaagaacggagggaggcactaccgtgcgggacggggcgctgtgacgagaggccgacggcgcgggagtaatctctccggcctcgggccggggaagaggaagaagagggcgcggccgaagtcctcttccgcgtccttgctcgtgccggctcctccgacacgcgcgacgacgatcggcgactgcgaaacagagggcggcaatggcgcggaggcgaaaatgagagagtttggagggggagggcttgggcttaaatgggcagcaatgtcggtttgggagaggggaaccgacattgaacggtcaaggc

SEQ ID NO: 13662 - DNA, 13593 bp, Oryza sativa
gagaggggaagatgggccgagggaaaatcggcccatcgaccctgggggaggcagaatggacttttgcggaggaatttgatttggagggattggattcggaattgaactcgacgatagatcggggattgagatcttgagatggcatggacactagacaacaagcaaagaaacaaatttcgcaattagggtttttaagagataattttcccgctaggcgccacgacggaacgggcgctacaccctttaaggagataccacataaaaatcttaatcttaagaggcattttatgtttccaaataattttatttctctcaatgtaaccattattaattaaagctaagtacatagatcgtacaaaaaattggccattttgatgaaaattccatctgaaaatgtcatcctcgtctatgcacattgaaagcacacaaattatgccatattattagatcctgaccaactaatgctcttctaaaagaaacattaatactacagcaaaacaaccagctagagacgatctgcttactacgatttatcaaaccgtctgtaatgaactcaactaccgtataccacgagcacaccccgcaaatgtagctacgaaatgaagagacggggattaaaaccgtggctactcccccaccccacgtccccactaccatcacatcttttagaaaaaaaatgtttatatcctatttaattttggaacggagtacgtacgcggtcaaatccaaaaccctcgaggtggttccgcccaccgccgccgcttgctgccgccaccgtcgtccaccactgccgtttccccctgtcaccagccactagcgacagtccgttccagccgtcatggcctaccacccaccaccgtctctcaccgccgctgcccaccactgccgtcgccaaacgcccgccggcgctccgttgcagccaccagggcgtactggtcgccaccgccgcgccgttctatctgctgatttgtgggcgatttgggatgggatcagacttcaatcggctgattcaatgggccaaaaaaggattgatcttccatgtggagcctcgaggcagatcgatttagttgaggctgtgctgctacttcaacaaggtaatggggctgctttctctctccatcgagactgcacattggtccgagcatttgttgcaattggttgtgatccatgctgaacaatttgatttgggatccgattaattggttctgattagaggtggtgccctatattataataacctgttttgctgaagtaggaattattcgaacgacagcaatattactagtcagttatgttattgagttctcaatagtaaaagataatactgtttctgaaatctgaactgaatccattgatttctgaagtctggacagagcacaccaatataaatttgaatgctttatctgtatttttttatgcagggcatctcttagcagaatagaggaaaaacttgtggttctgttattttgacatctgtgttaattgattctcatgaatgttggttatggctgaagcatcccatgtaactacaaggtaagattaaataattcctaacaaattttgtgcatatatgatggctagtctcatgagaaacaaactctgtacatgctgcgcatgctatgttgatatatatttgggcagaccaaataatgacagtactgataaatcattagtaattttgtttcagtgttctgctgttccattgcataatcagaagacaattttgttcacagacttcaatgtttattaggggcattactgcaagatgaacctgctgaacttgaaatatcatggtattcttgatgactgaaaggtacactccttcgcgtccatagtgttaaatctgtgagatagttcatgcctcatttctttgggtggtacttgttaatattttgctcacaaattttttttttgttgctagcctcttcacaaacagtgatatattttcaattcaaatggccagataacccacagcattaattttcatatgctatgcgttggaattactatttccatgatcaatagtcgaccccatgttggtaaacttgtcaatcttttcttgacgaaaacattttattagtagtttttttctgctccacttatttttctgtagactaataaagtttctttatactgctgtttcattgtctaaaaggtatgtgaagatgatgataaacaactgaatggttcatcgaatctggagcaatggggagatgctatgcctgtttatgacactctagctgaaattgtactagttgaggaattgtagttataattgtacactgtttctataacaagttctattgtatgatgtaaattatcacttgaatgaataaaatgtgtgttttctttgatgtccctaactgtaattttttttctgatgctaaatgaaatgtaatggtatttgatattgcccaaaagaatctgtagatggcacaattgtggtctgttcccgtgtcaaacaatttcttccctagagacggttgaaggtgtgtctactctctcaaatgcttgaataatggatttttctttttatatccacaaaaaatggaaaataaatgtagagacggttttgcccatttctattgaccgtctctacctcatagtcacggttcgcacaaccgtctctcttttatagagacgggagcaatggcaacgcctctgagacggtttcaggttctgaaattgtctctagtagatgtagagacggtttaaaccgcgtctataggctactaaaaccgtctctacacgcagtttctgctgtattaagccggaacagaacccataacattagcaattgaggcatttttccttctaactatagaagacaatgaggggtacttttccttcaaagaataactccctagccatttggacaactaggactatgcatatattattaaggtccacttggaaaatcttaatatctcaataatttcttcaggcatgtactctgtgtattctataaatacatcctccctaccattgtttccccaacaaaatataggcaaatactgaatgggtggtctgtgtggcaccatgattaattcttatcttggccatgctgccagcaattctaactatggctgatccatactgtgactgtgattgttcccagcaatgtgtagttaagttgcagtatttcttggaccaattccgtgctggagcagaccatccaaaccgcaatgaataattcgtgaaacgtggaggaccttctgggttaggcactgggcttattcatgactggagtttaaccactggacttgaccccaatgtaaatattgttgggcgtgcacaaggatggcgtatcgttgccagccaaagttccccagttaattggtacctttctcagaatatagtatttcaggacaagtaaatgctactcactttttagatagactatatactacttttccattggcttgtatcactaattaaattgccatccatggcaccattatagtaagtatgcatggtctacactttaggtgatgggaatcatttaaggaagtgaagagtaagttggagagtggtcaattattggtgggactggcgaatttactaatgcgcatggtaatatcaagtatagggaacttgatattcaggtgttctacactccaatcactcaatcagatgcaagtttcttaagaagtactgctacaactcttttacaggttgtttggttggaacaatgggatatgtgatggtctacaaaattattgttatatgttacagctgggagaccgctgcctccaccgccgttgttgttgccgccctgtccgaggcccaccgtcatcatccccgcagtggcaagcgacggatccgctccgccgccaccaccctagccaatgctgccgccgccgtcatcgatgccgctgcctctctcactgatgcagccgcccccgccacccttgacgtggccaccgtcgccgggaatgggtagaggggggggggcagggggagagggaaagggagagggagagggatgggatgagtgggaatcggaatgggatcgagatgggaggagtgggaggatgggaggagcgtggtaccaggagaaaaataagtggggtaggtggggcggtgggctattttcgcatgcgggtcacttaaaggtccgcatgcgaaaataaggctattttcgcgtacggatctattaagaggctcacctgtgaaaaatgatttttccgtgcggtccttctgaagagccgcacgcgaaaatagagcactatttttgtagatgtgaccacttactgtccgtctgcaatctaaagtgagttttgtacaggaaaatcatctctactagtgcgacaccctcctggagtatgctagtttgcccgtcaggctacccgatcagataactccaacaccacatgtctaaccggcggtacccgctcagtgtgactggccacttagagccgataaaaccgttcacaatcgaaaaacactgttcaccgtattttcaactaacacttacctttcacaattgtttgtcaccaagattaatcatcacatgattctacatgtacatatatatgttatgtttgcgaatgacaggaatttactcgctgaaattaagtgattagctgatgccaatttagaaggtctggtatcctattttacgcatatcatcatgtgggcttggcgttctataaaaagaagatttcgccatatcagggtttgtggataacttgtatatttttagcttttcctgttctcaaatgaccagccatgagtatgccatttcttaggagggatcgtgagagttcagttaggggaacaatggggaataaatctgatctagtatattacttttcaatttctttaggagattttgcataataggccagtttggtttggtaccgtaccaaaatcttggcagtgccaaagtgttggtaacttttggcacaaccaaatttggatgggcaaaatttctactatctaagagatggtgttgctaaaatttagcaccaatccaaacatctagaaacactactgaagattgccaataaattagtagggcataatttggaaccaaaccaaagcatctccaatagatgcctaaaatttaactcccaaaaatctcagattggggtcatcccaaaacaatttgagccaaaaaatcacctccttgtccaagagcttccctatttttagttcccaaaagcattgaataatgccacatcatcgctggtgggtcctcttcaactgtttctagcaatctggtttctcatgtcgctactaggccgatcgttggcaagatcagggcatggcaggccgatcgcggccacatagtcgctagcaggctagcaggcaatcaccacagagacatgacggttaggcgatcggggcattgcagctgggagccggcagcccgggcagtgcgcggccagcctgcgacacggtgagggtgccagcagctagtaagtcttgcattatgacactatattgtggatctaggtcaagtaaagattacactatgacaaagttctggtttgacgaaccagatgtgctgaaactgagctctccaacaatcatggatcttgggatgactataattggcaaatgcttacaagctttacttgaatttgaaaatgaggacatagtataaccataaacagggatccctgaaatcgctacaaaacaaatcccttgaattcataatatccgtgaatatatctaggtgaattcctaacaaatacattgaatttctgaagttcaattatgattgccaacaaacattaccatttctagccctctccttccctgatttggtgtcacaaatcatcacaagaataaggctaggtaatgccctctccttttcccgagttatgtaaaaaggcataaaaatattattatttactgaaattttgactgtaccacacgcataatatggtttagattttcagactacattctaaaccagattattcagttcagcaatgtcagtactaccaacgccaaattattcagcatcaaagagttgataccttgcagaatctcttgaagcttcagtatgcaattgcttcatgacaggcagtgcagtgtagtgttgcaaattgaaaaacatcgagcaaactgaaaaccaagtaaagtgttgccctcatccgacaatttaacctcaaaataatgatttctcaatcaaccaaaacttaacaccatatttgtcattgtgtgcaagaaaaatagcaaatagacatccaccaaacaatattcagattcaatttgctctagaaaaagtacaacgatacacatagtcaaaattttctttaggttcattcagtactagggcttgagcagcttacagatcggcgggtggatcaggatgacctgccgatagtatgcagacggccttggtggtgctgtggagacgacccagcggcgtggagcggtgaacaaagatggccctagcggcgtggacgacaacggccacgacggcgtggatggaggtgtcggtctggacaaagacgaatggaacggagaaagcccgacaccggcagggtggcggcgtctgatgcgagctaggagaggggactgagcgacggcagcagggcacgacgaggagaggagggaggaggaagaaattggcgcgagcaaagaaatctacgtgtgatcgctgcgattgggaacgcccagggctgccccaaatctgactcggttttgggactggattgggcgtgggggatttttgggagcaagtttgggcagctgttggagctttcctttgaactaaaatcctaaaatttaatttttggggacctgtttaggcatctgttggagcaagtctgtctaatattttgatatgttgtcagtagtgttctcatatttgcttctgagtcagctagataggcgtatgccacttatttggacatgactagatagagaccgcactctatattgtcttaaccagagacttatcttagacctggttgcatactagtacaccaaatgatacatgtttttttttcttatagatttttcttttaaattatttatccgatttataatccgattacaccattgtgttcgtttaaattaaatctttacaacaagatcttacatgactatattttgataaaagaaatatctatgttgtaaattaattttattatatatgtaagttacttttatcatatatataaattacttttcgatttgattaaattacttattatacaatcataatgttgtgagttgtttattttattatcctttttagtcaattctacaatttgtgttgattaaatttagtttttagatagactcacgattttacctccataacggatctatttttaatgtcatgacaaagttacttcctttttgtcttaagttacttctataatatatgtaaattacttttatatgtgtaagaagtaatttagtgaaatctaaaagtaatttagatatactgtaaaagtaatttgtaatttttcatcaaaatataatgatgtgagatcttgttgtaaagatttaattcttacgaacacaaccgtacaatcggatcgtaaatcgaatgagtagtttaagagaaaattttatttgaaacataggtaataggattatattttctacttacttgatggggactagtactatttaaggcagatagggtctctcgttagcactaaaacgagaggcctcttgatttagattttgcccacttattagttattacgatgttgtccagcttctcatcttaagcaaaacaattaatggaacttttttgcttccttcttatctatttaagtggtcgaacaaaatactggaagtggccacatatagtagcctcctcaccgcttgcaaccttgtcgtgtacgatgctaatcgataagccatgcgctgacagaggcatagagcaggtgtacatgaatagctactacgaaaaattatcgcaaaacagagtaaaagcagagtgctatcaggattcagaaatactctctgataaggttgacattactgatcttgtggctcaatcaagaaacacagacccacacgttcaactgagcgagcagttctcagaaggctgcaacagtaatggcttccttcagatgtaggaatacccattcctgtatgtatagtttcctgatgcctctggttccaattgatggttagtgtatatatacgctgctgctgtattttctaagaggggttttacagtgcttgggaggtacctggggtacctcctaagccaattaataccaaccgttgattctgaaaggataatttaggaataagaaatattgttaacgcgggtagattagtaattactcaaccccctacccatcgactggccagcgacatcctatgccgatgctgagcgccggtgcatagggcgtacggcggttgatctaaaggtagcagatgcagagagaagaaagagaagttatccctcataggatctgaaccagaaaaggtacttgcaatggatattggtagaaatgagacgaggaggtgaaacatatatataaacactggtctagaaatccttagccaaaaaccgacacatctgagtcatttcccatcgagcctaagccatgcacatgtaggtggtgaaaatgaagaatcaacagatatatatttgcgtcttgttagataagcttttcaagatgtatcttataaaggcaaactctatattaaaattgtaccacttcatgagtattagaattagattagatttgtatagcctagatactgtatgtgcacatctaggcgccaccccgctctcgccgcgttctccccgcgccactcccctgcatcgtgccgcttcggccgtgttctcgctgcgctcccgctgtgctcccactgcgtcgtgactgtgccacgtcttcgccatgtctaccgggtccaccagattctccatgacttcgggcagcacggcatcaacatcttccggctcttctctgacctccgccgccagcaccggggagtccattggtgcaatcttcgtcaatccatatgccgccatcaacgtcaagactcacatcccaatcaccctggagctcaagcatcccaactttaccaagtggaaggccttcttcatctccatgtgcagcaaatttggtcttcttcctcacattgacggcaatgctcctcctcgacccgacaattcggcttggggacaagccgatgttgtgttcaaggctggctctttggcttcgtttcagatgccatcctcgacatcgccatggaacccgaacaaacatcccgcgatctatggctcgccatcgatgatctctttcatgtgaccaaggaaccccgcgtcatctatctcagtcatgagttccactcgatgacacagggcaacttgtcaattgctgactactgccataaggtgaagaccgccgtcggtgccctcctcgacttcagccaccccgttcctgagtctcagctcatcctcaacctacaaagtggcctcaacccacgtttctccagcaccgccgaccacatcgctggtgcccccatcctgtcgtccttcacttcggcgtgcaatacattgttgctcaaggaacttcgcattgctaatgaccacaaggtctagaccgaggcagccacggtggtagctgcctcctctgccaacacttgtgcctctggcacttgcgccgcctcttcctcgtcgcagcctcgcggtggctgcagtggctccaaaaacggacggaagcgcaaccaacgacgcaatggcggacagaacaacagcggcggcggcggcaccggcgatcgatagaactacgacggcggtggcggctatggaaactctggaggcagctttcagcagcagcagcaagtgttggcattagcttcgcgttaacgacccatggttctgctttaatccatggcccatgcagcagcagcctccctggcggccccctggcaacggtgccgggttgcttgggccttaccatcaagtccacacggactttgccggcccatacgtctcttcaccaactccgggctggcctcaaatgcagcaagcttagcccaacagggatcaaacaggtctggttgctgccctcaatcagttgtccgtgagcagtccaaatccctgggtgcttgacataggagctacttcacacatgtccaccatcgatggtattcttgttacttgcctccctaattcacatacttttattaccgctggcaatgatcatactattcatgttatatgtcatggcacatcttttctacctataggaaccactaagtttgctcatagaaacatccttctcaccccttctttggtttgaaatgtactttccgttcatcaattcacccacgacaataaatgttttattgagtttgatgagtttggtttttctgttaaggaccttcggaccacacgcgtgattcgtcaatgcaatagttggggtgacctctacaccctgaccactgccgcccctgctatcgccgccaacaacttcctcgccgaatcctccacattgtggcatcgtcgccttggtcattctagttcagctgtaatctagactcttctcaaattaactattcttccttgtactaagacagatcataaattgtgtcatgcttgtcagttagggaaatacacgcatctattttttctcggtctcattctagtacctcttctccttttaaacttgttcattgtgatgtgtggatctctcttctgtcttgagtacttctggctttaggtattatttagtggtgcttgatgattttagtcacttatgttggacttttccactttgccatatgtctgatgtacaccagcgtcttgttgagtctgttgcctatgataagaccctgttcggccttcccattaagtgctttcaggcggataatggtaccgagtttgctaaccaagccaccaactcgttcttcgctagccacatcaccatgcttcgcctatcatgcccttacacctcccgacaaaacggaaaagccgaatgcatgcttcgcactatcaacaactctatttgcaccctccttatccaagcatcatgcctacatcctaccaggctgaagctctagccactgccacatagttactcaatcgacgaccccctactgtagtctacaactccatcctgttccaaatcttgcaccgcaaagttcttgactattctaaccttagggtttttggttgcctttgctatcctaatcttagtgccacgactcatcataaacactctcctcggtcagctgcctatgttttccttctctaaccggcctctcacaaaggctatgagtcttcatatctcgtcatgtggttttcgatgaacaaacgttcccatttgcagctattcccctggccgctcttctgtcgattttcttctaccgggtgcttctacagcggtagctccgtcctccttggacgttgagcgtttgcgccctctgccggccggtccctcccccgaggtcaagtcgccgatctccgatgacttggccggccctgatataaatcagcttgtccaacacagcagacagatgccatcatcgcatactccggaccaggttgcctcgtcgcctagtgcgccctctggtgacgactcttgtcctacgggcaggagcatctcctcttcatcaccaaccagaacagtctacattgagctcttctgctgatcggcagcccgttcggcagcccattttgcatggtgttgctcctgcccgaccgttgatctctccgtatcgacatacgtatatatcatgttggtgttccagaacatacgtatatattcagaaacaatatatacggaagttggctttcagaaacaatatatatcggcataagtattgatagagagaatagatgtggaagtatacttacagaagtggaatacaagatgatgacaaaagagaaagagaattgtcacaatacctgtatttcagaacaaatatgaatagtagtttgccttttacttgaaaaatgatcctaattacaattcaggattagaagacaaatatgacaaattcagcattgcaagcaggcatctgaaacaataacaggcattttgttgggtaaatttgtgcagcctagtttgtttgctttgaaaataaaacaattcattttagcaaacagccattacagtagagtagcaacaaaaacaggcatcttaaattatggccttgcataaatctagctaggtatttcttgggtattgcacaacaattggatatacatgaatattcattggtcgttgtgttttgcagctcaaaattagttaagtacaataaccatgttattaattgccaatttgttgccagagaagctcagtatttggggtactattatagtcatcctgctgacgaaactaattaattatgattccatgtcctatcttacgtataaatctactagaaaatcgtgacaatattttactttgtattttttagttccttaagtatatatgattctggttttcagaatatgcatcgcatttccagagtatgaacatatgtagtaggacatatcatcatgtagtttcacatgcgtagccatcacacaattgtcagcttcgaaaatcaatagctgtgcataaatcatagatgggatcaaattattttagaattagggccaatgaaattgtttcacatcgggggcatgtgctatatatgtcatgccaaaaaggaaaaggttcacatacaaatatttagtacaactgaaagctaaattgagggtatggatttatgtatatattcagttgtttccttgctcacacatacttccatcaaacaggttaatttccccgcttgcgttacatggttatgtttatcctctttgtgcaaaaaagtccaatactgaatccagttgtcggccctgtagatttcttacataggagaacaaaattttgtattgtcaaaacacgttgtcaaaatttttgtttaccctgtatagccacattccaaagatattaaaagtactatcaggtggtggaagaacaaaagctattttagttgcatcccaaataaatttagcaaaagggcagtaataaatagatgttctcatgttctgcagctcaaaattaattatgtacgataaccatgtcgttgatgccattttttttttcgaatgattacatgtcattcctgtggggaaatgggagtaaacacatctagctacggcaaaaccatgataataatattttgtcaatgatcatctttcttacgtataaatgattctgatttcagaatgtgcatctcattcccccggtttatttgttttgcgaaacaagaatatatataagtgggtcttaacatcttgtagtttcacatgcgtagccatcacacgattgtcagcttcgaaaaccattggctgtatataaatcatagattagatcaaattaatttggatatggaaccaatgacatggtttcacatgggagacatgagctgtatatgcatgtcatgccagaaaaagaatggctcacatacaaatatttagtacaactgaaagctattccgaggataaatatgcctttttttccatgctcgatcatatattttttctgaaagccaacttccaccacccccagaaaataacatcctataccagcccattgtttctgatggcattattacaacatgaacagctagcttgtggcaccattcagatgggcaaaa

SEQ ID NO: 13663 - DNA, 565 bp, Oryza sativa
tcaatttaagttaaaatttcaaaactcctaccaccaatcttgtttttgcatgaacacatatcacataaagcaaagctttcatttagtgattgtttactttcacttaatctgttggtgaaaagctgttactgtcctgatatttatattaaccattatacactaacacctttttttcattttaaaggttcaagttgcaaagaatattacgaaggggaactaatctgcaggcacgcagtgatcaccggtcaatgaatctccagcatgcatgaaaaatttgatcaaataaactatttctttccacatatcaatgttttgcgatgtgatttgaatgtattgtatttttttccttacgccattggagtttttctgccaatctggcaactgttaatcttttatctgaaaataaatgttgtatgtgagataagcaacaccagattcatgttacagtgcttgtgattgtctactaataattattactcttctctttgtgtaattgtgattctcaacataaatttacagtgattgtgtctcctaatgcaaatattttacttatagagtggagtac

SEQ ID NO: 13664 - DNA, 1293 bp, Oryza sativa
ggagatggtgcagtaaagccaggcgaggacgacgcagtccatctgcttccaatcggcacgatgggggagatgttcgtcggagaggacatgttccgtcaaggcatacttgctgagggcgacgaggaagaggccacgccacttcgtgtagtttgcggcggcgacatccagtgtgacaggaacaagagccttcacgttgaggacgctgatggcctaggcgtgaagggcggcgctggtgtcggggtcgagcacaggcgcagcgcggcggagtgagatgggccgctgccatgaacgccatgcgggaaccctggcaggacagaaggcttgggccaggagtagtgggctggcgccgagccgggtggaggcaggccggctgccacgaagagcgcggcgaggtcgacgggtgtcgcgggctcgccggacggtggagccgaggtgccgaccggaagcatggccgtcgtggtcgtcgttggagcgtggacgtcgacgggcggggtcggtgctgggagagacgcgagaaaggtggagagcgcctggcgcgccgtggcggacgccttggccgcagcgccgtcggcgacgatggtggcagtgtcggcggcgatagagaggccatcgggggactggaacgccgcgcggacggcgttggcagcggcgtcggcggcggagtcgagaacagcggcggtgggggagttggtgtaggaagccgtgtcgtcggcggttgccatggcgagcgacgggtgcagcaggcgtgctacggaaggaagagagcggaagaggtggatcgggagtctgataccataaaagggaatgggactcaacgagatggtgtattgatcacggagatttacatatgtagcctcatcctttccttacacaagcaaccgatttatggaaatagtatcgggtggattaggaaggagagccaatcacacaaggttgccatctatagtctaacacttcttcatccacacgagcaatgacggggagaagagtaaggggctcacctgatgtctgcactgggaggaaggaaggcggcgccgggaaagtcagtggcggccgcggatgcgtctacaagtggctgctccggcagatctgatgtgaggcggcggcggtgtctacagcgagaggaggcggcgacgcgagcggatcggtggaaggcagcggcgcaggaggatgtggtggtgggaggcgccgtgtcaagccctcaatattcagagaactagaaatggaacccggaagagatcgatacgatatgtgtgcgccgcaaggacctaaaactagggttcctagatctaa

SEQ ID NO: 13665 - DNA, 1520 bp, Oryza sativa
ttcagatacattacatgggattgaaaactcattgacttgtggtggtgtatatccatacagggccttgaagggtgtcatctgaatcgcagtatgataggtggtattgtaccacaattcagcaagtggtaaccaagaataccagtttctaggctcttggaatgtcatgttcctcagataggactccaaacactgattaactctctctgtttgtccatcggtctgtggatggtatgcagtgctaaaccgcaaatgcaccccttttgccttaaaaatttcctggtaaaggttgcttgtaaaaattctgtccctatcagtgattatagccgtcggcatgccatgcaatttgtgtatgttattcatgaacacttccaccacttgctcaacagtatatgggtgagatagagctaagaaatgagcatacttagtcaatctatctaccacaaccagaattacatccttccctcttgatatcggaagcctttctatgaaatccattgtaatatgggaccatgccatgtcaggaattgctaaaggatctagtaaaccaggcacatgtatgtgttccccctttgtaacctggcatatgggacattcccacaccacttgctcaacagtatatgggtgagatagagctaagaaatgagcatacttagtcaatctatctaccataaccagaattacatccttccctcttgataccggaagcccttctatgaaatccattgtaatatgggaccatgccatgtcaggaattgctaaaggatctagtaaaccaggcacatgtatgtgttccccctttgtaacctggcatatgggacattcccttatgaacttatctacacttctctttaacccagaccagtaaaatagtgttttgattctatgataagttgccctcattcctgagtgacccccaaaagaagaagagtggtaggccctcagcaattctcccctaatttctgtggcttctcccacataaatccttcctttatatttcaacaacccagattccagcttatattcttgatttggatcaaccattgtcccaattatactgagtagtttatgtgcctacacatcccccacataacttctcttaatgtcttccacccaatctggaactacagtaataatagcttgacatggtatttgttctgcttcctgttgtttaggcaacctggacagtgcatcagccacaatgttttctctgccaggtttgtactcaatggtgtaatcatattccattagcttcagtagcaacttgtgttgtattccttccactaacctctgtttcatcataaacctccgactttgttgatcagttcggattaccaacttcccccaaggaagtaatgcctccatttcttaagtgcttccagaatggcaattgcttccttttcatagacagattggctgttagcttttggtctaaatgctttgctaaagaaggctattggcctaccagattgcattaccggccctaattcctgatccacatgcatctgcctcaatgacaaact

SEQ ID NO: 13666 - DNA, 3157 bp, Oryza sativa
  unsure (1)..(3157): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaagagcacctcgttctgataccaattgaacgcgcagagatatagcctagaggggggtgaataggctttcctgaaattttctcgacaatcgcagtggttataataacagggcccggaacctcctggtgaagaacaccggaacttctggcagtgatgagcagcccggaacttccggagttcttgagccagaaacttccgggcaacagagaaaatcgaaatttggggaagcaaaacaggtcctagccagagatgatcagccacagagttgcacaagatgtaaatcacaagataccagcagattcaaacacagaacatgcacaagagagacaaaggcgattttttcccgaagttcggatcacacggatcctactctccgttgaggtgctcaaagagccgggtctcgattaaccccttgcctcacttgtggaaagatcccagaaggagtccacagccttcaactcaacacttctaggtcattttctagaatcgagtgaccaccaagatccaactcacaatttcttctagaaaagaccacaagtgcaagttgctctacctaggagaacctctgaaaactcagcacaagaatctttactcacttacctcgtttccttgcggagatgaggaaaaccttcacaaactttcctgggacgtccacaagatctttggaagctcacgggcgacacctaaccgtctaggagaagatctccaagagtaataagcccaagtgacagcccacaagatatccaaagtgctcaaacaaacctaatcttcaagccatctccaaaacactccaacactctaatctaatctctcaatctcacaagataggctctagatttgagtggaggaagcaaaggaagcttgggagtggctagaaaaccctagaacatgaaagagctgaagtggaatggccaaagggtgacctggggacaaaatccatagatataacggctaggtgacgtcatctagccgttactcacaagtttgagctggaagccagccaggaggttccgggcaaaagtgccaggaacttccgggaagcacttaggaaaattttggtgttgaaatggcgcccggaagttccggccagaacctccgggtagccctctctgtcccggggagaaaaatcatttttcaaaaatgattccaaaaatattttgactcatggatatgactaagatcactttgtataccctagaaccacacttgaaacccctcttaatagtacggtttttcctaaactcaatttcgaaagtgaaaaacctagtctaatcacctccggtgtttttcgcacttaggaacattcaaattggggggtctccttgcattcttagccatcacaacttgctttaggactaaactgctgtgaataaacttgataaacatgttagtcccctttaagcaccttgtcattaatcaccaaaacccactagggggtttaagtgcatctttagaagaagcaatcggaacccgcatcactcaaagactaagtctaaacctgcaagcaaaggttatatcaacagcacaagtcaatcctaacatactacatgtaaggcatatattcaaaggaagacaatatgtagttcaatttcagcataaagcaagttttgtttcgcaattcttttgtaaaggagttgatgcttcaactaacaaaacaaatttttaagtttcaatattaagttcatcttaattccaacataatcaatctcttgttgtcatcttttgacaacaagtcgtaatatatcaccacacacacacaactcaacacatttatcaattttaaaccagtcacatgttcacattttaaaacattgtctgtacttatgacacttcaccaaattgctcttgaccacgagcacggctaatcgattagtttaaagaacactgcagagtttgtacacctttacccacatgatgtgatagaagcccggaggctacactctagttggttaagtgccggccaagcaccccacactcaacattatgagtgcggactagaggtcacaacgaagcctttacactacttagaatctagcgttggaaatatgtctataaccgctaagtgccaggcccacgccttaaacttaacgccgtggtggcggacatgacggaaacccaccacatggcacaataccattgtattggacagacttagtcacctaaactatcacgttagggtaaaaaggaagttcctctgaatcatcgactaattccacggaattatcgactaactcatacacaccggcctaccagaatgcaagtttagtcctaaatagattactcagcttaggccactcaaaatagcacatgtggatgtacggataactttaaatgggtcacacaagttcggtccttacgacttgggcaaacacccccctattggtgtgcaactaacaccatatgcacaccacttgtcgcgcaagtataaaatcacattttacatattttagttcgcgaatacccatcatattcattttattccatcaagggttcatgtgtcaaaatcacattttaattatagatggaatgagttgtaacaccctaggtaaccacgtacctaaagtgccacaccaaaatacattcaaaaccactaactcctaaaattattagaaatttcagcagagcctcccctaaaaatacggacatccacgacaagcagttataagataactcaataacgatataatccacataatccaaaccatcctagctccatgaattccccgtgaaaataaggaccgaaactttaaatgacttttacaagtactacgcaaaacttatgctaagcagaaacataatctaaaactaaatttcaatagtgtgcaataataatgtgtagtccaagggtgctactcccgtcccatgccgatcaatatcattaggtacctaaaaaccaaattaaacataagagtgagcaaagaatactcagcaagtacaatattgaactagtaaaacatacactggtttaatgcaagaagaaaccaatatgaaacatttgatttcctttaatttaa

SEQ ID NO: 13667 - DNA, 17493 bp, Oryza sativa
ttatggaatcccaacacaatagggaccaacactttcttccataaagtacctcatatggtgccatttgaatgcttgcatggtaactattgttgtaagaaaattctacaagcggcaaatgatcctcccaactgcctttctaagaaagaatacctgatctcagcatatcctctagagtttgaatagtcgttcagattgaccatcagtctaagggtgaaaagccatattgaatttcagttatcaaatggctcttgcacagactcccagaacttagaagaaaatttaacatccctatcagaaacaatcgagcgacacacaccatgtaacctcactacgtcgcgtgtataaatcggtgctaagttactcgatgaataagtggtgcggataggaatgaaatgtgccaccttacttagacgatctacaactacccagatggcatcctttcctcgtgggttacgaggtagcccaaccatgaagtccatagcaatatcatcccaagaccatacaggatcttccattgattgtaactttccagcataactcttatgttcagccttcactcgctgacatactccacatgatgccacgtactttgccacatccactttcatcctcttccacctatagatcttcttcagatcatgatacatcttgttcttgccaggatgcacagtataaggtgttcggcgtgcttctcgcaaaatctcttccttgacttcagctttctgtggaacacataaacgcccaaggaatccaaagtgaaatctccagattttccttcccttacacgtttcttaactttttgcagcaaccgacgtgttgttgggcctctagcactcattgtggtatgacggactcaagaatgactcgtgactcggtattcgccactccggcgtagcaataggagatattcatccgttcaaaattagttatcaacaactcacagtcagaggaacgaccttacggcttagagcatctgcaaccacattcgccttacccggtgtatattgaatattgagatcgtaatctttaatcaactctagccacctcctctgccttaagttcaaatccttctaagtgaagatatatttcagactcttatgattagtgaaaatatcacaaaattctccatacaggtagtgcctccaaattttgagagcaaagacaagatcatgagtggagtaattctgctcatgcttctttaactgcttagacgcataagctataacattgccctcttgcataagaacacaaccaaggcctactcgtggagcatcggaatagacagtgaaacgcttaccaggttgggggcaaagtaagcaccagagcagttaccagcctcagcttcaattgttggaaactacgctcgcataggttcgtccactgaaacttcacatccttatgtgtgagcatcgtcataggtttagcaataattgagaaatccttcacgaagcgtcgatagtaccctaccatacccccaaaaaaaaaactcgtcacatccttaacattagtcggcctttcccatccgacaacacttaaaactttgctaggatcaactgagataccttgctgattgattacatgccctaggaaagccacttcaggaagccaaaattcacacttctttaatttagcatagaacttgttttcccgtaaagtccctagcaccatcctcaaatgacgctcgtgctgctctacatccttggagtaaatgaggatatcatcaataaacaccaccacaaaattatctagaaagctatgcaacatgcaattaatcgcctccataaaataggctagagcattggtcagcccaaaagacattactttatactcataatgcccatacctcgtggaaaatggagtcttctcaatatccccttctcgcactcgaatttggttataaccagattgcaagtcaatcttagaaaacacctttgctccctttaactgatcaaacaaatcttcaatacaaggcaatgggtacttgttcttgattgtcgcagcatttaaggcccgatagtccacacacatacgccaacttccatccttcttctcagtaaaaataactggtgcaccccatggcgacacactccgtcagattaacttcttggataatagatcatctaactgtttcttcaactcttcttggaaaggacgagctaaccggtatggggctctggagataggtcgtgtaccaggaacaagatcaatacggaactctacatcacgctcaggtggcatccctagcaattctgcgggaaaaacatcaggataatctcgcactacaggaacatcttcaatcaataaaggcttggatgccttctcggctaaggcccacaataaccctgtctttatagcaagctgtctaggaaacaaccttgccatcatgaaaagagaatgcggaggcgcgctcccttggaaaaccatatcgtcgcctgatggagcttccaaggtaatagtcttctagaaacaagagattacagtacggtatcggttcaaccaatgcatgcccaagatcacgtcaaagagcggtaatggaatcacaattagatttgccacgaattcttccccatcaatagagattgcacaacctggacatactactgaactagagattataccccctggagagctgacttggacagattgagagacctcttgactaaatagattagctcttttcgcaaacttgattgaaacaaaggaaaatgtagcaccagaatcaaacagaactagagcatcatgcgaatcaattgaaagtgtacctgtaaagacatccgggcgaccaagagaataagctgcaggcatgttgtagactccagccatagagcctgaggcctgctgctgaggtggagctaaagcagaaggatgcaccataggcggtgcaggcaactggagtggtgtacgtggagcaataaattgaggcgtggaccaatattggcctggtagtgatagtggtgggtaattatgtgtgaactgctggtgaggaagtggataagttgtcatcatctgaattgcaccatgaggactactagtggatgaacctgaacctcgagggtaactagttctcgaagaggttgttgattaggagatagacctttgccacgtgatgatagaatttggtttacgcttacataccaactctatgtgtccagccttgcaacacccacgacattccccagtaaacccacactctgcagaatggtgattctttacacacttaaagaaaattagcccttgccctggtacagggcgaattatctgagactctgcaagacgtgaagctgaataaaactgagaaacccactgcctaggtttggatgatgattgagtggcctgattttatttgtacttcttgaatggtggtcgttacgggttctcgtccccttcctgatgggctctctctgttcgttgctagtgacattgccaggacgattcttctatgcagtagtaatttggggctcaacctccatcccccgagcctcctcaactgtattgaggtatacagtaggcgggtttcttcccatcacttttgtatatcgggcattgagccctcgaaagaacttcctagccttctcatgctcatcactagccacgctaggcacaaagcataaaatattgctgaactcccgctcatactcatccacagtcttgcttccatgttggatattgtttagctcatcactcatcatgtccccaaatgattctggataatacttagctctgaactgctgaagaaaaacttccagagtaatagcaccacggtcagggttccacgcttcaacaacttcgtcccatcaaatgttcgcctgactagtcaactgaaaaggcgtgaaagcaaccttctcaggggtcattctagatccactcatgtacttctccatcttgcgcaaccagtctgcagcatcaatgggagtactagacccatcaaatgtgtctaagcgcacggatgtccatctagtgagtgtcattccccgagtagctcgagcagcatcattagatacaaacagccggtccatgtcctcatcttccatctggttcgatgatgccgcctcattatggcaacctctaccacggcctctagcatggcccctaccacgacctccacgattaggaataggggattctgcaaccgagttgttccctacctcttcatcctgattattttcaacttcttcattatggtggcccctaccgcgacctctacctccgcctctcctgcggcctcagttggctaaccgagcactcactaggcggcatagctatatcaaacaatagcatgcaaagaaacacaatcatacacacatatatgcagcagaaacataaatgctaggaatgacccatgcacccccatcctattgtgcaccagtgtgtcaagttttagatgattacatctaatccaagttttactttttattattttctatcctaagagaaatttttaattggataggaaatctagttcaaaattttatgtcgatttatatttgatgtaacccagtcacttcacatggacctaccgcctgctctgataccaactgtaacaccccaagtaaccacgtacctaaagtgccacaccaaaatacattcaaaaccactaactcccaaaattattagaaatttcagcaaagcctcccctaaaaatacggacatccacgacaagcagttataagataactcaataacgatataatccacataatccaaaccatcctagctccatgaattccccgtgaaaataaggaccgaaactttaaatgacatttacaagttctacgcaaaacttatgctaagcagaaacatagtctaaaattaaatttcaatagtgtgcagtaataatgtgtagtccaagggtgctactcccgtcccatgccgatcaatattattaggtacctaaaaaccaaattaaacacaagagtgagtaaagaatactcagcaagtacaatatttaactagtaaaacatacacaggtttaatgcaagaagaaaccaatatgaaacatttgatttcctttattttaaaacgaaggaggcaaagagttgtagttccctcccgggcaggtgtgaatatcctcttagcattaccggtaagccgagcaagcgtgatcagcgcttctcaaggatcatgaataaaaatccaaattgcactcccatgactacgcatggtacttgtataatgtaaacaaaaaacttccggaagaatgaaacatgaataacgtcgttaacttgaacatgaagtgaaatatgaatatgtagcataataccaaaaccacacaattaataataggaagcttcgaataataattgggtaaatgaaaccaacaaagcaacacagtttatccatcactcaagcccatcttgtacttgccttaacttcttcgataatccaactcaactcctccaagttggaaccctccacacctgtggagaaaaactacgcataaaccactatatccaactaatgattgttacaagggacatttagtaaaatcgaaacctagaatatataattttttaccgatttatattaaataacctatagctgttcccttactgttttatgcgtaactcacaaaccgtctaatgaaatctaagaaataatataacttcggatatctgtacaaaattgtctacaactttcatgttgggcgaaaattccgattatgcctctgcaaatcccagattaaggaaaacaaattgctgtcctgatttccggacccagtcagcagtactgtttctgttgtttctcccaaaccgtttatcggaattgagtgaaaccagcgccgtttgaaagatatcgacgatgactacaaactttatttaggtcaactaacctgaatcccgacggtttattactagatttaaaaatacggtttcagcctataatcaataacctcaaaaattgcacaaagggctatcgaataaatttctatttgaatcttatacttctaaggggtaaccaaaagtaccgttgcagcgtggatactagaatttgagaacaaacccgcaagccgcgaaatcaccgaaatctccaaaattccttcttcctcctattatcctcctccctggccacgcagcagcagcctgcaggctgcagcagcgatcagcggcagcagcaatcgcatgcatccgcagcagcagcaggagcaagcaatcgcatgaatcagcagccagcaaccaaataaggagacgacagcagcacaaagatcggcggcaggagctcaccaagaacgagccgagcaggaggaatcaagtggccctgatggacgacgacggccgaagcagcggcggcggcgcagaggcgacgtgggcaaccagaacgaccgcggcgacggcaagggcgcaggacggcatgagcggcggcggctagggttttgctggcgatcccttttttcttttttttttgttatataaagagacaataggagatctaacggcccatatcgattcgatccccgggacttcgttcggactccgattactataaatttatagtctattttgcacaactcggcgagctctacgcatccacgattcttgatcgcctattcgaataacggtttaaaagttgaacttttacgtgtttactaattcgaaattcggggcattacattcttccccccttcaatcgaattcgccctcgaattcatccaaccatactctagaacatggggtattacattcctccctccttcaatcgaattcaccctcgaatttgtccaattatacctcgaataactacagaaaggaactcataggtaggacttgtataactcacttggtgtgaacaactccgggtacttctccctcatttgtgactcaagttcctaggttacttctcgctctgtctggtgcgttcagagaatcttgacgtacttgatagttctatgcctcagttccctctaagattcctccaatattcgtacagggcgggactcaaatgtcaaatcttgctcaatggccaccggctctacgataatacgatgatcagggtctctcaaatttttctcaacatggaaatatgaaatacatcgtgtacacctttcatggactctggtaactagatgtgataggctaggattccaactctttccactatcgagaatggaacaatatacctagggctgagtttacctttcgttccaaatctcacaacgcctttggtaggagaaacctttagaagtacttgatcgcccactttaaactccaattcccgtcttctgacatcggcgtcgctcttttgcctactttgagctaccagcatgtgttgtcatagttctgctatccgttctgtgtcaaacatcaaggatcacaattatgcaaggtagggaatgcagcaaataggtcataactaccttaacccagtttcaaataccgatatagtctaagttcacatgcaagtttgcaaacaaacatttttcattcctcaaatcatgggattcgatgtgttcaaaggatgggaggagaaaaacttgccttgatcagagaaatgttagcacctaatccactccttcaccgaatatgcaattatctaaataaaggacacgttatgcaattaaacaccgaaagagctgaaaatccaaaatgctctaaaatgcatgatttatacacagtgattaggtactggtctaaaatgaatttaggtgaaagaatttctattttatcttattccatttgggagttatgaattttagaagttttatcggtttatagtagtatagtcttaggtagtgctacaaaatattattgcaaagtggtttttattagatttgactatacaggggcatagagatgtgttttgtaagactatcgcatttggtttcacaatttttggagttgtaatgattttcttatagattttacaagttacaacttattctaggcatatagtgttctatatgtgcatgactcttaagtcgtaggttcagaacatgctacatcatgtttaagttgaaaaaataagtaatttggttaactaaaatatttttagttcacatgtttatagtttttactaccatggttcatactttataaactagggatgctctagtctaagactagcaataccttatattaacttagaaattacaatatgagccaagttcttctatgttttggtggatagggatggaattatggttctactggtctataagttttatttaggtttattcatagctagagtgcattataaatagttctacacctatattttgcttaaccatcactaggtaattaactcctaggtcatctatttaaagattaaagctataatttgtataaaaggtgtcatatcttattttactatgttgaagctcactattttctggttctatagaaacttggttcatttcatttaggctaaaaatgaattttctacaaattttacaatttaaagtctgctataagttagtaaatccttacatttatttagaggcttttactacacagtaaatataaaattttatttcataacctgggaatacacattttggtgattctacagaacttaagtttactcaaattgaagctaagttgaattttatatgaatttctaaactttaactcatttataactagtcattttaaagataatagtttgaggcatttgatgcaaagtaagtaattacttttatttcacttaatcagagagagagtgcatgatgatgaatctgtagaatttgagtttgtatcaaaataagttaaattgaattttctatgcattttataagtttgtatatgctttatgtatgacctatcttagataaattttagagacaatatttgtacagtgagtgtcaagttttctattcctggaataaagttcataactttttgaatctttagaaactggaatcacctcaaaataagctatatttgatttcatatggattttacaagtttgtgcatttttctgctaaacatatatttgtttgtgcatttccttagttattttccagactttaaaagatggggtccacatgtcattggctgtaaatatgcagagaggcccctagagttctcaaaaatagaacccgcagtccttatacatgtatactatcaaattcattaagaactagtagccatgtagtcacgctttgcacgactttagatgcctgtcttgaaatcatatatatgtatatatgtatgtatacgtatgtatgtatatgtatctatgtatgtatgtatgtatgcatgcatcgttaatatgataactaggaaggtagcccgcgcatatgcgcgggcatgtgcgtaaaattttattacgaatgtccttgtgtggatggttttctatcaaaaatattctttcactttatcataaactaaaattgaacttacttaaagtgctttgaacgttggttacttacaatatataatattatgataaatccactttataaagcatctttgaaatgctttgatcgctgtaagtcgggatgaaaatataagtgggttgatcctacaacctggcatggggtaaaggcattatttctaaattatctcgctccaattaagtaagaaaaattaaaatagctgccttagtattttcttagcaaattagtactaaactggagcgtcatgtaataattacatgtttctagattgttctatgctatatgtcacaaattcatgatgttcctgtagcaagttttaccaaaaaaaaaggatatggtcttttaattcctatctttaggcttatatattgctgaggctacatcacgattgttttactcttaagattcctcggtgcaaccaacgtgctcaggacaataagtatgttgttcaactggccacgtgacttcgtagatcatatatataatttagatgctatgatcatcttaagattatttatatatctcctaaaatgataatttattgataaaagcatcaataccaaaatgtatgggtaatagctcctatatacaagctgaaaaaaagttgatagaaagacgttagatgtctaacgggatatataagtaatgggtctaccagttttataaaaaaaataagctgggacattttgatttttagtgaacaattttagtattttcttttatttagggtaaaatttgctataggacattaaaaaaggtgtaatcggccggaggacaccgcaagaacgcgtatctgttgtgggacacaaaaaaactggtaattagttattagaggcccgtgacattaatttataatatccaaaggaaatgcagagagaaagaataacaaaagtatgacttttccccttcctaccaagtctggctcacatacaccttcgacgctgcaaccgcactagccgccgatgaggtggctctctagagggggggggggtcaaggagggcctgtgcgcctgggcctttggctccatgtcattcccgcactcgtcgcgctgcagcgtgagggccatgccagcactgatgctctgccacacactgcgcttgggatgagcacaacgtggaccatctccagattcctaacgaggagggcgccgcagagcacaggctattgttgtcggtctcacagccatgccatgccacgctgccatacctccaccgcccatgtcatgactaccacggcgtcagagcgatatgcgagccacacatgacaggaagaggcaaaatcatactttcgcgattgtttctctccccttttcctttggatacaacaaaataatgccacgggtatccagcagctcatttaccagtttttttgcggtgtccatagcagatatacgttcttgcagtgtctcttagctaattatactttttttggatgccctgtagcaaattttatctttattgagtagaggctgggtccataatgttatttttttgttagcagttaaatatagtcaatatggacattaagttattgttttctcttaaagaataatagctggttagacctaaaaggtggagattcgtttgtggtcttttctttgcccataaaaataattttaattttaattatcatagagatattaaaaacaaagaaatgtaattccacacaccgcatgggaacggggatggaggaagggttgtgatacttattttttttaagaaaaaaaattgattgatccgacgacctaaaataatgtgtcgatgtttaagtaaaaaaccgttggttggatgttatttttttctcagatttattaggtttttttctaatttaagtgggataaatagcaacttagcaaaacatccatagggatggagaggaatggaagatggtttgggatgtttttttattaaataattagatacaataacgatgtaaaataatgtgtgaattgatttaagtggaaaccaatggatggattaataagatgtttataagatgtttaatggactttaagaatgtcatacaatgatttagaaatatttataagatgtttaatggactttaacacctatttttgagattattttctataaagataattttaatttaattgtgatagggagcctacaaattgatcactctatgcgtggtgcactgtacggggatgtgggatgttttggttttctagtatagatctaacgatctagaataatagtccaccaatttaaatgaaaattgacggttagatttctcaattttattagggtgctacatgatgacttgagagtatttatatggtgccatgtgatggtttgggagtgtttgtagatgtttaatggacttttagtatataatagatagatagtactacgtacatatggtttttctctttatcttatatggtagaaaattatagtttatatttttctcccaattatactatgtactttttttttgactttatcacacaggcattctttttcttccgacgaacggaacctaagcttccaaatcatatgtactgtagttacaatttttcgtttatgccgacgatacatattttcccttttataaggggaggtattaatatatacacctaatgattctaaagtaactggtccaccaatttaaataaaaattaactatagatatagatctaatctaatggtctaaaataacatatccactaattaaataaaaattgacggtgagatcgtttatagaaagtttaatgaatgatatttacgtaaatttatagaatagtatgttttatctttaaataatagaattaaagatcatcaatttttttcaatgtgtaggtttagtttttctgtacgtctgtacttgattgtttttttcagttgtacgcacgtttggagtacttgcaatcatagttctcccgcatatacatatagagattaatgaattagtttcttaaaataaaatatatctaatctaatgatttaaaatattgggtccaccgatttaagtgaaaatcgacggtcggattcgacagtgctacgtggcggcttagaagcgtttgtagaagcgtttataggaagtttaatggacttttagtatataatacatagataagtcaaagccaagtgaaaaaaaccctagctttttatataaccattttgaattaatttatttgcataatattgattggttggattttggatggaggtatgttttactccatgattttatacaattttcttcacatattgctaatttaattacattttcccaaaatagaatttattttacaatctttttgttcttataaatttggccttttggctcttaagattttagaacttaattaggtgaattattttcgtcttgtaaatgaattaaacttgtagtagaacttaattaaaatgaactattttgaatgtatgaaaacaataaccttgaatcatgtaaatttaaatgtctttgagaaatgtatatggacgtctagtttagatatttatatatttccagtgctaattgggtttaagatgctaatttataatattacacctaatctgaaatatactactaaccacatagataacattgtaatatttttaggactgttttacagtttaatacttacttagaggtttaatgcaaatcaaccaggtggggcccacaaggttaggcatgccgcatgcccactgacaaaggggtttcctttctattggtcttggctatgtctcccccctctctctatgttaattttgtgatagtctctagaaggttcttgaagacttgggctagcctcttttaccattctacatccaacgtcagatattggaccccttttacatcctacggctcatatttaattgatgatgtggctaaatgaggtttcaagaaaggttattcctttcgttactttagattcttgagttttgcagcttttactaatagatccttggtcccacatgtcattctaacatattttataatttagaccttgcaagttttaagctctctctaagcggaatcttcagcgcctaatgacgtggggtctgctggtcagtgtctcagcaagagagcaagggcagcagcagagcagcggcgactcggcgagtttctcgccggcgccggcgatgaacggcagccgttctcgcggtgcgaccaaaagagaaaacattcctaagcttcttgcgcatctattcgtagtggtttcatggtcggaggtgaccggaatcgatggtgacagtggtgtgagcggcggtggttctcggggtgacggtgcatgtgtgcatggaagtcgatcccgaacgaaagggatgcatgcatgtggtcttctagccttcaggatgctcaccgtgggtcaagctaaggttgtcgaggtcttggcagaagcgatgacttgcggaatggctcggcgacggcgctcctcctcgggtgaacgatgacggctcgaacgggacgacgagctgctacaagcaggcatgcacaagggtggtgaggtcaaggagatggtgtctgcgcgaggaatcgaacaatggctcaccggggcagcggtaatcgatgatgacggcggaggcgattctagatcggcgccggggaagaaaagatgtgttctccagagccggccggcgctcgttctctccctctcagtttttcttggtcggctgagggtgagggacagaggaagggcgagctggagaggctgccaggtggggccaagtcgatggaagctaggcttgggagagaggtatgggtaggagtttgggtagacttagtttttggacaattttcggaattatttcttctccctaactttgcaactcaatatcttaatatgtggaccggaagaattagtgcagattttactggtggtagatgtttatatctagattccattttctttagttggactaaaaaataatgggtagactgctcacataaattagataaaaatgggctatttaaaagttagatcaaatttttaagagacctaaacagaagataaaaattctagaaaaattatatttattcatgataaataatctagtatttgaatagattatttcccatgttcacttatgagcagttaaatgtacttttgaatgaagtatggcgttagccgattaaaatttaatttgatttcttttagttgtctgtttttactgattaatttgaggtgtcaaacttagttattaatttataccaatattacagtgaattacttatgctaaacatagtttacataaatttttccatgattttatctagattattttagagaattagaatgacctttctttgtatatgtgttcccactttgtaattgcacctaatattattacagggattacattaaatttcttttgggctgagaagatgatatttgagtttaatattaagtccatattttatcgcccaagatccactataagtctgtttagtaaattttaacctctttaggttatgctcatggaaccttttatgaaatacgagaccaaaatccaaatgcataagggactcgagcctaggcatgcattatgcacatgtctgctcatatgctcggtgacatttctagtctaatgttgggaatgaaaaggttttattttgttatcaaattttaatcatgcaatggtttaagttggtcatcacctaagttaaaacggaaatttttgggtcttaaaattggagaagttaacctctaattattttgacaagaatattttttgagtcctagaatttcgggtatgttacattaggcatcctcttgccaaaaccacacgagcaattggtgcaagcacgctctagattctcatcctcttgtggcagcgtcctagtttctacaagttggccatattggagggcatagggggagaggtgttccatcttctctctcaccctctctccctaaatctggaagacgtggatagagttgggctttgtgttgattgtaagggcgttttttaggcgatctcgtctatgttccattgttggcctagcggcggccggtccaattctagccttctcctggaccagtgtgttggcgctgtcggtgtgtgggtggtggtatatttttttccttttttcctggttacgaccctccagggttgtaatcttatagttttttcatgctctatcaatagaagttcgcaccgtcttgtgcgagtcgttcaaaaagaaacaaatctatgtgaaataaagaaatcaagcagatattctattagtaaatttctatccatgcatgcttggcgtttattttctatcaaagtagactaaaaagagaatatgttgttcttacatggccccatcctcctctttttgcaacaaagcctcatactaatccagtgcgcatggtgcctctgaagattaccattaatattggctacagttttgtgttgtcgaaaaagatgttattgtgacttagccgtataactcaaaattgagcgcttatcaaaaccaaaatttgattctttatttaggccatgtttagttcccactcaaaaactttccgccctgtcacatcgaatgtttggacacatgcatggagtactaaatatagacaaatagaaaaactaattacatagattgacaatatgtagttctacagtaaacatttgctaatgatagattaattaggcttaataaattaatctcgcagtttacaggcggaatctgtaatttgttttgttattaatctacgtttaatacttcaaatgtgtatccttatatccgatatgacacgtcaaaacttttcacccctgcatctaaacacaaccttagctttttgtttaccccatatagctactattagaaaaacaatttattgccacgaaaaaaatcgtagcattaatgctaaaattgtggcaataggtacatgttgtcacaatcttaaaatcgttgctagccgtggtaataaatagcatggtaataggttgttgtaacgacttttatttagttgtaacaaattttgatattgccataaaatggatgtggcaaaaaaaatatattgcaacacttcacatcgttaaaataaataactattgccaccactccatgtgtggcattagttctatgtaccaaattaaatgttttaatattaatttatcatcttaactattttttttatatcttgtcatggttaggatttgaacccaagatctttccctcacgcgcgctctttattaccaactcacctaggcatcattttttttaaaaaaaatgcatatcatttcatttgagcgtacctatctgagatttaaatcgtgaatttgagtatttaaaagatttcaaatgaaaaagttaagttgtagagctctaaatttcatacaaaatttatcctaatccgtgtccatataaaaagaataagtcaaattatgaaatcataaattttttattgcaacgaatttattgatcgcggcaatagaaaatagtgaaaagtaccatgtactatgcaaattgccacataaattaaaattgtagcgatagaacatgtttttttgcaatagtaaagttttttttttgtggcgatagctcattttctattgcaacaaaaataccaaataaaacaacgattgtaaatcgttgcaacaaaatatatttgccacaagaaaaattatcattgcgatagtacaatatattgccatgaattatttttcgttgtaataaattggtggcgatagcacaattatcttgtagtttgccaacattgtagaagtactatcatatgttggaagaccaatagctatttgtatttgaattgcacgccaaataacatttagcaaaagtatgatacagaacagatgtgttgtattctttcgttataattacaaatgcaacattttgaactataagtctatactgtccttttgctaaattatcttttgttaggagttctccggtaacatttggaacctttatcttgaggggaatttttatattccatatatagcggtccattatttgtcaatcctctatatatagaatgagctttgaaccatccatactggtgtaaaagaccatcaaaatgtgtcatattggtaattgagtcctatttcccttttttttatctacaagctcactatatctcttcgtaaagaatattttagaggtttataatttaaaacctctgtgactgttgcactttggttccttacaatgcaatatagcatttggtattgttggtttacatttt

SEQ ID NO: 13668 - DNA, 746 bp, Oryza sativa
ccacaatatgagagggagaggtagaggtgggtgggtgggtgaaggtgagagtaccggtgtcggaggtcatgtgtgcagtggcacccgtatccatataccattcatttgtagccggttggggaagcgtcatggtgttgaaggagttggcgagagaggcttgatcccactgcgagggagcccccccaaaccagcccaccgactgctgaagagcgtggggcatggagggctgcgtctgtgcctgctgttgggccggctggcccagtccaccgaagccatgtgtgccaggaagaagtccataggactacggcccgtagactggctgtggagccaagccgaggggcggcccagctagagctgtaccagcaaagtgggccggcactggtcacggcccaaggacgccacggcccatggatcccggccacatatgtatagtgccggcccatggattgagtgggctaggccactgcgcaggttggcctgttgggggcttgacgctgccctgtccaggcgctgtggcgccgttgccgccgccttgcttcccgccgccatttccgccgcgacgacagcgattgtgggagttcccgccaccgttgccgccgccgccaccaccgccttggttcccggcgccgaaaccggaggtgtgtgcagaggtaggggcgccagtcttggggttggaggagcctgtgccgctcccggcggggaacgctgcagcccgagctccgggacgaggcgtctggctgagttcc

SEQ ID NO: 13669 - DNA, 5936 bp, Oryza sativa
  unsure (1)..(5936): unsure at all n locations
gtactgttgatgctgatcgagatggtcctccagagaattctacttcgaccagtactgaaacagaatgtggatcaacttcagaagttgctgctcctctgcacattcaacgacgacatccgccgaaacaaattattggtaatataagtgagcggactacaaggtctaaggtaacggctcataatgtttgtgcaaattctgcatttgttgcttcttttgaacccaaagatgtgtctcatgcattaactgatgaatcgtggattaacgccatgcatgaagaacttgaaaattttgagagaaacaaagtttgaactttagttgaaccaccttctggacataatgttattggaaccaagtgggttttcaaaaataaacaaaatgaggatggtttgattgtgagaaataaagctagacttgttaatcagggttttactcaagttgagggtttggattttgatgaaacttttgctcctgttgctagaattgaggcaattagacttttgttggcttttgctgcttcaaaaggttttaaattgtatcaaatggatgtgaaaagtgcttttctaaatggttttatacaggaggaagtttatgtcaaacaaccaccaggttttgaaaatcctgattttcccaaccatgtttttaaattgtctaaagctttgtatggtttgaaacaaactcctagggcatggtatgataggcttaagaactttttgcttgcgaaactttttacaatgggaaacgttgacaaaacactttttgttcttaagcatggtgataatcaacttttcgttcagatttatgtggatgatatcatctttggttgttcgactcacgctgtggttgtagattttgctgagactatgcgcagggaatttgagatgagcatgatgggtgagttatcgtactttttgggattgcaaattaagcaaacacctcaaggtacttttgtgcatcaaacgaagtatacgaaggatcttttgagacggttcaatatggagaattgcaagccaatttcaacaccaattggttctacagctgtgttggatccagatgaagatggtgaagctgttgatcaaaaagtgtatagaagtatgattggatctttattgtatctaactgcttctaggccagacatacaatttgctgtgtgtttgtgtgcacgctttcaagcttctcctcgtgcttcacatcgtcaagcggtcaagcgaataatgaggtatttgaatcatacacttgagtttggaatttagtattttacttcatcttctatatgcttaagtggatattccgatgctgattttggaggttgtagaattgataggaaaagtattagtggaacatgtcattttcttggtacatcattgattgcatggtcttctaggaaacagtctagtgttgctcaatcaactgctgaatctgaatatgttgctgctgctagttgttgttcacagattctttggcttttatctactttgaaagattatggtcttacttttgagaaagtacctctcttttatgataatactagtgctatcaatattgctaagaatcctgttcaacactcacgcacaaagcacattgatattcgttttcactttttgagggatcatgttgagaaaggagatgttgagttacagtttttggacacaaagttgcaaattgctgatattttcactaaacctttggattctaatcgctttgcttttcttcgtggtgaattgggtgtaattcatccttttgacatggtttgagggggagtttgtacctcatggttttatcaagcaataatatgacaatgaaaaaattgagaaaagagagctttgtttatgcatatggtattttcttatgcatgctagcaatactttgaaggtttatttgtctctagcatagcttgtatgtattctagtcttttcatgagatttagattttgcttttaagggagatgatgtatgacacttaaattctatacttgaattaagcaaatatgcaatgttgatgctagcatatggtttgatttataaatgctctatatatatgctttattgacttgttattcctcaaatagctttaattgttcattgtaaaaaagagaataaaaatatgaaaaaatgaataccgaatccttggaaacagtcttgacgacaaggacgtattcgatgtgagcaaaataatgggtgccgaatccctggaaacagtcttgacgatagggacatacccggaataaaaaagaaaaaatatgagcaaaatggctcaagaaaagaaaaagttaaaaaattctcttggttattttgtgctagaggttatttgagaaagagtgataaatgcaataggtatatgtgtttcgtgtttattcttcaacgtatgtgcttgttaagatgttgcattataaatcgtatgaaatcacgaattttgattgttgattcaagcttaattgtaaaatctttggttcatggttatactttaattcatgcttgttttgttatagatgggtctatcttctttttattacaacacatgacttgatatgctatatgtatgctaagctcttgaacattaatgaacataattcctatgcttgatgaaatcattgtccaaagggggagaagtaatttgaaaatttttttggattttttgaagcaaagtgaatttttgaagagttgttgagaagagcatgttgttggttcaattgggaatttctttcttttaaaaaagagggagaagttttcttttggatttttgagcacgatgtgtacatttgtacgaagtgtgctttttaccaccaaatatcaaaacatttttatgagtttgccaatgtgttcatcaagggggagattgtaaaatcaaaggtgttttttattattattctgtgatgaataattgggcattggagattattggttttgttatttggaatttattctcgaagtggttttggagattattggatttcacnnnnnnnnnnnnnnnnnnnnnnnnnttatgtggaccggtcagaccgggctctggtagccggtcagaccggcgtgtaattcgcggtcagaccggcgcagcccgcggtctgaccggccgatactgtgtcggtttcggtttcgggctgtttatttggatatccgagtttattccatgattatgacttctatatggatactatacgtatgtaatactattgtttgctgctaatgagtcaagttggagatagcttggtctcggaatatagtttctttgtttgttctatgtgtaggtgactcgatgtctcgggagagtatttgcggtgatggaccgggagtcggcttggggataagacgacgtccgtggtggtcagagatcatgcgggatacttaggctagagttgatgcacgtggttgatggagattccatatggtatatgatggagttattgtgtgcgtatgggatgcggagtcgaatttggaaggagtccaaatttggtacgtttggttatgtaaagtttctttcttgtactagtgggtttcctaaggtgtttaggactcctagtatgagtttggttcgtggctttagactgcctacctcatgtataaatagagggggagcgtgaggcttcccggcatcgctttgtatcgcgttagagagcaattgagttgagttttgagttagggtttcgagtttagtcgaaatttttgtaaggagtgctattggtgcactttgtaaacacagagagaagtaattaagtcatcatccactttaagatttcttcgatttgtgtttcaccgggtttcggcggtctaaccggcgatctaccggcggtcagaccggcggcaagtggcggtcagaccggcggtgtacaggcggtcagaccggcggaaaccaggcggtcagaccggcagggcaactttggtcagactgcgatctatcgatttcgagggtaatttttatttccgctaaaagttttcggtttttgggtataccaaccattcacccctcctctggttggcttagttcttgtgtttcgattgcaaacgtctccctgtaaccgaagatcacgccctgcagcagagctagcgtgtacaggacgtccagtgccgattgcttcagattgtcgccgccgtagtcgcgctcgattagccgccacagagaaatcccggcggagatgtacagtccatagaggtagatggcgaacagaagccacattacgatgctcaacatcgctgcttggatcttcatcaccgtgatgtatgcactggggcctgcactgatctctgccctacttctgcagatggcaaggtaggagaacccagtgttgctcaactgcttgttcatgatgacattgaacaccctgttggatggtacggtttgagcagcatacgtaacacatggtttgaaatttcggtaatatcggccctcccgtcaagcacaaatctacccaaagtttttaattttttttatcaaatatttgtaaaaatttgttaaaattcagtcaaaatatgttaaaactttaaataatttcggccataaaaatccggaaatcacgaaatttcaaattttcggcaaccacccaaccgaaattgtaaaccctgatgtaacaagtggaattaaggtagaacgcagacgggttcactattttcaaatgcataatttctgggtactgaactttaggattttctgaggtaactaaaaaaattctaattcaaataacttgtgcctaaacttaatttctcgtaagagcttaaaatttttgcgagaagaacatcctacaggaacatccggtaaacccgaaatcttggaaaattcagtccaaaactgtgaaccctaacaagaacgtcatgttcaaaaatcgatctacttatgtactagttactctctccgtcccataatgtaagggattttgattttttgtttacaccgtttgaccactcgttttattcaaaaaaatttgggcaaatacaaaaaacgataagttgtgcttaaagtactttggataataaagtaagtcaaaaaaaataaataataattccaaaattttttgaataagacaagtggtcaaatggtgcaagcaaaaactcaaaatcccttatattatgggacagagggagtagacaagaacaccatgatttaaaccatgtgtttcgacagatgtgccgtttaactagtggctagtttgaagtctaaataggtaatgggaaaagaaaaatcagtcgtgaggagacttaaccaaatacctgaaagagggtgattaccgtgagacaccaaaagtccttcttccccagcatggagacgaaaccgccgaggaggacgaccgtggtccatgtaaccacgaggaaaccaagcccattcacggctattgtcatgtaccccataaggacgccatagctgttgatgtactgcacttccaaccagtcggtgtcgctgggatccagggatgggagacgccggcgagtgtttcgccgtttacggtgctcggctcgcgcgccacggtcatgcagccccagctctaccccgtcggccattcttgtcaagaccaagagaatcaagatgatcgcagggggcaccccactccgagaaatcagccagccatttgatcggacagtccatgggtgtagttgaataacatggaagcgaagtaaacgatatgttaatttatgccaagaacgaggttggatcagggagggcgagcttgttatttaattccagcagagaagatgtgcaaatatcaaaggtcaaggtgcgatgcgcgggcatcgtatatatttttatataaactaggatggtagctcgtacaaatgtgcatgcatgtatctcgtttatatgggtggagaattaaccggattatttatatcttgattcaaaagtacgatttctcttaaattatgcccatcaacattgcttggatattttttccaagctatttgataaactatgaaggtagcctacatattcacgcgagcacgtattgtagcctg

SEQ ID NO: 13670 - DNA, 3603 bp, Oryza sativa
tatgtattcatataatacatatgtccctcggcaaaaaaaaaaaataccatgtacaatgagttaggggcaaataggtctttttacagctctaacagatgcccaactaacagcttctggactgtgatggcacgcagtagacgttcgggaaaacacgatggcatattattcaacttgacaaagtcagtggtatattgtagctagaagtagtgaaaactcaatggcactgagtggattctctctttctttaaatataagtaaaacaacaatttaaataaactaaaactctaatataacttaagaattataatcatttatctttgtaattattgatcgttattattaattagttaaaaatcaagagacgaagaaattaagtgagagaggggaggaacagagttcacggggatatagtacgcgtgcataactgtaatattattttcatggataatactgttttagttgctattattttgttaacttaaaagtttgattaaaatctatcttttctttctcatcctttcctacagtatattaaatatagtagataccaaaattaagaacactacaaatctaataaatctaataatgttattttgacttattgtaacatcagaataggttcattttaattactttgaagttatataggatgataaaatatatatcattattttttgataattttgtaattgtttgaatggcacgccaaaatcagaaaatacgggcccaaagcaacatattcattaagaaatactcatgcttggttgtatgcatatacttgacggtcacatcatacatgcttggcgaaatttcagaagaaacatatcgtccttcatcagatataagtattcatgctcctttctgtttttgaatcttatagaccaagttgccggtactacatagtgaaaatcagttttctctaagttggtcacttttatttcagattcagctcatacacgtgttagtgcgtgcattgcctactattcagctttccatcagacaaccattcagtagatcatggtcaaacaattgctctgaccatctactctggcaaggtattctgtacataaagttcttcattagaaatctaaagatcatattgtaattaaacgatgatcatatattgtaatccaacaaaccaaaagtatattgttggaaaattaaccattcctgcttggtgcagtagaaactatagagcacactataaaactgtatttagaaaaattgttatctgttttatcatcatatattcccgcagcaacacgcagggtattattagtagtgctaacggggagccgcaaatggatagcacggagaacgtcacagattctgagactgttgatcacccttccttggtaaaccttatgttgaatgatccaggtgtgcggatttgaaatgatcaaaaatttgaggatgatcctgcgatttggaccagaggttcaccggtccaaaattttgggaccggtggatccttctatgtgtatccaggaactaaatttttaggactttcagaaattccgatatgaaagttatgaaatttctctcggcccaactcctaatgcctcccatgtctaagtgcgtgatgttcctggatacacatagcgatatgcaatttgcagtatatgtcatctgtgcagacaaatggattgcagtatagaagatcttactcttgattgtccttttctagatggtgaacactagatattcagtgtaacagctatcacatgagaagtgtatgcacatgtgtttttacgattcttaaacagttaatgtgagattacagacagagattagtcttggaaaagaaaatggttatatttttttcctcgtataattacagaccatgaataagtagtgttcgtcaagttgtgtgaaacagattttctaatatctatgtccggattatgtcaaaacggttggactaatacgggccaatgtatttcttttggtcaatttgaatagacatcaccgattaataaaaaaaaccagaaaaaagagggaaatcaaacagagcaagatcgagccagaggcctagctatggaaatacaaattgcctccaccgaatggccatgtctgtacttggactgaatgaaaactagccgtactcagcaatgtcatgtgtctactgaacaaagtggcgcagaagattttggccgtgtttagattcaaaattttttgttcaaacttccaacttttccgtcacatcaaatgtttagacacaggcatgaagcattaaatgtggatgaaaaaaccaattacacagtttgcatgtaaattgcaagccgaatcttttgagcctaattacgtcatgatttagcaatatgatgctacagtaaacatttgttaatgacgaattaattaggcttaatagattcgtctcgcagtttacaggcagaatctgtaatttgttttggtattagtctacgtttaatacttcaaatatgtgtctatatactttaaaaaatttttggcacacatattaaacacaagtacacaacctttattgttcaactatgttggaacagggagcagtgttgctaccttgacagagattatctgcgaaatgctggctcatcactgtcaacatttgggaggataggatggggcagggtggatggcttattatgattttgagcatatcccgtgaatttgacaggtcgtcaattcctacgagtacgcttagttgaaccgaaatttcggcgattttggcacctcctgttcgaaatttcagtccttgtcactgctctattccggatgcctgccatgtctaagttcctttgcaaagttgtgttgtatattatctgtgcacaaaatcgacctaagaagataagatgtatgagactcatcatgcttgcagctatttaaattcaagctggagtcgatgcctttctttagagggcctcagtatcctatgggcttggcactccgtggaataaatttaggcctcggtcggcaccaacagcttgtttggcaactgagggaaggggattggaaatttacacgaggaaattaatggtgagattaagatgagaatttgatttttcatctcagtctcttgtttggtagaggtggtgaaaattgatagggagtttagttggagattagatcattaatgaaaacggatggctgagatttgtttaggcgaagtaaaggaggaattccctcccaattacctgcccctacccaggtattgaaaaggagggagttcattcctcaattccccatcccatcccaccaaaattcccatttcccccaaccaaacaaaacagttaatagcctcatctctctaaactcctaatcctcctagaaactccctccaaccatacagaccgcaagggataattataaccaggtaaaacggtcaccggaggggattgggttgatcccctcccaccacccaatccctttcaccacgggattatcatttggtttgtttggacaggtaagggattggtgggattgatttatttggactaaggtttaaagatttcattacataaattttaaattgtcacgaacaaaattgcagaaaattcaaaacaccacccaaaaaaatcaaaaaattcaaaaaaaatcaaaacaaaaatacaaaaatgggaaaat

SEQ ID NO: 13671 - DNA, 4800 bp, Oryza sativa
acctctattacagtaataagtagcagggattaaattacataaattgaagctaaatcattaatatctacttgtaaagttcctcaattaacagcacatttctcaggtacatcacaataacattcttggtgcagcaaacagaagtccctgaaaaaacacatgagacggattatcactggaaagaaaactgcacaattcaaaggctgaaaaatagctgatcaatatgctcctatatggtcaacagccacatatatttccaataacgagaaagttttaggttatttagttccagaggttcaataagttccatgaataatttaggtttcactgtgaacatttccaattacctgcaaaagggaaagaatgcttatcttcatatgataatttgattacatcatcctcactatacagatcagtctatggcatacacatgttgatgtattatgtacaaaaaaaagaagaatattgtgtcacaacaacaacatataatagctactcctataaccaatagttgctaaaccacatgtttaagccccattgaaatagcttaactagcagcagtcaacagaaactacaggttaataaaaactacgtccaatagacaattcatatatccaaaacatcaactgcatgacaggcacctaaaaagtgtctaattacgggaataagatcaactgcatgatttctctatttatacacttctaaagatctggtgttggtctatgaattaatcaaaaaaagcacattgaaaggaaaaatggcacaatctacagttgtactcttcatcaaagtaaaaaaattcagtttcagagaactgaaactcccaaacctgcacatgatctgagactgaattttctagctaaatttcagcaacctgaaccataatttcagaatttcagaattcagaattgagctcaatttcagcaggtccccaacatatacactgcactaatgcgtgggtaagaaacacaagcacattcagagtgtatagatggaattgatgttcctactcttgtttgtttttaaaaccaaaagaattgcatattcttgggaagctgttaagaggaagatgtgatatttctctgatccatttccacagtgaaggacgcatttcacaaggggcatcctaaattcctaaaaatgatggcatcctttacagaattacagggtcatgggaatcaataatcatcttcagctttcgtggaacacgtgttgtaataacaaatccaatggccaaagcagttgatagacactcaaactaccagaattaaagggaaaaaaacaaaacagaaacaaaatcagaacaataccagattctatgctaactgactagaatatacttgctgtccaatttcagctaatgactctgaacaaacacatgtcattctctattacaaatgcatatatgccattctctagaactaatgcagagcaaatctgagcacccagggacagtagtaaaacttagtactatataaatctgagcactgtttaacagaacattatcgaaactcaagaacaattaatttaggcaggacataaacaatagaaactttaggcagaacatacctcacaaaagcacccaatctcatgtatatcaaccctgtcaatacaagaaaaccaggtaagacaacatgctctgaaaattcgtgtgagctacttactacactgcagggcttgcattgaaagctgaagatagcaatgttagctagcttttaagctaattaattagccaaaactagcctaattaacagtgtgaaattagaagggtaggtttgtttagtgttttgccgggtataaaggcttcaggttgggttaaattatgctgcttgttggggggattaacacttaacagccgcaactttagaccttagacacccacaaatgtatcttgaagctaattgtctgtaatgctgataattgacaagcatgcatgtgccatcttgaatcgtcgatggagttcagaagaaggatggtgtttgacatacctagctgatgtagcagaagatgctcctcgaggaggttcttgttgggaaagacccggcgtccggacagaggtgactgaacagagaagtaattgccaacggatcttgcatggagggatggcagcagaacataagcttcttgaaagagaatgggactcaacgcgatggtgtattgatcacggagatttacatatgtaggcctcatccttcccttacccaagcaaccgatttatggaaatagtatcgggtggattaggaaggagagccaatcacacaaggttgccatgtatagtttaacacccccccccccccccgcagtcgcaacgtcgctagcgaacattgagactggaacgaaactcggtgaagaccggagtgggaagcccgttggtgaaaatgtcagcatactgggaggacgtgggcacatgaagcacacgaatggccccgacagcaaccttctcccgaacgaagtgaaagtcgatctcgacatacttcgtccgttgatgttgcaccgggttggaggagaggtagacggcactgacgttgtcgcagtagaccagggtggcccgcgacggtggagagtggagctcatggaggagctggcggagccatgtgacctcggccacagagttggccacagcgcgatactcggccttggcgctagagcgggacactgtgtgttgccgcttcgaggaccaggacacgaggttgtccccatggaagattgcgtaaccagacatggagcgccgagtgtcggggcagccggcccagtctgcatcggagtagacggtgaggtcggaggtacaagaccgctggatgtggaggcttaggtccagtgtaccccgaatgtagcggaggatcctcttgagagcggcaaggtgaggcttacgagggtcatgcatgtggaggcagacttgttgtacggcgtaggagatgtccggcctggtgaaggtcaggtactgaagtgcgccggcgagactgcgaaagtcggtgggattggacactgtaggtcccgccactgaggagagcttggcacaggtgtcgaccggcgtgttgcatggtttgcagtcagccatgccggcacgttccaggatgtcgagacagtactagcgctggttgaggaggaaacctgacgtctgcctggtgacactgatgccaagaaagtggtgcaatggcccaaggtccttcatggagaactcggactggagcgcggagctggtccactgtaggagccggtcagaggaggccgtgagaacgatgtcgtccacgtagagcagcaagtagacagtgtcggtgccgcggtgaagaatgaacaacgatgtgtcggacttggcctcggtgaagccgatggacagcaggtaggtggcgaaccggctgtaccatgctcggggagcttgcttgagcccgtacaaggacttgttgaggtagcacaccatgtcgggacgggtgggatcaacaaacccaggtggctggatgcagtacaccgtctcttggagggtgccgtgcaggaaggcattcttgacgtccagctggtggacgggccagtctcgggagacagcgaggctgaggacggtgcggaccgtggcgggcttgatgactggactgaacgtctcgtcgaagtcgacgcccgggcgctgagtgaagccgcggagcacccaacggaccttgtagcggtcgagggagccgtcagcgtgaaacttatgcttgaagatccacttgccggtgacgacgttggccttcacaggacaggggaccagatcccaagtgcggttggcgaggagagcgttgtactcctcctccattgcgctacgccaattcggatcggcgagagctgccctgtaagtcttggggatgggagacagcggagtggcatggaggttcatgcgagtgagctccttgcgaacgccggccttggctcgtatggtcatgccgtggtcgttgatcacaggtgagacaccgagctgtgatggcagagccgtgatgccggggtggcgcgcagaccgagggcgacgaggaacatgcacagaggaaggcagcgtgggagcctggggcgctgagaaggccggctccgtgctgctgtcttggcgcggggaggtcggcccaggaccagccgaggggggctggcggggcgaggcaggcctagtgaaggccgcaggggacgaggccgaccggtcagggaagtccgcgcacggcccagtggaggccagcccagtggtggagtgggtggcagccgagcccaatgatgccgtgccgtcagttccagccgacggggagaagtttggtgcaggtccctgggcagcaacagactgtagtcggcgaggggcaccaatgggggcctgcacaggagccgagaagtcctccaaaaacgagagatcagcagcacttgtaacagtgttagtcaactcggcaaatggaaacgaatgctcatcaaacacgacatgcctcgaaataataacctggttggaaacagggtcaaaacactgataccctttatggtggacggggtagcctaaaaagacacacatggtggatcggggtgcacgtttgtgaggggtggtggcggagaggttaggatagcactcgcaaccaaagacacggaggtgtgagtaggtggggtgagtaccatagagggcgaagtgtggcgtgtgatggtcgagggttttggtggggtgtcggttgatgaggtgagtggcggtgtgcagggcctcaacccaaaaggagccagggaggtgtgcctgaaagaggagggaacgcacaatgttatttagggaacggagaatgcgctcggctttaccgttttgaggggaggtgtgagggcaag

SEQ ID NO: 13672 - DNA, 2564 bp, Oryza sativa
atttctgcacggcattgcgttttctatactccattgcgtgagttattagccctgtttggaagtaaatggagttggttatgacttatgtgccctgtgaacccatatgcttgtcctgggatggaccagacggtgagaatcagttagagcaaggtgaacatagagtaggggcagtgagctggctatatttttttgcgagatttttcttttttgcgagagctggctctaattttattcaactcatttacagatctgtatagtcaatgatagtagggcctttcccacccaaaaaactaaccaataagataacatgttccgtcacttatatattaagtcaattgtccttatgcaaccaatgtcgaactattcaatatatagcttgtgtataaaatatatagtaaacggtagaaattgcggcttttatctcatccaatctatatctcgacagtagccgataaaatcaaccaataattttgacacacacagttgctgccaggctcccactcaacttccatataagtatgttacgactgaagataaccccatcaaggccaccaggcgatccgtgagagtcagatggcccaatactcgcgtaactgggccggagtggggccaagtcatgtaccgggtatatatgtttataaatacccaggggtgagttaggaacacgatatgggatgacaaacttgcacacggaactatgtcccatatactccctccgtcgcaaaaaaaaaaaaaaagacaaatcctggttttcgtgtccaacgtttgaccgtccgtcttgtataaaaaaattatgaaaaaattaaaaagataaatcacgcataaagtattaatcaatgttttatcatctaacaacaataaaaatactaattataaaaaaatttcatataagacggacagtcaaacgttggcacggaaacctagggtttgccttttttttgggacggagggagtaattcaaatcctcttcctgctcctctgttcttctctgcctccttcctcctcttacctcaggtgttcggcggaattcccatgagagaccgtaacaaagtactggggctgatatcggacagggcaggctgttgattctgattttgaccctatccagaaacttttacaaggggctgtttcctacttgcgtacatgctgaaacaaaatgtttggaaaattcagaaattcctatcgaatatttcaaaccctgttcgctgcataattttggggtccctcccatttctgtgtttctaatttttcttgattctcatatctccattgcatttcaagttggtgtaagcaaacttttcttatgtttggaacttttaactcaagaacatgcccatttgtagaggccctgatatcctttaggcttggcatttataggtgacatatacttctgttctgaaatgggaccaaacaaattttgcattaattaagatattttgtctatatgtcaagaaataaatactaatggtcccatttcagaacaatttggaaggtaaaggctagaaatcaatttggtccggaagtaaatactaagagaaattttacagtcattgaaaaggtaccataaggtatcaaaaattgtgtaaaatttggtacctcatagtatttagatactaaaagatataaaatttacaatagaaaaattagtacctcatggtaacttctaaaggaccataaaattgctcatgatgtgctatagttgcatttaaaattcactatgtactaataattgctatacatggcatcttgacattttgatgtttagtgggatgatgtgtatgcttacatgttgagttttagatttttagtgggttctaactatatagatggtataagtgacctaattattaacggatatacttattaacattgtacaaattagttagaattgaataatttaccgggtcatttgacccggtaaaactgcataggtacgcccgtgatctctaatatgttgaaatacaatcatctttgttctaagaacattggcatgacgaccgttggctctgccctcgtgtctgtcgctcattgccacctgtctcgattaatatggttctggttaagtcaagctggcaaatgttagtgccagatttgttttaaaaaacgacagtacccgttactaccagttcataaaaaaaatggttatctcgattaaagataaacaaaaacaggatgcgatagcatcaccattcatttttccattactttttgtgttggttctaaataaacctacaatgttgaggcaggggcgaagctaggtagtactaggggttcctaggcacccggttccaaaagaaaaattagtgattaataccccttagtgaccatatgtgcaccccacgctagaaaatcagaccacacaagcacgaatggcccactataaccacgacaggagcccaatacagcccagcttgcattaccgtgaggactaattaatttcattcattggaacagtagctcctaattgtgagtgataggttttcaattacgtgataatagctctcgtgttttttttagatcaaatggaaggtttggaatgaaattatatgagagaatccattaca

SEQ ID NO: 13673 - DNA, 17001 bp, Oryza sativa
  unsure (1)..(17001): unsure at all n locations
caaattttagccaaaaacttgaaatctgatatttcgattattttatccaaattttggaagtttttatcctaggggtattttggttatttcgacaaatttgtacagtactaacggaggctaactggacggcgatggtaaatcgtagaagttaagcaaaagtcgatggtatattgtagaacgtgacaaagtcagtggcaaatcgtagacttgtgacaaagtcagtggcatataatggattctctcatcctataatgcagagtcctattagacaactaatccgaatatattgtgggcccaaaatttggatcacatatttcattttttttcattgagttgttattgttgaaatttgagtcgtgcgaaatacatcacttatattctagtattgttaattacatggcctgtaatttgagtgatcgcttggaaaaatagtgctgaggagcttctaccaatgtgggagctaggccctcactttgagtaattgaacttgaggtcgccgatatcctagctacctagctttgagcaggtcgagatcacttcctagttgcttcgagctcagcccgacacgtaccgaaggtgtactgaaacacgcacgacgattaattagcagggagcttgatacatcccaaaacccagacagctaatccgccacgatagggagcttttacggtagtgacagctccggtcgctgtttcagcatagagcattttgctaggtctcgacgagatctgaaccattggatcgggcatgaattcgtgatgactctcaaccctaggtttttgtttttccttgagccaaagggcgggcaaagctctgaataatgcccaagccatgatctctcttttagcatttgccaaaatgaatttgaattaaataactgtaagatcgatgcgtgtttaattgactacataagacaacggagatgttttctatgggtatttttgtggacttggaaaatgtttttatagattcggagtatgaccatcaaaaggaatcattggaaaggatggctcatcacgatgttatatatagagttaattagatcaatgccattggaaatttgcctattaaaaaatatcattacaattcatctattcgtaaccgtgccactagaattttacaaaattataaccgtgccattaccgtcacatttccatctattccttcattttccgtcttctttccttctcccatcttcttactccaacagtgaagtcgagccggcggcggcgagcacggcgtccgtgcaaggaggcgagggccctgccgagcgcgtcggcagcagcggcgagcacgtcgtctgcgcaaggaggcgagggccctgccgagcgcgtctgcgccgtccgcgtcagcatcggccacagaggcggagctgtgcccgcccgcgcagagtgccatcttcggcggacgttgagcacctggaacgcagcggcgtcgccgaggagctgccgcggcgggtcgctgctccagtggcaggtgaggtcgaacccgagcgagcggcagcagccggcaccgatgctgaacgggaatggcatggctacgtcgccgcaggtggtcgggcagtctccggtcgcggcgccagcgaaaatgaatcctcttgcctcccattgcatcgatcgatcctcaaggcagcatggccgactgaagtgagaagaaagtcagaaaactttgggtgtatgtatctgcagatgaagtatcttcattctcaactctcggcggcggcggcagcagcagcagcagcagcacgccgtccccacacaagcggcagcagcagccggtggcggtggcggcagcagcaaccggcaaccgcagcagaacgctcttccggtccatggtgagcattgtagtattacatatattgaaaaaaccggatgtagtactagctatagcctgcctgtgcctgaacttccaagcctccaaggtgggcattgtgtgccagttgttgtgaaaataccgatacagatgtggtgttatatgtacaaattgtttaatcggcacatatagacctactctctctgtcaaaaaaaaatcaattctagatttgaatctagatagacactactccatccatcccataaaaaaacaatctaatactggatgtgacatatgctagtactacgaatctggatatatctctgtctagattcattataatagaatgtgtcacatccggtcctagatttgtttttgtgggacgaagggagtatgtccagattaaaatttaggattggatttttttttatgatggagagagtatgtgtctaatctagttctcccttatctagaagacttgcccaaattcgttgtactaggaaacatcaaatcccattctaggttagctttttatgagatggaggtagtattacgtagtggtatcaatgccgttttcgtgatggtggcgactaatctgacacctttggagcggtaatgattagccttccagtgatagcgatgttctctgtcccaaatcacctttatattagcaacttgcattcggagtttatctaatttatgaattgactgtaccacaattaaatctttaaaataaaaactcggatgattataagttttcgtttatttcatccattctatatccctccaaaatagtaagaaattagattatcctatccaaccaaacataaaaaagatcagatcactaatccaacaggactatatttcacgcataaatgactgtgaagtgtgaagcagacaccccattcgcccaattcagcttgttgtattacgtgctcttcccggtgacgacggccggcttattttcgtgtttctcggcctgtgtggcccattaactggatgagcgattggcccatacatagctctgtattgtactccaactatttgatagcatcacttatcccaatattttttcatttctttttatacaagttatatttcaaactgaaatttgttataggcttatagctattttatttctaaaaaaaactttggtgtcggatttatgtaatacgaactgatcttagagaacatatatatgaactcaagtcattcaaatcagggcataaatcaaatgaaaagtttcaacatactatttttttaataagaccacttgttaaacaatataaaaaatgaaaagcatcatgcatttaaaatcgagggagtaattaatcaacaactatatattggaaggtagtactgcacacttcatggtgagggaaagtgcctgcatgtcatctaaatagtcataaaaaaatttaaaaaaaattgaaaatatagattaatatgaaatatatcactccacaaacatgcaagttcaattttaacttctacaagatgtaacaaattttgttgcaacttataaaagttaaatttggtcttgcatgtttgtgtagtgatatatttcaaattaatctatgttgtcaattctttttaaaaaaattttaataactatttacatggcatgcaaacaactagagaatgttctctcgagggatgaaaatccacgtcctcatgattgacaacatgcatacatcgaaatcaaaatcgaagtctacatctcgagaaaaccacttaatttccaataaacatgactaatccgcgaggggcctgtctaggcatctgtcgtgtgatttttgaaaaaaaatcacccagattttttatcccctcagatttgcatccaacagaaaaaaatagtacacaaacaataagatcgggccaatacagactaataaaacagatacaatataggttgcaatatgctaaaattacagtgctttgtaactaaaattacagttgtaaaaacagtagatatggcatgtaagtgcactgtaattttagtacaaatgtaatgtaaaatttggtaactagaatatttgtcgttttagtacaaatgcactgcttgagaaatcgtccaggtatctgaagtgttaaatattgcatttataagtaaaattacagtgctttataactaaaattacatttgtaaaaaacagtagttatggtatgtaagtgcactgtaattttagtacaaatatattgtaaattttggtaactagaaaaagaaataaaagaaatagagagaagcgacatcagcgagaaaacatgggcgcgcaaatcaaaatatcgcacggagaccgtggtgaacatggccccacgcggcgccatgcatgatcgattttctgtcgactggaagctgagatactcgggctactgtctactgtgttactatcagcttatcgatcgtttcctccaccatgtcgcccgtgagacgtgtggcgctggaccgctttgtgcgtgtctgattcgtcgcgcctaatcgcggtgcagatccgacggttgaaaaaacgtcaaatacgaaaaaaaaaacaatcacacgagagatatattggtataatcacataaaattaatgataggacaaacataagatgacactagcttaatttgggaaattccaagcttagaacagcagcagcgaggcaacgagaggcacgagcatcatcgtcatcagcgacaccgccgccgccgccgccggtgcagtctcgaacgtcagccgcccggcgtcgacgtcgtagatcatgttggtgcccgtctgcagcagcgttcccagcaccgagccgccctgcgatggcagcatggtgaggcactccagcccggtgtcgttgtcgatgtagaagtagttcgccgccgacagatccatgtcggcgccgccgtcgaacaccagcgtcagcttcggcaccttcaccttcgccatggacgacgcgttgtagcacaggtcgagctccagcgccgccgagccgttgacggccggcaggccgatcctgctcgccaccgccgccctcacgacgtcgtacgccgcctgctcgaggtacgtcaccggcgtcgtgctgctgaggatcaccccgccggtgccgttggccctcaggtcgaacgtccccgccggaatggcgtccagcctgttgccgtcgacgcgtacgccggtgaggttgacgtagtagaagtccgggtacagggtgctcgacagcagcggcgtcgaccggccgcgcttcgtcttcggcacggcgtcgtcgccgaaccggatgacgctgtcggcgctgccgtcgtcggtggcttccggcgccagcagctggtacgagaacttgccgaactggagctgcgagatcagggacaggttgcctctcccgatgccgatgacgcccgacgcgccggcgaagtcgccgtagctggcgtcgctgcagccgaacaccacgccgggcacggccgtcgcgccgaacgtgaacgtgtcggtggcgaggtagcccgacgtgttcgccgccgacccgccgtacgtcaagctgtagctgtcgcagcgagcgccggcagtggcgttggccgccgcgccggcgaggccgcacgtctcccttaggacggggaggcacatgtcgctggagcaggggagcggcgagaacgtggcggagccgttgggccggaacgcggtcgccggcggcgggaggcacccggcggcggcggcgcacggcgcgcactgcgcccacacgaaatagctcgtgatgtcgacgaggccggagacggtctgcgcgacgggtgtcccgacggtgatgttgatgacgagcggcggcgcggcgccggacgccgcctcgccgccgagctgctgctgctgctgcttgttgcccctgttgcgcagctgcttcttgaggaatccggcgaccagcttggacacccatggccggcttttggcggagtagccgccgacctttggtctggcgcggacggcggcggcggaggccaccggcggcgggtggagtagttgcaggctgaggagagaagcagctgctagtagcagcaacgtcgacacggccatgctcctggccatgtttgaattttatgtgtttgcctatcaagctagctagctttgctgtttgtatgataactatgcaaaacttggctgggatgtttgatgaacatggctagttaaatgagtatatatagggtttttggtcgtcctgccatgcatagctagccactggcagaatttagaacattatgttgttggattgtgttgacacttgacctaattttatttcatcgtgctgaaccatatgtcgaactgctacatgtgatgtaacgaagcagagtaacacttagtttctgaatacatgacgttagatcctgaatggtcgaacttattattagtcgcctaattttttgtagctatcatgattgttttaaactctttgtcacctagagttgcaaacgtgtcaactaaactaatacaaggtgtacagttatttaaacatcaatctccagtagacgcagtggcctcccaccccctcgcacccaccgcgcataacgtaaaatactttcgtaaaaaccgaaccgaccaacctctcccagtcccatccataccacccctcctaagattaacctataaaaccaggcagaaaaaaaaattaaaccctataaaaccaatatattctattatttcaaataatagaaagaaattttgtcctttcctcgaagatttgcagccaattattacataaatcctttcaacggcaagcataaaccaacaagtccgtaatagcacacccaaaaaggcaaaaactaatgaccaccaacactagacaaagacaacaaagttactaaaacttctttgtgaatttacatctgtagttggcgagaatctgtataatctttgcctctaggttatgcataagtttgatatactcatcacacctttgcagttgggcttaaaaccgaagcgaatatgttgcgctaaaaaatatctgcatataagatttagacggtgatttgtcaaaaaccatatcatttctgctaagccatagaaccttacatataacatatactcctactagactaagtttcttggtttttttatcaatacccacaggccaattaccaaaaatattagatttactacatgaagatataaacaaaaagagatttgtactgatctccagagaaatctggcaaaatgattatctcaaaataaatgatatatatcatcttatttttcatgaaaaaattacatctcacactacctttccaattcctactaaccaaattatcattagttagcactactccttaaacataaaccacataaaaatatgaatctttagaggcatctcaaatttccagataacattattcctctcaatataaccaaaaaaaatttgaactaaatacatagaacgaagcgagaattgacgattttgatgaaaattgcatttaaatacatcatttccttctgtcaaacgaatatgcacaattaaaacacataaattatgtcaattcatcgagttatggtctactaattctcttgtgaaataaacattcaacggaacataactcataacatttgcagccggattcttctacgaactataaagtactaatacgggtagctgtacttaaaagaagtatttcctatctacttacctcctagaatcttagttgttcaccattattaactaactaggaacccatatctaaaaatctactcctaactttcttcataagtcccaaccaacaatgagaatactcttgtttcctctcaacttacttaaatgattcattcgttaagtattttcttttcaataagtcttgttgaacacatttctcatttattaacttaaaaaaaccatttgcttaataaaaattggttttgaatttctaaatcttcaaaatatatatacattgttaggtggcctaaatagtttgtttaactcgtatgctgtatacatattcaaggatctactaaatttgtaacactaattcaaggaggtgcaaaaagttatatattctcacattaataaaaaaatcttaatcagtaatttaattgagagaatctattatatgcaattcagtttatcacatgtctacgatttaccactcacttttgccattttctacaatatgacatcgacttttgcttaatttctatgatttataatcgccgtctagttagccaccattagtactgtacatttttttccacctgaccaaaatacccatgggacaaaaaattctaagatttggacaaaaacaattccaaaatatcatattataaacataagattggaaacattcaaaatttggccaaaaacttaaaatatgatatttcataatttttatccaaattttggaagtttttgtccatggggtattttggtcaattggacaaaattgcacaatactatcgaaggctaaccgcacggcgatggtaaatcgtagaagttaagcaaaagtctatagcatatattatataatattaaaaaaatcaatagtaatggaatattaatggattctctcaatttaatttaattattgcatgtatagctgaatcatatgaaatataattgcctacatgtacgtgctgatgtcaaatgtatacatcatgaaataatttttgtatttatagcagacaaattggtatttcgtaatatttataggtgtgaaatggaacttccactacggaagtatctactgcgccattcacatatcagctatcgtcgtcaaatttcgaaagattcagaaataactgtagaggatgttcacgagacacatgttatattgctagtattcgctagctataagttttgtttatatgctatatataggccctgtttaattcagcttagaattattataatttagattattaggagtaagttaaaacaaacaagtagattattatgctagattattataatctataagccagattactataatccaataatcttctctagaggagcttttttcagattattgagtggctaaaaacccactacccttagatacctctaataatccagagaaacaaacaactcgtagtttattttatgtcaacttattataatccagtttaaagtaatttgatttaataatctagattacaataatcttaagccgaaacaaatagggccatagtatatcaataaccattagttcaataatgccaacttttaggctcttagcgagtagtgaagacgacaaaaagaacaaaatatacgatcgtccgagtctgcgtgcgtgtggtcttccggccggcacgagctagtttaggtcaccctgaaattaagtcaatcgcgtcgacgtcgttaattaaagatatatgacatagagagaagatgacgatgctgactctgtctaatacgttcctctcagtgttacctttcgttaattaaagctgtgtgaccactgaccacgttgaagagtgaatgggttatactaattgatatcgcctcatgtattttttaatccaatataaattgctatatttttttaaaaaaaggatgatatataatgcaatgacaactcccttcgttttattacaagttgctttgaattttttcgtagtcatgttttttttttttacattttacctaattagtaaaaaaactatataccattttagcataaaataaatatattaaaaattagttttattgaaattaattcggttttcaaaatgttgctaaacttaattatctataaatttggttaaactatttttaagaagaaattgaaatgacttataatatgataaaacagaaagagtaccatttaagttcaatatcttgcgttcctaaattttcgtggtgtggatatatgtgttatgaatgttataaatctttttaagatttatttacatggatttatatagaagaaggatattaactcgagggataaaaatagctagattcccatcgcagaaaactgcatcttctgaccaggttcatccgttgcattattttggcatacatgcatgcaagtatctggcctacggcgactcgtctagccagcagagcgcttatctggttggatcatctatcgtttcgtccagcggcgccgctgtctacgagaggtgattggtgtatatagtcagcagttgggcgctgttaaatttgttcaaattgattgaccgggtgaagatgcatgtgctttcatcctgtgtgaaaaaggaaagcaagcatggatcagtaagtcaatcagcaccaactctatcctaaaatataaatttctaacacattattttgtttaaaatatagctatttctaagattatctactcctcaacgaattacaagtattattattgttattatgaatattgaaattttaatcatatatatgttaaatttgttggttattaattttgttgcagtcgatatgtagaatttgttttgaagtgctaatgacaacacaatatattataattagatgaatattataattagatgaatatagaatccatcctaatatttattctattacacaacttaatatggaatccatcctaatacattctttagacattattttatagggcaattgcttatttgaccctgtttggatgtctaactaccaatttgaccctactttttctactttgcgtttttggccttattttttatagacgacgctactctctgaccctgttccgttaaggtgagctaatggtgttaactttggagcaaatagtccattttgcccttgcttatttgattctgtaatatcttgcttatttgaccctattatgtcatattgtgtatatattaagatttgttgacatttttttaataaatttgacagtatttgctttaatttgataaatttgattcaatttgactacaatctgatagtttttttttcacaaatttgacaaattttgactttaatatttccacgcgggttccacatagcaatgtctagtactaattctcttatcctctctcttctctctctcctctcttcccgatccagggcaccgggagcccgggacgagcggcggccggcagggaggatggcacgacgggcggcgactggcggggaggatggcacgacgggcggcgaccggcggggagggctgcacgatcgcccctgaagtcgtgcgccgccgctccgcggcgcgacagcgccgcgaccgccgctccaccgtgggacgccgccccaaagccgcgcgccgtagccgccgccgcccctccgccgcacgacggcagcccgaagacgcgacgccaccgctccgccgcatgacggcgccaccttcctgggatgccatcgtcgccccgaagccgcgcggcgccaccgctctgccgcccgacggcgctgccttcttgggatgccgccgctgccccgaagccgcgcggctgccgctctaccgctcccgcaaagccgccgtcactccgttgtgcgatgccgccgccgccgccttccctctgcgcgccgttcgcaaaagatgaagaagagagagagatgggttggatagggttgaagaggctaagggtattttggcccgtttaaaaaataaatagattttttctttttcctaaatgaaaccgtaacggtgtgatggaaagagggtcagacggagtgttcgattttgaaaaacagggtcaaataagcaaactaggaaaaacatggtcaaattagtagttagactttgaaacggggtcaaataagcaattgccccttattttattgaattgtactaaactgtagacaattcttgcgcactgccttgaggctaacttttcaaaaagcatgtaaacacacaaataaatcttctagttaccattatccgcagattctatagatgttctatatgacagacgatatttatagagtattgggatcgttagaaccagggtatatgcgaaatacggtaaaagaaacaggagacctactcctgttggacgaacccggtgttgcctttatatatcaatatcatacaagcataatatttgggataacctaatctagtctacgtcggcttagcggcaaggagctctcacacgtaatccacgactagtgtagtcttctcctcgaacataaaccttgcaagattggaggtagttctagatcccttatatatgtcatgttctatggttcctacgtacattgggtttgtcctgatctgtattggcttatcttttgttggtgcacccccttccttctatggggtattctatttatagcaaaaatcatcttcctctataagtagaacttggagatttagaacaggatatggaccaagaatactttatcttctccgactaagactcttaacaccttctatttcgggaagataattttcttctttacctgccgcatttccttaatcaaataatacattatggtattatactaggtatatggtatctcagtattggaggcatgtcttattcttgacaataataggttctaataagaaaatagttgatattagcactactagaaaaagcattttcgccaacgttaggtatttattttcgtaggaggatatgacccttagagtcaaatagccgcctacaaaaaagcaaattggggtgaagggcgttgttcgcctgcaaaaatctattttcacaggcgaaccacttaagcggcgcctgcgaaaatcattttcgcaggcggaccacataaggtgcgcttgcgaaaattagcgtggtatgtgtcacttcccctcactctcctcttatcctctcccctccccttcacctctcccctctcctcactctcctcttatcctgtcccctccccttcacctccccgccagtggaaggggcggccggcggccggcggcgtctcccctccctccctaccctccagatctagccggagaggggagtgggaggccggcggccggcgggaaagggcggacagcgtcgggcgaagcgcggatcggctgccgggtggcggggcggccggcggcggctcccctccctccctcccctccagatctggccggaggggggtggggggaggccggcaaacggcggcaaagggcaaaaggcgtcgggcgtggggcgcccggcggcggctcctctccctccctcctctccagatctggccggaggggggtggggggaagccggcggcctgcggcgtcgcacgcgggacgacgcgaggcagctggcggcggctcccctccctccctccctcccagatctggccgaaggggtgaggggggaggccggcggcggggtgcattcgtgcgacggcgatgacgacttgcgtgggaaaatttgtgatttgatttgatttgattgtgaaccactatgatgtatgttaatctgtgatgtttctatgtatttgatttggtttgatgttgaatctggatgggggaatgtgaggagaatgggaagctactgctaccggccggaatggcggtgggcggtggctgcacatttttttttaattccaggtgctattttcgtaggcggaccagttgtccgcttgcgagaatcaactattttcacaatcattcggttgcaggcggtgaactggtccgcctgcaaaaatctgtttaggccgcctatgaaaagctgttttctagtagtgtagctaagcaagataaaacaaaattagtcaagaattagtaaaaaaaaagttaataatttcagagctacgagattttcattccgaagcaacgttaggaacgcccccacagatcgattgagttatcacatatgtgttttaatcttattggttaaatgctttattaatcaaaaattacatttatattgaataagtcgaattagaaactagttaattagtcaatcttagtatttaaatgctaaatcacatatcaactatgcaaatcataaaatagttatacccgatcaattggttgcaatcgtaaataatgtaatcaccgtgtttaaattgtggcataaacaatgctcctactgctcaatagctcttggtctcgcccaatttgtttgttatcttcccatttggttttctcatatgtattgatcaattacatatgtatcttctaatctgctcaggtatgatttggttgaaaatgataaatccaggcagcttccatgtgactaatttttcgtaggctgttggtccggaatatattagtgaaatcatctaaaaaattattggaaattttacacatagatatcaactgatatatttttatatcattttatctattcatatgaaaatgagttttcaaaatttaattgcaaagttgaatatttaaaatttgcagcaaaataatttaaatttattaacaattctaacaattaaattattaattaaaaatatgtactcccgctaatatgtgaatttattatttaagattgttcgcagaagcatattaaaataaataaaaatgaagaaaagcaacaaacctgatttacttgcaacattgactaagtaaggtcaactccttttctcctgatttgcatatgcgcagctacactcttccatggtcggtcatcttgtcgctaaactcttctaagtctgttttacgcatggccatgtcctcaagtgcgtacaagagcgacatgtcgacacacatgcatggagcaccgagcacctcataattaaacacaaatagagatggcctgtttttttctttttgtgaaggatgggtttgttgaggatttccaatttcataaaaatgaaaaaagaggccatttttttcaacttaagagaagatcatcaacgttgataagatcattattaatccctccgtttcatattataagtagtttgactttttttttctaatcaaactttgttaagtttgaccgagtttacagaaaaaattagcaacatataaaatatcaaatgtaatgttgaatatgtttattttgtgttgaaaatattactatatttctgtaaacttagttaaacttgaaaatgtttaaccagaaaaaaaatcaaacgagacggaaggagtatgtttcctgccgttaatttttttcaccataacatcaccagccaaacatctgtattaaagcctcccaccccccccacccaaacctggcgcaagaaatatatgcatgggtgtctacatgaacatcaaaacaatcgaattagaatccgattaaccgatcttgacttgtgcggtttgccttcgctagcttttcgttcacgaattcaatcgtgcatgcacgagatggaattttagttattatttttaattatttgcatacaagtatttgcgtctacgtgaattgagcgtagctcaactccctctggtggaacaaactcacttgggtttaagttctagacataacattccaactataattttgataaaaatgttgtgcaagtaaatatatattagtcactaccaggatgcgaaagtttcccgtgtgcctataacacccaggaaactaggtgaaacacccgggaaaaatcttcccgtgtgtcaacacccgggaatgctcacacgggagcgttgaagctttcccgacttggattcccgggtatcaggaaggcagcgctcaggaaagctctagacatcctgggtggttagagcagcacgggagaaaaatctaacgctcgggatgttcaacggaacggaaacggcaacggaatacttctcgggtgttggttcttttgcaacacccgggatgtttcagtactacagctcaacattcttcccgtgtgctaaccacacccaggaagtttcagtcctacagttcaccatcacccgggtagcaaaaataataagcaatgtaatagaattggtacaagcactcaaatattcagcaatgtaatacaatcagtgcaagtacaaagcataaactgatctgtacaaatgttgataccagatatttgttttagttgcacacatacatattcaaacagccacaaccaatctatggaatacacacgaaagtaatgtttgctccttcatataggtagatttttttctaacatcataagtaccagttcttgaataatatctgggagtccattggataggtaggaccaaaataacatgaactacatccaaaaatcattgttccagatcttgatgtttggatggatttctgtagcaatgaatcatggctggcaattggacgcacttgatcttagatgatggctgaaaaattatagtgtgttagaaggtgctgataaatattgtatagaatatattgccagataaatattgctatagcatattatgaaagtttaagagtgcacattgttagattcatgcctagatggattagaatcacaagcccaaagacaattaacagtacaaatgtcaagcatgccatttgtctaaccaagtggttcctacttgtcctgtacaaagagcccagttagcacaaaccaggtagaagatacataaagaactagattgaactacagctagcaactagatacatgcatcaaatgtaattagtcttacttcttaggtacctatgcattttacctattcagattaaactatgtgttatatctcaggcaactgtttacatattgaatgcattcagattatatgctttttcgaagatggaactatccggtaaaaaggtcattaatgttggtataagattgctcacctaaatagacagtggggcatgttggggccgctggtcgtggaggcaaaacattaagtttcattgcagattgaagcgcctgaaatttatttacacataacaatgcaaatagttaaatttatacatgttgatgaattttaaaattaataagtacataaaggaggcaaaactacaagttaccagctgtatcgcagatgttaagtaacatgtttcatgttgccaagccttaccatcaatgggttatttcatcaaatcaggacttgcaccatgcttttccttaacaactccaaaataagcttcctgcatgataagttgggtgtttattcaaatggaaagagattaaaaagttgttgatcaaattttgtgcaagctagagtgcaactacttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13674 - DNA, 1076 bp, Oryza sativa
gaaagtttttcaaagcattccaaatctcttgagcagtttcaagatgtgcaacacgatcataatcagaacgagaaataccactcaaaagaatgttgcgagctttgcaattttgttcaaaagcagttttttcagcagcagtattaataacctcaggaatcacataagcatgagaaacttttctccaaatatcataatcttcagccataatgtaagattgcatcctactacaccaatgagaaaaatccgttccatcgaaaacatgaggcttagttgaaaacctagcgggagtagcaatggcaaaaactttagatcgataaaaatccaaagaagaaaacgaggctttgataccacttgtagtatcgaaacacaagaactaagccaaccagagagggggtgaatggttggtatacccaaaaaccgaaaacttttagcggaaataaaagttaccctcgaaatcgatggatcgcagtctgaccgaagttgccctgccggtctgaccgcctggtttccaccggtctgaccacctatacaccgccggtctgaccgccacttgccgccggtctgaccgccggtagatcgccggttagaccgccaaaacccggtgaaacacaaatcgaagaactcttaaagtggttgacgactttattacttctctctgtgtttacaaagtgcaccaacagcactccttacaaaaattttgactaaattcgaaaccttaactcaaaactcaactcaattgctctctaaagcgatacaaagcgatgccgggaagcctcacgctccccctctatttatacatgaggtaggcagcctaaagccacgaaccaaactcatactaggagtcctaaacaccttaggaaacccactagtacaagaaagaaactttacataaccaaacgtaccaaatttggactccttccaaattcgactccgcatcccatacgcacacaataactccatcatataccatatggaatctccatcaaccacgtgcatcaactctagccttagtatcccgcatgatctctgaccaccacggacgtcgtcttatccccaagccggctcccggtccatca

SEQ ID NO: 13675 - DNA, 487 bp, Oryza sativa
acagctgagagatctcctgcatacctttttccagcaatagccactccaaaccacccaactcctcgacatgcctcaaattcaggcattcatttacaaacagctctctcacttggggaaggttggagatcctctccaggccttcacatccttcaacttgaaggaaaccagagaggaatgggaggtcctccaccgtcttcaagcaacttgtgcatcttataaagaactccttcaagttggtggcctgctgtccaagctgtggtgggagagccctcagcttgggcagcccacaagttgcaacctcgtcaaacaaggcagcagccatgacgaccttggagttggagacggggcttcctcccccttttgcttcgaagcagcagttccatcctctcccccttccttggctgctgcagctgcttcctcctcctgcacttcttcttcttcaacaaaggaccacttgtcagactcgtaagaagaatggaggaaattt

SEQ ID NO: 13676 - DNA, 258 bp, Oryza sativa
gtccagctataatggttagaaaaagggatggatcttggagaatgtgtgtagactaccgacagctgaatgcccagacagtgaagaacaagtttcctatgccaattatagaggacttgttggatgagttacatggggctagaatattttctaagctggacttaaggtcgggatatcatcagattagaatggctgaggaagatattcctaaaactgccttcaaaacacacatgggtcactatgagtacgggctgcaggaat

SEQ ID NO: 13677 - DNA, 799 bp, Oryza sativa
taagtcggcggcaacagaagcaaaccggtagtgaagacgcgcagttgtgaagataaaagcaccagtcggcggcggcataacacgagtcggcggcggaagacgatgatgtccatcagtagtggtagctgtataaaccagatgtagaggcgagggcactagtcagcagcagacgagacgaccagggatgaagatggtaaggccaatcaacactggcagaatcatgcagccatggaagtgcagaaaccagtcggcagccatggcaaacgtaggcagcttgtgttgaagatactgatgcctattagtagtgacagcgatgtagccagccgtgaagaagatagcatcagttggcgttataacaggccagccgtacaggcggtgacaccagtcagcagcggatgcggcggccggtcggtgaagacatagacgcccaacaacggcagcataataggccagccgtgcaggcgaaaacaccagtcggcggcggtcgaggcggccggtcggtgaagacgtagacgcccaacaacggcggcataataagtcagccgtgcaggcggaagcaccagtcggcggcggacgaggcggccggtcggtgaagacgtagacgcccaacaacggcggcataaaggccagccgtgcaggcggaaacaccagttggcagcggcgaaggcaagccggtcggtgaagacgtggacgcccaacaacggcggcataaaggccagccgtgcaggcggaaacaccaatcggcggcggctaaggcaagccggtcggtgaagacgtagacgcccaacaacggcggcat

SEQ ID NO: 13678 - DNA, 5621 bp, Oryza sativa
  unsure (1)..(5621): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttattgaataaagcagggagcaatatttacatgtaaggagtaaaagtaatatttacaaagaccgaataggcactaaggtaacatctctgctaggcgtttggttcccgccgtagcccaggttttttactcttctttaatctttgcggtgaggggcgccgtgcttagctccttgtttcggaagattcggcgattttgctcgttccaaatttcccaagagattaggagaattagggatctggtccccagctttggtaacccttggcatgtggcgagagattcccaccattcgtgaaccacgctcgcctgtgcccaatttgtcggcgccatgggcgcacaggctaaccggttgacaatggcatcccatattttcttggtgtatctgcagtctgccagcaggtgaatagcggtctcattagtgtgtcggcatagcgggcaaacatcgttgttctgccatccccgggtcgccaatctgtcggacgtctagattctattttgaatgattagccatgcaaagattttgcatttgcacggtgcccatactttccagattaaggtttcaaagtttgttttgagcgatccgaagaattgtgccttgtaggttgaggacgttgtgtattctccatgacacgtgagcttccaagtgattttgttgtcttcatccggggaaagtgtgacctgttggattgtcgtccagagagtgacaagctggttcaggagctcaattgtcattccatcattgatgggtaaggcttggtcatctagccactggccgctttcgattgcctgcgcgagtgagcggtcttccgcctagatatcgagaacacgagtggtgccacatccttcggccagcgcccatcaagccatgcgttgtcccagaattttattgtgtctccattaccaatcttaattttcaaagcagacgcgaataggagtttatcgttctggtcacacggtgtctccatccccgcccacgctttttctggtgactttcactcatgccaaaaccaacggagtcttagagcccttgtgaacttgtcaagattcaggattcccaaacctccattcaccgtcggtgagcagatcttctcccagttgactttgcatttgcctccaataatatcaccagaaccagcccacaggaaacgcttgcgttgtttatccaggactttgagggatccttgttcaccttgagagccgttagcaggtaaaccggttgcgaggtgagcactgatttgaccaaggttgttcttcctgccagacccaggtttttccctctccagcccgccatgcgccctgctgacttatcgaagaggggctgtgggtgaaccttgtgcagccgccctagcatcaacggcaggcccaggtattttagtgggaaagttgcacgtgtaacctacgactcctccaggatgttatcgatgtcaagatcatcacacctaatcggtgccaccaaggatttttgaaagtttgtgcgtagaccagtagcatctccgaatctttgaagtaggtttgtgaaggcgttgacatctctgcgtgcatggcgctctccttcctgccccggatttgggtatgtagcccactagtatatcatatttagttatggctcggtatatttttaatctttgtacccccattgaaaaatttctactgctgccactattcaaaagcgtgggtgtgcgtacatttgtgaccgcttgtgttcactacaagaaatcttatgatagatgacgcttcatttacatcaaaaaacataaaatttcgtcacgttttgtaatatgtgacgctcgcgtgacgaaaattcatccgtcacctatcatgcgtctctaatagctccgatgtcacgagaaattcatcacagaaggtcatatttcttgtagtgttgtatcgtgtttagaaaaacaacttaggtggtgtttggatccagggactaaattttagtccctatcacatcggatgtttggatactaattagaagtattaaatgtagactaataatataattaattgcataaatgagagctaattcgcgagacaaattttttaagcctaattaatccataattagcacatgtttactgtaacatcacataggctaatcatagattaattagactcaatagattcatcttgcgaattagtttagggttatggaatgggttttatcattagtctacgtttaatacttctaattattatcaaaacaaccgatacgacaatgactaaaatttagtctatagatccaaacagggtcttactcttatgacctcggaaggcagctagcacctcaggaatcttggttgcttgccgtttgccgacgccttcataagagaactcgatcacgattataactccatcttacttcttaatatgtccaattatccatgcaatcaagcatctagagtgctatttaagaattatcttctccatgttcttaaatcaaaaggctcaattaataaaggcaagtttttatattacacataaatatgggtgcttcctcgagcgtatatcaattaatgcttcaagattagcacccatattatatggctctctcattttcataatttaagtcattagttttattctaataaaactaatataggtttgatcgagtttataaaaaaaatacaccaatataaaacgccaaaatatttccacaaacacaccatgcatgatatatgttttaatagtgtatttatttaatttattaatttagatgttgtattcatcaaccatctcggtcatcgttaaatgagtttgacttagaataagactagctaaaatgacttacgagatgaaaaaagagataaaaattgttaactctttactatcttcatcccaaaatataagaatttaaaatcggataaaatattttctaatattatgaatctgaataggtagcttgtctagatttgtagtatcccatctagttagatacttatattctgaaatggagagagtaattagtaagtagagtaataataagcatctgccttggagatatgatcaacaacaactctccattattttgtaaagttattccctacgtaccacatgcacgccatatatataatgcctttaatgccccccccccccctatatatagtcgaacagggagctagctagacttggcacagcacatcatcatcagtagcacagcacaaatacaggagcggcccggctatggcaatggcttgtgcagcactagtgccgttgctactgttgcttcttgttgtgctctctggctctacatctctcgctgaccacagtgcaggtgtagatgaggtcaactacatcgtggtgctaaccagcagctggctcaagccaaattccgtctgctccagcctgagtaccgtcttaatttttctctctcttcttcctactctctccgtaattttttcatatataagtttatccaaatttatagaaaattagcaatacttctaacacaaaacaaatatattatcaaaatatattcaatgttacatttaattgaaaactaatttgggaccgtagatgttgctacgtccttttacaaatttaatcaaacaaaaaaactttgactagaaaaaaaataaaaacgactttatatatgaaacagaggtagtagtacctaagattaaaacttgaacgtttttaataagtagttaagtcagagcaattatactatttcctcctattataaatataaatcatttatcttctcgactctttactagactttgccgtcgttgggcaacttttaactatatattcttccttgtttaccttggtaaataacctctctaacaaatgaaacgaattattttggcatttaataataattattattaatatatcatattaataaatataattgttgtacgtggatgttagtgagcccacaccccaacgtgaccaactgggtcccgttgagccgaccgtacgggccgtgcagctcctcgccggcgaagggtagggcggcgccgtccaccgtcgacggcatgctctggtcggaccagcaccgcgccgactacatacagtggaggctctccggctcggtcgccggcgtgctgcagccggccgacgacgtgccggtgtcaactaactacgaacagcagtccatagaaggagatcttaactatggcacgtactaccctgcacctgcaccaatgtcatcaaaggtaaaattatttaacccacacatatgcaaaaagaagtaaaataattatataacaataataataattaacctattactagtaattaattagaaagctaagtttatataattaaaaaaggttaataattacccacaatatataatattaataaaattggctagaacttcttatgcattattgattgatctgatgaaaagaataatagatctagaacttattacattattgacgtacatgctgcttatcaaattcaaattcaacttctacgtatagtaacgaaaaaaataaatttaaccttttttttttacaattttcctttttcttcctggaagtatcttcttaagggaggaagagatttcctgttgttgttgtttagattaaatgagagatcaagatgtagtaaagaactggattctgatgttataatttattttttcttttatatattaataaaatcttaacggtggtggctttccctgctgtggttcttaaaaaaacttcttttttaagatgtagaagttcaatttgatcttacatattatttgtgcagtgatatattacatgttaatacatcttgtcaaattactttttcataaccatttaagtgatatgcaaattaacaacgtgaccggacatctcctcgagggatcgaaatatattaaaacgtactcacatgctagctgtccgatctcaggcgatgaatccggccgccaccggcggcggcggcggcgggccgggagtgacccagacgatggtgctggacacggcgagcgacgtgacatgggtgcagtgctcgccgtgccccacgccgccgtgctacccgcaaaaggacgtcctctacgaccccaccaagtcgtcgtcgtccggcgtcttctcctgcaactcgccgacgtgcacccagctcggcccctacgccaatggctgcaccaacaataaccagtgccagtaccgcgtccggtaccccgacggcacgtcgacggcgggcacctacatctccgacctgctgaccatcacccccgccaccgcagtcaggagcttccagttcggctgcagccacggcgtgcagggcagcttcagcttcggcagcagcgccgccgggatcatggcactcggcggcgggccggagtcactggtgtcgc

SEQ ID NO: 13679 - DNA, 2024 bp, Oryza sativa
aggtacgtgctgacgccgatgctcaagaacccggccatcccgcccacgttctacatggtgcgcctcgaggccatcgccgtcgccgggcagcggatcgccgtgccgcccaccgtgttcgccgccggcgccgcgctcgactcccgcaccgccatcaccaggctgccgccgacggcgtaccaggcgctgaggcaggcgttcagggaccggatggcgatgtaccagccggcgccgcccaagggcccgctcgacacctgctacgacatggccggcgtccgcagcttcgcgctgccgaggatcacgcttgtgttcgacaagaacgccgccgtcgagctcgatccgtcgggcgtcctcttccagggctgcctcgccttcaccgccggccccaacgaccaggtcccgggatcatcggcaacatccagcttcagacgctcgaggtgctctacaacatccccgccgccctcgtcggattccgccatgccgcctgctgagtccggccgccgcccccgacgtctcgatcgggactctactactacaggccggagctgctcttgctccggtgataccttttaattttcataaagctcgagcgctcgcgtctttaatttgattcctcctatttatttttgcgtatgcgtacacgtgctacaagatcagctggctggcgtcatgtatgagccagattagcggttgctttgatatgtactcttccatccatgtgggtatatatatatatatatatatatatatatatatatatatatatatatgcacgaagaaataaaacttaatttgtttgcctattaactgtactgtacaacccttttcgaattcgtcatctcatctttaaaaaacctcttctaatttgctgctgtcaaccagccatacacgcatgggttgtcattcacaggggtgcagggcgaccgatatgatattttggtccaatgcatgtatctgaattcttctagatatgaagcacttcgttacagatatggatatggattaataccctagctagtatgtcacaatttatgtgttgcattcttctgcatgtgtggcattccgtttcagagatgaatgggcttatctgaagaatcatgcttgtaactttttttttaacgagttctattgataaaacagaaaaaaattacaagattatgacactggagggttgtagccaggaaaaagaaaaaattataccaccacccacacaccgacatcgccaacacacaagcccagcagaaggctagcaccggaccggccgccgctaagcgggatcgaccgccactagactaacaaagggacccacggctagcgcaccgatgctccaccaccatactagctctgccgacatataggacccctgcaccggcaccccccgccggccagccttcgtgcgccgaagaccactccatacacaccagcagctcctcctcacacctaggtcgcctcctccaccgccggccgtgcttctctgcgccaagccggcctcctccaccggacgcgcctctcgcgccaagccggcctccatctccgctgcccgtgcctctcgcgccgagccgacctccgctgccatcgactgcgcttctctgcgccaagccggtctttgacctctccaccaaatgatgtcgcgctagccagatgcagccatctcccacgccctcggcaagccgtctgaggccaccatgcctctgatgaccgcagacacggtcaccaccaccgcagccgctgctgccgaacgctcagccacctcgccgtcgccatcctcacctcgcacccgactacttccccgctgccgacgtcaccaccgcctccacagtcacggccgccgtcgccgctgccaccgacacgagccaccgccaccgcaaaccgccgctgcgccgtcgccctccaccaccaagcagcgagcaaccgccgccgccaactgccacgaccacaccgccgccgctgtcgccaacagacgtcgccagccgaccaccactcggccacacccaaatccggccgagagctgccgtggacgttgccga

SEQ ID NO: 13680 - DNA, 3455 bp, Oryza sativa
ggatccggcgcctctgccgacgtcgccaccgtcgccatccccgccggcgtcgacccagcctctgccatccccgccgccgtcgacccagccgctcctctaccgtcgccgtcgccatccccgccgccgtctccgtctccgtctccgccgccagccgccagctgccacaccgccagatccggccgaggcggcgcggatttagcggtcaccgtcgccgccgtcctgggctgctccccttgccgcccgaaacgaggcgagctcgacgaggaacgaggagccccgccgccgccgtccttgtggccgcgcggctttgccggcggccgctcaggcggcggcgaggcggaggaggaagatggggggagggggcggccggggttcgatgcctcccgtgctgcccctaggggagggcgatgcgagagcgttttacaaaccactatgctagtaacttgcagtgctagtaactggtggatcgcttgcatgaagtaaatattttgccctcaagctgccactcttatatatttaagtgaaatcccaatctgctaagctgccactcttatatatttaagtgaaatcccaatctgctaagctgccactcttatatatttaagtgaaatcccacccttgtatactcttatatagcaaaacaagcatagtggcccgcgcagattgcgcggctagcatcattatattttctctcatataatagtatatatgttttctcattatattattcaaatatattaaaatgacaacataattttaaattttgcaataactttacaaaactactaatgtgtaatatttatattatattttatatacgtgttagttattaattatttttaatatcaaattttagttatttgtaaattatatatattcctatatggactctagactcgtcttttaatatttctttttttaattccgaattttctgtaaattgtatttttatatagagtctatgctcttcttccaatattatttatttttatttatgaatttttattatttctaattgtatttctatgtggactctaaactcatctttcaatattctttaatttttaatttcgaatttcagttgcttctaaattatattccaatatttgtattcctatattgaccttaaattcttcttccaatgtttttcttaattttgaattttagttatttgtaaattgtatttttatacagactctaaactctacttttaattttattatgtttattccaaattttagttagttttaaattcctatatggactctatactctacttctaatattccttatttttttaattccgaatttctattttttttctaaattgtatttctatatatactctatactttacttctaatattccttatttttaattccgaatttatattatttcctaattgtatttctatatgtactctatactctacttctaatattccttatttttaattccgaatttcagttatttcctaattgtatttctatatgaactctatactctacttctaatatttcttttttttaattctgaatttcagttatttcctaattgtatttctatatggactctagtctcctcttctaatattcctttttttcattccgaatttcagttatttcctaattgtatttctatatagacagactctagtctcctcttctaatattcctttttttaattctgaatttcaactatttctaaattgtatttctatatggactctagtctcctcttctaatattccttattttttaattccgaatttcagctatttttaaattgtatttctatatggactctgtcttttctttttctccgattaatgtgagaatttctagaccatgagagcgaacttggaggttcttttttctattcctttaattatatatttaattccaaatttctttctaaattgtatttctatatggactctagtctcctcttctaatatttcttatttttaattccgaatttcagctatttttaaattgtatttctatatggactctgtattttctttttctccgattaatgtgagaatttctaggccatgagagcgaacgtggaggctcctttttctattccttaaattatatatttaattctgaatttctattttttcctaattgtatttctatatggactatatagtctacttctaatattccttatttttaattccgaatttcagttatttcctaattgtatttctatatggagtctatactctacttctaatatttcttatttttaattccgaatttcaggtattttctaattgtatttctatatggactctagtctcctcttctaatattccttattttttaattccgaatttcagctatttgtaaattgtatttctatatggactctagtcccctcttctaatattccttattttttaattccgaatttcagctatttgtaaattgtatttctatatggactctgctttttctttttctctgattaatgtgagaatttctaggccatgagagcgaacgtggaggctcctttttctttcctaattgtatttctatatggactatatagtctacttctaatattccttatttttaattccgaatttcagttatttcctaattgtatttctatatggagtctatactctacttctaatatttcttatttttaattccgaatttcaggtattttctaattgtatttctatatggactctagtctcctcttctaatattccttattttttaattccgaatttcagctatttgtaaattgtatttctatatggactctagtcccctcttctaatattccttattttttaattccgaatttcagctatttgtaaattgtatttctatatggactctgctttttctttttctctgattaatgtgagaatttctaggccatgagagcgaacgtggaggctcctttttctatttctttaataatataatagatcgttttactgtagacttgctcgatggttgctaaatgcactgacagtgatacagtacaaaccatactatattttagatagaaagttagggctaagcaatgaatgggttgtcaggttttgctgctgtcaattttcttcagcaagctctcccttagcctgttcaatttcaatggcatgcaagcagcttcgtatgtcagaaacgatgcaaacaaaatgctcgacggggacggtggtggaggcggcagtgcaggcgtcggaagaggcgagtgagacgaaggcggcgagggcggacgagtcatcgagggcggctaaggtggcgagtgcgaggagagagggcagcttgggttagtgagtctaaaagatgattatacccctctgtaaataattttccctggacaataatacccttctatgattcaactaccattaagtgaggtggtagtagaaataaatatgaaccattcgatcaaatgaaattaatggttcagattattttct

SEQ ID NO: 13681 - DNA, 11845 bp, Oryza sativa
gcagaaacagctcgtgattagcagattgcattagtgggtggactgtcaattcgatcacagtcacagaaacgacatgtgagcagaacaagttcttcctcctgcagagatcgaacattggagagatgacatagcggtgacaatggcgatttggcgattgcatcaacgtgttgcacatatataaagctagcgacaagtataggcgatgcgtgtgcttgacagtgtacagtgcagaccatgggtggcgacggcaagcgcaccaagttgccgtggctgggcgtggcgaggtacgcggtgaccgcggtgctcgcgacgacggtggcggcaacggtggtgctggccattgtgactttaggagaagaatttggggattcaacagtaacattgatctaaccctaaagggcaaatataaatgtatacaagtgatgcgaaaatactaaactacccctaatatcttaacacccccactcaaatgcaatgtgtatacacattgcatttggagtgtaaaataaatatgagaacacaagctaaatattggtctatctccaaagtcttgatgatgtcgtcgaagtgtgtcaattcttggatgatgaagaagaaaagatgtatctcttcctcaatgaagtggacctcggagccttcaaaaactgttcttcagttctcagtaccttaaagcctttacaaaccgttcttcggctcttcattgattcagagacgtggatgatgatggagggcccttcacaaactgttcttcggatctccacatatttgatgacgatgacgatggtgatgatgaaggaccttcacaaattgttcttcggtccttcattgattgatgttgatatcaactccgatggggagctggtgatatgatgaaggccaactctgtggagctagtcatgatgaaatgacaatgaagagatggactggcacaactttgacaaaatgaaggatatgcaatggaatttgctggattcaatggataacataggaaattgatttgtaaatgatactaatttagtagcaaaagacacatggatattgatataccacagcagtagcaacaattgatgtgcctggtggcacaaccaatcaatcaccaacaagccacatgtgcattggacaaagcaagactcaggacaacagtctgaagatgatggagaatagtggtggcacaagatgaaggtgatgaataatcaaacattgatgcatatcccaaaataaattcaaagcaacgcaacatgcaaagcaatggatagagaatgagcagagcagaggtggatgataactgccgagaagaggctcgtggctgcagcagaacttgaatggatacactagatagaaaacaaagaaaatcgatttgtagatgacattgatatgctagcaaaagatataatggtggttgccaagggaactgcagattaaccgattctatccaatttggtagcagagagcagcagctgataatgaaagaccacgagtactttcagtataatacgagtttagatagcaaaagtatgatcaggaaactgtgagcaaccctttgaagcattttgtcgaacaccttgtatgcaacttggacttggtggtttagaggcaacaacactcaagactaaaggatctactgtcggcagtggccgcaacgacgagcggcggcaacaggcagtggcatgtggagaccgcgacgagtggcaggcaggtgacgacctgcgacgaggaagacggatgacacgctcgacgagcaacaggcgtgggacgacgacttgtcaacttgatgcggcgaatgagggcatacaacgacgacggttggccctgcgaagcgcaccggtgaggatgacgacagccagatccacaacagccggcgaggacggagttgcgattgacgacgagccgcagctgggggacgactgggctgatgacatggacggggttgccgtcgccgatgcgcgtggatgcatgtggacgaggcaaggacaatgctcctggctgctgcctgcaacttggcggatgacgacttgatgagacgacgaacgacgatgctgtgcctgcaacttgacgaagatgacggatggcgacttgacaagaggacaagacgatggctcgccgacggcgagcccgccgccggcgcgccggcgagaacatcagatcgacaactagagtttggatccttgctctgataccatgtgactttaggagaagaatttggggattcaacagtaagattgatctagccctaaagggcaaatataaatgtatataagtgatacgaaaatactaaactacccctaatatcttaacagccatcaggatggtgctccggccggtggagctggacctgtcggtggccagctgcgcggtgtccgtggagcggccggagtcgccgtcggccgcgtcgctggtcaagtacaaggtgacgctccgcgccttcaacccgagcggccgcgtcgtggtccacttcggcggcgacaacctcgtccgcctcatctacggcgccgcggcgcagacggatagctcgccgcgttcacgctcccggcgttcgtcgtgccgcagcaggagtcgcacttcgtcaccaagtccgcgttcctgaacgcctccgcgctgccggcctcgctcgccgcgaggctctacgacggcgagaccgaccaggtggtggtgcaggccgtggcgtcgctcagcttcaccatcggcggcgcgcgcggcgtgagcgccggcaagcgcggccacaacttcaccttgatccactgctggccggtgtccatctccagctactacgaggtgtccggcggcaaggcgtcgtgcagccaggacaccaccgaggcggcggtcgccggcctgacccacgaccgctacatcggcggcccttgcccggagacgtacaagaactccggtaagtgctccaggaatagcaccggcatcaaggggtgatcagctaagttcatttcgcggggtgtaatttgatttccaaatgctactgtaattaactaatttattacaaattgaagaaataattgtattgaaattgtgcttaaacaatgacaaagtggaaactaaaggctttttgatttgttgccacatttaacccgataacatgtattgtacacatcttttgttttagtgaggctatgcctcctgcgttgtaaactttgtgtttgggatgtccccaaaacaacacctcccccacccccccccccccgcgcgcgcgctttcaatataagccgggccgctagtctttttctaaaaaaaaaaaaacatgtattgtacccacaagttttgagtgcactctcagttaccacacacaccagctaacaaataaaaaaaaaatctagacatacttacaaatacgtgtacacgtactacaactatgcataaagtgtcaacttcaagtttaactaaacataaattgatcactaccaaaatatgccaattcaaaaatttccgctcttgccaataaattaggcgtccctattataaactaaatatttatatagatatgtaacgtaacaaatcaaagaggaaacccatccaccatgatcctatatattttgccggattgaccaaagagcgaacaaccaccgcaccacatccgcatcttgagcgaaatagcatgcaccggcggcggatcggcgggccgctggtggaggcccaggcggtggtggtgcagagctgttggtggcagcaacgtgatcgagagcgggtccaggcggccgatctaggagcgcggtggccatggagggagtgctcgctacagggtggcggaggcgatccgctgtcgaggatgcttgagatcgccggatccggcagcatggaggccttcccaccccggtctgtgcggtctccgccttcggccacttgcgtctctctctccacggctgatcttcgcctgccagcctcaccagtcaccactagcactaggtgccctgccaaggacgattttgacgccgagtgcaccgatgacgcccatgaggtacatcaatcttgaaagagtttgagttgcaacgcacaggtgtattgatcacatccagtatacatatatacatgccggtgcagctcaagagtgccaacggaatcctgataaaatggatcgtagactgagcacggcggaagaataggtcaaaaagaaactgtaatctagcctatccttatctacatgatcagccatcttgacaccccccccccccccggcggttggtgcgtcgtcgacgatgcacaaactgtatcggaaatcttcaaacagcgctgtgggcaatcccttcgtcatgatattggcgagctgttgtcgagtcggaatgtgcacgacgcggatgtccccaacagccaccttttcccggacgaagtgtacatccagctccacatgtttagcatgaccatgatgaactggattcttggacaggtaaacggcggagatattgtcgcagtacacaagcgtggctttgtcgagcttgatgtgaagttcgtcgagaaggtgacggagccaacaacattcagtagtcgcgttcgccacaccccggtactcaacctcggcactggagcgagacacgacggactgtcgtttggaggaccacgacaccaaagagtcgccgaagaagacgcaaaagccggacgtcgagcggcctgtgtcggggcagccggcccagtccgcgtcggagtacgcggtgagcgacggtgtagaagaacgccggagttgcagacctttgtgcgtcgtgccacgaacataacggaggatccgcttgacaagtgtccaattgttaacaaccaaatttggtaatctgagtatcgaagaagaagattagatcgatgcggaatcgaagacaaagatcgtttcggaaacagagcaagattcggctgaaatccaaatcggctacgatcaaagacagctgagttcgagtcggacaaggtagccgattaagccgattccgacaatacgactcggtgtgtgtcatcgggttgagttaatgtgcttcacacggattgccacactcggattgagtcctgaataggcaattgtatctattaattaggatattttatataatttccttagagataagtttgggcaaaagtctgctgcaaagacttatggtatcttagagttggttagagataacagtcgtgtccgatatggacatattttgtaatctcgggtataaatagaccccgaaccccatgtattcaattaacacatgttcaacaacaatctcggcgcattgccaccctttacttttgttttgctttcgactagttcttgctttcgggttgagctgcatcggtttcgatcttcaactagaggtacgacttgttatggcggcttgcgttctcgggattagtgcttccatcattatgatactctaatcttgtctctgtaagttgtcgagttatcatatattctatataatcttcggcaatattgttatctaaccttcagtcggctaacatctatcactagaaggcagccgattaggttaaataccaacgttgacttagattatatagaatatctaccactctatgaagctcccaatggcttgattgtctagatattgtctttcttttcatacttatggctgcatcagttaggtttgacctcataagtcgtgcttagaactataatctctagcctgcttcttggtttccgattagggtagcatcggagtttcagccaatcttacctgatttagctttatgttttatatgcttaattgatatgctagatccgccctttatgttaagatcctattgcatttaggtgtattaagctttatgtttgatatattttacttgctttaatatcttgatatagagtggtatcggagtattagccgatacacgctagatctatctgatcggctatgctgtaaacgtctatagtctccttggtaatatatatttcgatctaagtgatttatactgtctcggcatggcgaccgatctatcccaattacttaatttaagtatatatcgacataaagattatatactgttaacatctacagccaactgccgatcgattcacatatgacatcggctctcagataaatgatatgtcatcggtagctggccgatcggctatcgtttatggatttaactgcggtttccttgtctttatttcttgttgattgcaggatcaaatcaattggcacgctcacgaacctcaaaggcaagatttttggacctgcactggagttaagcagatctcccaggcctcgtgttttcgcatcaacaccagtgcacgtcccgcagcgagtgcatgtgaaggcagacctgttgcacagcgtaagacaaatccggccgtctgagcgtgaggtcctggagtgccccgacgatgctacgatagaacgtcggatcactgtagggctgccctgtcgtactggagaccttggccttcgtgtccacaggtgtcggcgctggcttacaggcgggcgtcggtcgtgtcgtcgatgtgatcgaggaggccgaacttgcggaaagcaatggtgaagaaggtgcgccaggtgccgacgttggagtcgccgagatcaaggatcacgggaacgtgggacttgatgttgatgagttgcgccgtcgccgccgagatggccacagagcctgccgcgaaggggttgacatcgtcagaagggacagtgcttgacgccacagagaagaaagaatggagaagcagcagaagatgattaggatcgagaagagatctactaagcaattggcaactaccgaaagtgctcttgttatccactttacaaccgacataatccgaatcggaatagccgactagcttgaacttagaaccttttgggtaccacaagccaatagttgaggaattctttaaatatcttagaatccttttcacggccattaagtgacactccttgggggtggcttgaaaccgtgcacacatgcaaatactaaacatgatatccggcctagatgcggtaagataaagcaagctatcaatcacagaacgataaagctttaaatctaccggtttatctccctcgtcatggtcgaggtggctattggttgccatggagtcttgatgggctttgcatcctccaagacaaacctcttgagtaggtccttgattggtttggctcacaaaggtcccatccttgagttgattgatttgaagtccaaggaagaagctcaactctccaatcatggacatcttaaattccctagacatcatatcaccaaattccttgcaaaacacctcattagtagaaccgaatatgatatcatcaacataaatttgacacataaagaaatcatcaccaatgattttagtgaaaagagttgtgtcaactttgccaattttgaaaccctatgataaaagaaaatctctcaagctctaggagcttgtttcaagccatagagagcttttgagagtttgtaaacatggttaggatttttaggatcttcaaaaccgggtggttgttcaacaaagacaagttcggcaatttcaccatttagaaaagcacttttcacatccatatgaaaaagctttatatcaaagcatgatgcaaatgcaagtaggatgcgaatggcttcaagccttgccacgggggcaaaggtttcaccaaaatccaaaccttcaacttgtgtgaaactttgagccaccaatcttgcctttttccttaccaccaacccgttctcatcttgcttgttcctaaaaacccactttatccttatgacattgtggtttctacgtctttcaaccaaagtacacaccttgtttcttgcaaagttgttgagctcttcatgcatagtatttatccaatccggatcaccaagggcttcatttatatgttttggctcaagacaagaaacaaaagagtaatgctcacaaatcgaagagacacgagatcgagtttgaacacccttactaatatcacccaagacttgatcaattgggtgttccttagagagagcgttgtgaattcttggtggcataggtggatcttgtgccttttcatcctccacgtcaacttgagcttggcttggcgtagcggaagtagtttgctcaacttgagtagaggtggaaggcttgtcttccacttcaacgggcttgatgtctccaatagacatgttcttcatggcgctcatcaagccctcatcacctacatcatccaaattctcgtgcccctcttcagagccattagtttcatcaaattgaacatcggcggtttcttccacaatacctttgttcttgttgtagacccggtatgccttactatttgaggcataacctagaagaaacccttcatcacaccaactttcaaatttggttagtctaacaccttttcgataaatatagcagttgcaaccaaaaactcgaaaataggcaacattaggcatcctcccaacaattagctcataggaagtctttttcaaaagacgatgcaaataaagcctattgattgcatgccaagcgatgtttatgtgtgacatcccagcagcttggtcttggcttggcccaaccatgcaagcgcagcaacagcccaagcaacgagtgagcagcagcttagacactgtagtatcgcgtgtactgtagcacgcgagtcactgttcaccgaatagtaccacctcgcctagctagcttgaggagcaccgagatataaggatgtttgcctaaacacgtgtaacaccgattcttttgtgtgaaaagcgatgtcacgccccgaactagtctcgaccggaactaacccgtgacgctccaaattaacctgttaatcgataccagtcccaggaaacagtgctggtatcacaggtgctccttgctcctgggagacagaatatcacagtagaagtaggcgcgacttgggaactaggccgaaaccctaaaactcatcgtagccggtttgctccttgctcctggaagaaccgctccaaattaacctgttaatcgataccagtcccaggaaacagtgctggtatcacagggagacagaatatcacagtagaagtaggcgcgacttgggaactaggccgaaaccctaaaactcatcgtagccggtttgctcctggaagaactcctcattagcaggattcgcttcatcttcttcagcaactggggggatatttatatagagcaagggtgagtacgggagtactcagcaagccaggggaaataagtgtttaatgcaggcttcaaggaatggctgatgtttttgcaattgattttgtttgaactcttttctaaaagcaactaagtgagtgcttctcaaacgacacagatgagacagtgcgtctcgtccggtcagagtatgtgcaatgtatcagtctttagatttgaacaagattggcacccggccaaaagctttttaaacggccacccgggccaacacttttcaaacggccacccgggccagcaactttttaaacggccacccgggcctagctgatcccatcagctgcaggttttccaaacatcgaacccagtttcactacagcaatttcacaagcagtagtcaaacaaaactacgctaggaatcacctcacatccgcccatgaccgtgggcacggctgttcgaacagtttaatgacctctgcagagggggtacactttacccacacgacattactaacccgggtcacccagcccgtggggatcagccacgtcgggagacctccaagctttcatgacaaggcatttcgaaagccgatgcaggtttaccatatgccgacgagaggggtcccagaccaacaacaggttaggtcccagaccatactgtgccaggaagcccaggggtcctcccctacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacgttccccggtccgcggttttggaaattcatttagttcgcaagcaccgacccaagtgtcgggttttccaagtctctttttaaaactccagttttacccaagttgttactcagattttaagtttgaaggcgaccgtcgatactcgcacagagtgcacgagtatcgaggcgcaactgggtggttacaaggggacatggtatagcaattaacaatggaaggatcaaatgcgacaaattaggtgagtccgccaatctgccttgcagacgggacaacagattaagtgtgatcctatcaatgcataatattttgcaagcaacataattaaatttcaaatataggctcaagatgttcaaaggtggcttgccttgctcgagatcgggagcttgatcctcgaaatcctcgcactgcgggtcttcgggctccgaaactacacgcgaaacgggacaactcaacatacagcgaaaataaagccctattaatgacctctaagcgtgccactagatagatctcgagatttgaagaattttggaagttgaacggagtcaaacggagttacggttgggaagatattgaatttctaagattatcggatttttggtctaaaggaaaaaggatttaattaaatcctttttggaaaaagaaaaagaaagaagggagggagggaatatagacttttctcgggcggctagggtgcggcccaagagatttggggtggctcggccgagcttaacgggccggccggcccaagacggcccaagcgcgcgcgcgcgggagggaggagagagagtccggtggaccgggctcaccacgcgcggtcccgggtgggacccgcttgtcagcggctcggctcaccgtgcggagggagcacgcggcgcacgcgcgcgggcggggaggaacgcggtgcacgcgcgcggtttgcggtggacgcggatgcgacgggcccacgcgcagcctcacggctcgaggtggaacgcgcgcacggggagggaccgaccggggtcggctcgacccggtctaggctgagctggcgccgacgtggcgcctacgtggcggccacgtgggctggcgggaggtagacgacgacccggccgcgaatggacggcgggcggcggcggcgagcgtcggagcgaaccacggtgatacgggcaagagcgagcacaccgggcggttgcacgggacgaggggagacgagccaacggctcggatttgccgggggttgctcgacggcggcggattgcggcggcggcaaccggcggcgggagaaggggaaaacggcgatgaagctacgaggggtcgattcccggcggtgagagcatctacgcggcttcgggaactcgacgctagcgtcggattgggcggaactacgccgagcgaggccggcgacgagcgggtgctacggagctcgggcggcgacggcggcgagcacacggcgagcgaaggcaacggttggggcggcgccggctagctacggggggtctactcgagctactaccgaaagctaggggggaggagacggagcgaggagggagaacggagagagacatcaccgagaagaggaggggcgctgtgacgagaggccgacggcgcgggagtaatctctccggcctcgggccggggaagaggaaggagagggcgcggccgaagtccccttccgcgtccttgctcgtgccggctcttccgacacgcgcaacgacgaacggcgacgggaacagaggggcggtaatggcgcggaggtgaatgggagaggaaaggaaaaaggggggggctggggtttatagggggcggcaatgtcggtttgagaaccgacttgcgcggtcaaggcgcgagctggcgctccggctagcggccaaattggcgacagggaggatgacgccggcggggaggaaaagggaaaaaggaggggaagaaagggggcttgcccctttgccgg

SEQ ID NO: 13682 - DNA, 7830 bp, Oryza sativa
ccggggggggagagagagagagagcccgggagagagatgggccgagcggaattcggcccatcgaaccccggggaggcaaactaaacttttgcggagggatttgattcggaattgaactcgacgatagatcggggattgagatcttgagatggcacggacactagacaacaatcaaagaaacaaatttcgcaattagggtttttaagagataattttcccgctaggcgccacgacggaacgggcgctacaagcgagtacgaaaaatgcggtgtgttgcagtgtaggtgtggtccaactaaatgagatgatggacacaataccgttttcgggtccagggctgttacattatggcttccacccaaaaggaatcggaagctccatattcatctagcatagtccttgccatctcaatcaatgtgcaatttttcctctccactacaccattttggtgaggtgagtatgtagcgaaaagctcatgcttaataccaagatcatcacaatagtcctcgatattggtatttttaaattccgaacaattgttacttcttattttcacaagagtgcaattaaatttattttgggccctttttgcaaactttttgaaaagctcggcaataatagacttgtcatgcaaaaagaacatccaagtataacgagaataatcatcaacaatgacaaggcaatgactatttccaccgatgctcttataggttgttgggccaaacaaatccatatgtaagagctccaatggtctagatgtggacataatgcttttggaaggatgagagcatgcaacttgcttgctggcttggcaagcactacaaagtttgtctttttcaaacttcacattttcaagcccacaactagatcatgttttaaaagtttgctcaattgatgcataccaacatgggctagcctcctatgccaaagccaacccaaagaaattttcgcaaccaaacaagctttcaaatttgcttcacttgagttgaaatcaaccaaataaagatatttataacgaaaatctttgaagatgcaagatttgtcatgaagactagaaacaatcacatcttgagggttgaaagtacatgacaaaccaagatcacaaatttgtgcaacggaaaacaaattgaaatttagtggttcaacaagatagacatttgtaattgatagatcattggtgatagcatctttacctaacccaattacctttcctttgctattatcaccaaaagtgactctctcttgatctttgcctcctacttcaaatgtggtgaacatctttctatcaccggtcttgtgttgggtgcacccactatcaagcacccaatggcttccaccggtgtagtagttcacctataaaagaagatcaagctcttttaaatacccaaacttgtttgggtccttggaggttagagaccaaagctttggagacccaaatggaattctttttaccaccaagtataggggaacccacatatctagcaacaatgcgaccatcatgaaccttcctaagcatgtagtgagaatcaaacatgcaagtcttagaaggcttaccaccggtgcaagcatttgccatatgtccaaccccacgacacttatggcaatacttaccattgctcttaacaaaacgaggagcatggtgagaaggtttttttacccttctttggaatgaatccatgtccctccttgttaaggatgcactgttgctcactcaagattttgtcaagagtggtcttacccttgaagcacctttccaaactcttgttgagcttggccacttgctccttgagctcattgttcacaaccacaagtgaaacatcacaaatagaagcacagagctagagctaggcatatccataagatcatcacatgaagtagatatgctagatgatgcaaaatatatagcatgacaagaagcactatcatcaagcaaatgacaagatatgcaaacatcaatgtgagctccatgttgggtagtggtaaggagagtgtcatgagcttccttaagcttctcatgagaaatggtgagtctctcacgagaagtctttagctcctcatacaaggtttccaaagaagcatgatctttctttagagccttgtacttggcaatctctttctcactataagcatggagctcctcaaacatactcacaagctcatcataggaaatatcatcaacatcatcatcactttcactatcactacttgatgttaccttggtggagcctcttggcatgaggcaaaatggagagaatagtgatggagcctccttgatagctactccggccatgttcttcttcttggagcttccatcatcatcactctcgttgtcggacccggattgagaatcgaagctctcaacacttgagtcccattgaccaatgaaagcctcgatcttcttgccctccttcttgagcttcttcatgagcttgtatccaccactcttgttcttctttgatgacttgtcctcatcatcacccttggaaggacacttggaagcaaagtaccccttctcgccacactcaaagcatctcaagttggagagagtcttgttgggtcttctattccttcttctattggtgtttgaccctcttcctctctctttccttcttcccaagaggtcattgaaccttctagtaagaagagcaatctcttcatccaagtcatccttgccttcatttaccttgccctttcccttgtcttccacctcggtttgaagggcaatgctagtcttcttggatggtgatgctttttccatctccttcttcttcaacttgtacatgtcattggtgttgatcttgcccaaaagactagcgggtgtcatccttgacatgtccgagttgatgaggaaggtgacaaggttcttatacttgtccggtaaggctctaagcatcttttgagccacctcaaggtcggtgtagatggccccaagacccttgagatcattaactatcacatttagcctcccatacatatcattgacgctctcatccggcaacatggcaaaggtctcatattggatcttgaggaaatggagctttgcatccttgtactcactagtgccctcatgtatctcactcaacttgttccatatctcataagtcgtctcaaggttgctcactctatcaaattcgtcttggctcaatgagttgaacaaggcattcattgcttgagcattgagtagaaggttgcgatgatcaacctccatcaaggggcttcccgtgataacaaaacctacatccacaatgctccaaatatggaagctcgtagccttgaggtgagtagacattttaattttccaagtagaataatttgtgtcactaaacatgggagcctttcctacatggttcacctcgttcgacatcttctctctaggcggtaaagcccaatcaagagagaccaagctctgataccacttgtaggatcaacgatgttgactagaggggggtaaataggcgattataaaaattaacatctaatcaaaaataacctaagttgctagtcttggtaagggacaagtctaactaagcaactaagttaagttttgcaatcctagggtgcaagtggttcaaatatgtctctaataaagtaaattgtacaaatgtaaatgcaataaataaatgagacaagagacagaatttttcaccgaggttcggaaacttgccggtttcctacgtccctgttgagacgagcccaactctaccgctcaaccacgagcccaactctaccgctcaaccacgaagccaccgcacacccccttcgtcaaggggtgggcaaggtgggacccggccacggagaggactacccaagcctcgatcactagggtagttcttccttcactccgaaggtggtgaactccaaaccactcacaaacggtgccgggccttctccacaatcttctcggagtggtcatcgggcaactcctccacaagccgtctaggaggcggtaacctccaagagtaataagcgatgacccggctcggagattggtcaagtgccacactagctctagaatgaagcaaatgcacttgactcttggctaatcaaccctcaatcacaccacaaagatgaacacaagctctagagtgtgtgagagagtgtgcaagggatgtatgcaagtgaagcaagtgccaagagagatcccttgctgctggtggggggatttatatagcccaacccacaaaaactagccgttggggtcgaaatccccaacctcactgcagtgccgatcagacccccatatagtggctggtcagaccggactactctgcaacggctagaaaactagccgttgccgtgcatttaatacacctgacacacatggctggtcagaccgcagcagagttgccggtcaaaccggccacggctcggtcagaccgccatcggctcggtctgaccggctgcgtctctggcggctctggatcggccatccagaggcgcccaactggcatccagccggccagtcagaccgggctacctggccggtcaaatcggcgccatgcctgcagtcagaccggcggtacacgcccggtcagaccggcccaggcggaaactcagggtttttgataaaataaagtgtgccaaatgcaatatgacctaatgtggcattttgatcatctctttgtttaggtcataacccctcttgatagtacgacaaagctataaataaactagcaaaatttgatcgcccaatctccttgatcaatttaaaatttaaggcctctagtttaccgtcttcgatcttttagctttgcgccatccaatttaatccaccgtaatcatccatgtgcacacaatatgggaacctaacttaaaaaatataactcaaggaaattgttagtccacaaataatgcttgtcattaattaccaaaatcaacaatcgggggcctagatgcttcaggtgagccgcgagagaagatgaagaagacgctttgcccttgccgctgttctgttgatcgtgcagcagggagaggcccgcgcaggagcctggcgagccgcttctgccgagcggtccagaaattcttcatgtcgttgtccgtcctgccctgcaagtaggtcgcgatcctcgcccacttgttcccgaattgcgcctgcaactcgatcaccaccctctcttcctcggcagtaaacttgcaaccgcttttttgaaggaggaaaaaaactcagaaaaaggtgggttatacatgaacatttctatcgactatttgatcaaagataagcagacaagaacattacagagaaacacaatatagtgcaagtgcgatcaaagattgcacagactgaagatatatagtttactaacacattatcatagagcagtgggttcacaagcgaaaatccatctagctagttcactcgcaactgccgaggtcggactcccggtggcgctcggctccccctctttctccgcagccacgagccggcacgccgccgccaccaccgacatggttcgccgcgggaaagagaggagcagccgacggggctagccagaccggagagagaggaaggggagagctgtgagactgacaagtgggtcccacgtcgatttttacactgtgttgctatgttggcataccacatgggcaaaagtgacaaatagttaagatgccaccactttagaggggtaaaaaaaataaggacaaatctaataagggtatttagataattggcaaacctaatagtggccaatagttaaatttccctttgaagttctcttaattagctagatacctcggaagctatgggatgggctgggagtctacgtttcatagggggagaaaccatggaactcatcaacaaaagcaaccgcaaaaccatttaggttgaaatataccattggtacatatgccaccaaacaaagaagtccttaggactgaagcgcttaatataggtagctagggcatagaagaaacaatgtggattcctgtgaacaaattgaccgagatgaatatataatgcactttcgtgtgattgtgcattgcatgttgtcttagttgattatatattgtgagttgagatgaacaaaattatcggaaactctgaattattggtttatccagaactagaaaaagtgagatggtacaatcattgcttagtggcaaaatctcttatttcacaagatcagatggtgaagatccaaagcggatggaagcttttaattaaggtgtacacaaagtaaattaaagtttgtaagatgcttcggaaaagatagaaaaggaaccaatataattaatggtcctaaccccaaagcttgacaacggatccgttctgtatcctagctagctccttttgagctgggcagctggccaggtgttcctttctgctacaccacatttgccaatatatgttaacatactccctccgtcccaaaaaaaaggcaaaccatagattttcgtgtccaactttaactgtccgtcttatatgaaatttttttataattcgtattttcattgttgctagatgataaaacatgattaatattttatacgtgacttgtctttttaatttttttcgtaattttttcaaataagacgaacggtcaaacattggacacgaaaaccagggtttctttttttgagacggagggagtacacaaggagccggatctacctttcaatatgtcagcgagtgaattttgacccacagaattaacgtcacgacagctatacagctcacaacgtctacaatatttactaaagcctggtggttagtggcaaaaccagaaataattactaaacactaggactaacctagctaggactcaactaatgaattatttattttctctaaaattacatggtaatttacttataattttggagaagcctagagctcaagccctaactactctaggcttgcctccctcctgccgctagtggttattttttcagatgcataatggctagtaaactcaccgcgctgttgatgatgctagctagtctagtctggatcttagttatgaaaagttgagtctgcgattgaaaaaaagtatttcatggactaaaaggttagagagagaaaataccgcacactaataattgtataaaaaaactataatctacatcaatagctcactgcaggtttgatcgatacgttgatgcaatttagtataacaactcgaaaattgaaccaattagtacaactaagagcaaggatcgataatagtgagctatatgccaactataagtttacgtgaaagagagagataaagaaaagtgagggatgttggctctcatgcaaaagctagctatacacatgtcccaagatatttacattaaattcatagtgagagatgtgtggatgcaatttagagcaaggataatagtgagctatatgtcaactataatcttacgtggaagagagagataaagaaaagtgaggggtgttggttctcatgcaagagctagctatacacatgttccaaaatatttacattatgaataagagaaagaaagagaataaaaaaatagagctaaccttatagttaatctattatacaagttagctatagtatagactaaaagccaataattagctatactattaaacttgcttttagtataacaaatcgaaaattgaaccatttagtacaactaagagcaaggataatagtgggctatatgccaatgtttacgtggaagagagagataaagaaaaatgaggggtgttggctctaatgcaagagctagctatacacatgttccaagatatttacattaaattcatagtgagggaaagaaaaagagaatataaaaaatagagccaaccttataattaatctattatactccaagttagctataatatagactaatagtcaatagttagct

SEQ ID NO: 13683 - DNA, 5517 bp, Oryza sativa
gatcggataattctcggatagttctgatacggatattttttgccggatacgtatacgaatatggtatcgggatttccgtcagatacggataataattcggatatccagtgaacagtgctattcggatatccgcagaagccatgagacataccccatttctttataactctatgaccttcaatatacatttttagattttaatagtggtttatctcttaacactagtccacactattaatattatttaaatttttaaaaatatttataaattatactacatttaatataaagtgagctaattatataagttgatatttgtttctattagaagttaacttggttttcgtgttccgagaaaaaattgtttccgtattcgtgtccggtcatattcgattcttattcgtattcgagataatccgtatttgtttccgtattcgagctatccgtattcgtttctgtatccagtaaaaaatatgaaaacgaatacggtatgagcattatccgtccgtatccgctccgttttcatccctacttccaaagctgtcattggaggttgggagtagtgatgaaggggcctcatgaggattcattttaacttatatggtcagtggtgaagccaccggggtggtgcttaattttgcttgcgaaaaggatatatataggtaattaaataggatcagttcgtacttggtagcttaatttgtatcgatgtcttgttctgaatagattgccgactcccaaggctgtgcatgtggtgcttgcaaattgcaataattaccatgttcttttatactttagctaataaggaccgggtacttgtaaccagtttatactttgcatacgtgagacaataaacatggcgaagacggacaatcacacatcttggcatcgctctcactgagtctttttttggatattcttaatgatattcttagttccggcgtgtttttttggatgacttcatgttttgtacgtaaacagaaacaaaactatgaatatgttcttcccaggagatctttttcttttcttttcttattctttttttttttttttgcaaatgccaacacggcatgagctttgctcctctggagtcccatccaaccgtggtacaataatgatgttacaagcacaatttactgaaaaagttgcatgcatgacctgtattttgcaagttataattccatacaaatgcatgcagggaaagtatttaatttgtattatcaaaatagcttgaaaaaaagccaccaccgtgttttttctaaggctttgaaattaacattttaatagaaaaaggaaatacaccgaccattcccttgtagtagatcaaaattatagtggtgtatgtcggttttttagttgtctaaaaaaaatgattgtatctacagaagttacaagttatatatgtcagggttatagagaacacatacccaatactagtcaattaagctcgatgggacccaccatataccattttttatacggaaccttacctcgtatatagaaggagttcggataaggagggagaagcagagttccacatgaactattcggatcgtatccatacttgtctccgtagtcctacttagacaaagggatatctgtgggtataaatataaagccccttaggaggagagaggggagcgaacatagagagatcaacactcgccgcaagatatcgacattagagataaacctaaacagaccccgtctagtgctattggaggccgacaagatggatctagcgctatctttgatctcgccatagccaaagcaatctggaggacccacagccatatcaccgattggtctcgtcagactgatcttgacgggagttcgtcggtattccgtgactcagttgttctcctttgtaattgctacctattctcataattacatataaactgaatgtaaggcttcttgcctgaaccagtataaaatccttgtctctgtcttttttacctcgatctcgtgtataccccagcaccatcgtagtcaggatctacaacgtcgacaatatattagtccaaataattctagaaaattattacatacaaaatatgactgtttctacgaaaacatatgctaagagttgtatcacaaattcaatttgatttgataagtcactactagaaaaagggtaatcacaggcggtcaaaatcgattttcgctggtggctgaccgcgccacttgcaactaaaggtcagtgaaaatagagtatttttacaagcggagattagccgcctacggaaatagattttcgttggtggttcgcaggcggctaagttatattgtccgactacaaaaaatatttcaatctcggctgaccgctaaaatccttggccaatcgtacaatccagcctaaaattttgcaaacaaaactgaatccaaaccaaaatcgatttttcagctcaatttcacagcaaaaaaaaccaatcaaacgagctcgccacagtcgtcgtcgccgttgccaggtagaagctacctcaccgcattgccgttgccgagatgaagccctagccgtggtcgtccttgccgtcgccaagccgaagcttgctagcggtaggttcgccactcctgggctcgtcgtaggaggatccgcctctccgcctcgcctgagctcgattgtcgtccaagccacgccggatctaggagaagagagagaagggaggggagcggagaagttagcagatctggaccgagccacctctccctccactacaccatcgcccacgccaagaccctccactattcccttcgccgccgtctccgtcgagccaagagggagaagcgattgccaccgccgagccgtgctcctgtcccctctcctccctccaccgtgctgcgcttgtcccgagccgccttaccgccccttctactgccctcgcccccactgccaacaccctttgctccttggctgagagtgatggagggagagagggaggaccagagacatgagaaagagctagctcgagctcagttgtgccacgtggctttaatagcgctactaccttttttgcgagcggacctctttatgtcccgcctgtaaaaaaagggacttaaagaggtcctcctatggaaataaaggtattttcgcatgtaaaaattgatttttacagacggggctagatctatggtgcttcttcttattttcacaagcgggattttttttaatttgcctgaaaatgtaaaacatatgtgtcaggaaaaatctttttttgaaaaagtagtgagtatgttgtacatgtaaagtacaattatacctatggatcggaatcagaacaaagagtttttcaaattcatttcatttaaaataataataaacatgtaagataatatttgctttaaaaaaagaaacgtcaagtccaactgcaaatgctttttagtcgatacataagataaattaaatcgagtttatggttatatactaggaataataatattgcgagacatgcggtatatatttttatgacatcaatgtttcagcattttttttcacataagtatttaattagttggcattttaagaagcgaggggcattatatacatatattattctgtatatataacctgtgctgtcaagtactgttcaaacccgcatccgtacgtatatgccctatataacacgtgcagcctccacatccgcaatgcaaggcaggcagtagccatcaacagcttagctatcggcaagcacatctagtcatagtgaccatgaccccgtttgtagcagcactggttgtgcttttcgtcctctctagctccattaatcttgttgctcatggcggagacgctgaacccggcgcctatatggtcatagcaaccagctccatgaaaccaaaagcttcctgctctggccacaagggtataatttcttctatatactacctccattttttaatagatgacgccgttgactttttctcacatgtttgaccattcatcttatttaaaaaatttacgtaattataatttattttgttatgagttgttttattactcatagtattttaagtgtgatttatatcttatatatttgcaaaaaaaaatttgaataagacgaatggtcaaacatgtgagaaaaagtcaacggcgtcatctattaaaaaactgaggaagtatatatgatgaagctgaaatgtgcaaatttttgtacaaattcctgttcctgagagcatcttaaatattaatttttcaaagttctcataataaacatatagtatatagtgtgtgtgtgtctatatatatatatatatatatatatatatatatatatatatatatatatatagtgaatctattctgcacccctcctctagaataactattctacacccccccctctcccatgggccaatcccacctcccccacccttcatagggcccaaatcccccctcccacctcagtcaaaggctggtcaaagccccctcccgccggtcaaacccgtccattgactccctcccccgcccaccactgtgttgtcctcgtctcacaggaattctgcagtaacggaacggtcatcgtgcagtaacaggacaactttctcacagtaacgacatcaaaaaatagtcatgatggatctagttttgttgagcacttttttacgaatattatggtgcagacggattagaaaaataatatataaagtgagagatattgctctctaaagattgatatttactttttttttagttctcgtctcgctggaacggcgtaataacgcgacagtcaatatatagtaacacggctactttccgcagtaacaacgttataaaatagtcatgatggatctagtttcgttaagcatgttgtctcgattatcgtgtagtaacaagactattgtattattgtttaaagattagattataatagtttacttgtactaagcttgctactatgtatctttatatgaacgaagaaaagtacttttagcactttgtgttaacttgtgactatgcatatgcacatgtatttttagcacttgtattttgcacaagattgagatttaataatttagctatgcacaagtagtggtattgtagtagtaccattaataacatatgttctctgttactacagtttcatcatgatgttactgtaaaaaccgcagtaacaacctataaatttcgcagtaataacctataaatttcgcagtaacgtaccgtgttactgcacttctgcgataatattactaccaaatcatagtaacaaggtacgattcctatagtaatataactggtttgttctcataaaatttatatagaggtagaaagcaagcaagcgataacccctaatcacatagtgttattgggtaaattggttaggagagcttattataaactatggggtcatgtgttcaagtcttgattttgctattttaatttttagttttctttttaaggtgaagcaaaggaagggaaagagaatagaccttgggaggagggaaaatatgagataaaaaaagaagagatcgatcaagcgccgggaggaggtcccggtggaaaaattggaggaaaaaaaa

SEQ ID NO: 13684 - DNA, 27857 bp, Oryza sativa
agtaacgaaccgtcggttaacagcacttgggcaccgggccatgctcgccggcgtattcggacacggacaacagcaccaccgacgacgatgtggcctccatgggcaaggcgctcgacgccgaccaactccgcgtcgcctatatccagaagaggctcgctggcgacaccggcgacggcgcggatccacataagtttgttgagggtggagacactcatgtggtaagtagcctccaggtcgctactggtgctggcattggccaaaagccccatctaactgtaagccccatctccttgctcgatactcctatatatatataacaaatatctcatcatcctgtatatgtgaatgaatttatagtactacgtatatttttatgtacttcaattctctactattatacatatataagttgattgatttgttattatagacgacgaggttaggaacgacggcgacgactaattcggcaccggatggcacgtcggcggtgagccagacggtgatcatcgactcgggcagcgacgtgccatgggtgcaatgccagccatgcccgctgctggtgtgccacccgcagcgggaccccctgttcgacccggccacctcgaccacgtacgccgccgtcccttgcagctccgccgcctgcgcgcggctcggcccctaccgccgcggctgcttggccaactcgcagtgccagttcggcatcacctacgccaacggcgcgacggcgaccgggacgtatagctccgacgacctcacactgggcccctacgacgtcgtcaggggcttcctcttcggctgcgcgcacgccgaccagggaagcaccttcagctacgacgtcgccggaaccctggctctcggcggcggctcacagtctttcgtgcagcagacggcgagtcagtacagcagggtgttctctactgcgtcccgccgtcgacgagctccttcgggttcatcatgttcggcgtgccgccgcagcgcgccgcgctcgtcccgaccttcgtctccacgccgttgctgagcagcagcaccatgtcgccgacgttctacagggtgctcctccgctccatcatcgtggcgggacgcccgctccccgtgccgcccactgtcttctccgccagctctgtgatcgactccgccaccgtcatctcgcggattccgccgacggcgtaccaggcgctgcgcgcggcgtttaggagcgcgatgaccatgtaccggccggcgccgccggtgtccatcctcgacacgtgctacgacttttctggcgtccgcagcatcaccctgcccagcatcgccctggtgttcgacggcggggccaccgtcaacctcgacgcggcggggatcctgctccaaggctgcctcgccttcgcgcccaccgccagcgaccgcatgccagggttcatcggtaacgttcagcagcgcacgctcgaggtggtgtacgacgtccccggcaaggccattcgattccggagcgccgcctgctaaattaatttgcttgcttgccaaactagcttggtttattaattagcttggttgatgaaataattagtcaatttaatcgctgtttatcttctcatgacatgtttatcctacagtactagtagagcatctatgatctctatggaaagggattaaagtagctggcttgcagcatgcattgtctgctaaagtttaggctagctagcaaagctcttttgtttatgttgtctgcaataattagttaattatcttgatgtcatttgtgctcgtgtgagattgtaatatcgagttatgtccatcttatcaagtcatgtactacttttcccatatctatagcctttttacatgatttgttcactgtttgtgcgcccacatttaactactctcctttttttaggttttaatgtgtgatgtcattaatttttaacgtacatctgaccatttttattatttaaaagtttaggtaaaatatatatgttatgtttaaagtaattttaatgataaaataaataaaatgaatgaaataacataatttattaatgatgaattttgctacatgacatttaaaattcatgtaatttgccgacaaacatcgtaaaaaccgtatcacgacacaagtacaactaataatttgctgaggacatttttggcctaattagagagagaaattaataaaaagataagaaatgaccaaacatgcatgtcctcaaaattgaaggtgtcatgcattattaaaaatcagagaaagtattaataacataaataatcaaacatgtctctaaaagtaaatgtgtcatgcattaaaaatccgagggatcagtatcttagtgtcggtttagccggcctaggatcctgaattcagacagtgctcgtctttatacgcctttatatgaccagctttggtgctccacaccctttaaaattcgtccaaataaaatgtatgtatatggaccaacatacaaaagaggatcacactccgtctctttctgcgaaaagcgaaaaaacgtgcacatccatggctcaacgataaaccaactcgctttcatatgcttatagctagtattggagagctgcacttaacactgtatctctatctcaccatttttacggctatgattgatcaagctttatgcaagaatatgatattaagttccttcttaattagtatcctcttaggtagtagccgcatacgataatgcattatcgcatgcaatccaccaaccggtttcctgtccatcaactgaccccccaggggaccgatttttgctggcgctggtatttatggcccgcctgcaatctaatggggtctcatctgaaaaaataatttctgtagcagtgagttatcatgctatctgtctggagtatttagattacatcgaaaacaagcagtgaactttttccttttgtgggtgaaactatcagccggccgcaaggtgtgaactgaacagatttaattttatataatatatgttattttcacacatttaaatgtcaaatttaaagaacttgcgaattataaacatttaaaacacatgtggcctgtatggtggtagctaggcatattattaacaaattaaagcaaccactcagtagtacatgttgcagatcatacatatatgtttggatcatacatatttgtagtttggtacagagataaaccacctgatctctgtcttgcagatgtactttaaaaggatactcccttcgtgtcatattgtaagacattttggttttaaatagattcatctattaatcaatgcatatgttttgtatatgtgtctagatttattaacatctttatgaatttagaaaatgctagaaagtcttacattatgtaacggaggaaatattttttttgttagttagcttaattatcatttataggaaatcaatgccatttaaaagggccaaataattcaaactttcagccaactgtttcaccatgaagctctgcagtacataattaatctcaaggtgggcaaatagtttttggacatatgatgtttctgctcgccttttctgcattatattgctgaataatactatctccaacaataatacccttaacaggagacccattggacggtatgcgtcgcctgcggcaaaagggtcatgcacctatttcttgccttctccaacagcgaacgcaaatggaaaccctgcaatgcagacagtttccttcgcgggcccgcgatgaaatttttacgcgggaaacggagggtgtcgtgcgagatataccgggcgcggggcgcgggactgtggggttggctcgatggcaggattgttttgccgccccggctgcatgtgagaagggagtctcagtggcagcgaggtagccgccggcgagcgaccgttcggacaaggccgaacgttggcgcagcagagtcaatcagaacacaggtaatctgatttctagcatttgcttgttcgatgtcacattcccttttaatttgtggctaatttgtccctaaattggcttggctttagacctgcacttccgttgtggtggccatggcttggagttacgtcaaaatgtcaatgttcgggacagccgcagcatactccgaggacgatgagatcatggccgcagtggtcatcctcacccagacgccacgaaaacgcccttggggaggttcagtccctggtcacaagacttacaagcgtgatcgaattgcagcagactggcaattgaatcaggactacttcgttgaacgtccactgtacaatgaagaacatttcaggagaaggtagaatctttggcccagtttccattttcatgaaatatttgtgttgaaggaaatgccaacattttcatgatcaattgtatattgctcactattcttgcagatatattgaattaatttgataaacaactgtaattttgggttgtaggtttcgcatgagacgggaattgttccttcgaatagtggatgaggtcacagccaagaacaggttcttcacacagaggagaaatgctgctgggcagttaggattctctgctcttcacaagtgcacggtggctctaaagatgctagcatatgttggaccggctgatgagttggatgatcatttgaaaatgggagaaagtactgtcctgaagaccctgatggaatttgttatgactatgatcaaggtgtttggcaaagaatttcttcgtcctcccaggagtgaggagatagagcacatattaagcatcaatttggccagaggttttccgggaatgataggtagcattgattgcatgcactgggaatggtctagctgcccgactggttggcaaggcatgtacagagggcacaaaggcaagccaactctaatacttgaggtagtggcgaccgaggatcttaggatttggcatgcttactttggtttaccagggtctcacaatgacattaacattttgcatcgttccaatgtgtttgatgatgtggctaaagggagggcaccctctgttgagttccatatcaatgacaacatctattcccttggatactacctagcagatggcatctatcccgattgggctacactagtgaaaagcattgctttgccagttagcaacaaacaaaaggtattttcagagcaacaggagtcgtgtagaaaggatgtggagagagctttcggtgtcctgcaggctaagtggaaaatcttgcataggccagctcgtttatggagtccaaaagtacttaattccatcatgcgtgcttgtgtcatacttcacaacatggtagttgaagatgagcgtggggttcagctacctactgtccatccatcagaatggcctggagtgtccgacccacctattaaccaggatagggaaatcccggcaattgaaaaacttgttgatgctcaaaacatcattcaggacagagagacagcagcattgcttcaaaatgacttgatggaacacatgtggatgctatatggccaatgctctggtccctttgctgcaaatcacaggaactagtctttagttgtaggcttagtttttttgctgcctactcataagacctttgtattttgttggctgctcacatgaactatagtggctgaaagatattttgttgcctgttggtaagaaatatatgacattttgttgttgataagaaatatatgacattttgttgctgaaatgaacaattgtcactacatgaacagacacacatcactccaatagataatagtcactacatgaacagacacacatcactccaatagataatagtcactacatgaacagacacacatcactccaatagataatagtacaaagttgcacacaatagaaaagttcaactcaagcgaaccaagttggacatatattcaacacacacgctccttagtctccgttgttcaagggactactgaatcctctgcgctccatgatttgtcgttgcatgcctagataatagttcttcagataaggggggaccttctcaatgtcaatggacataatactagactcagctgacatcagttgagcctcagtctgcttctccctaatctcattttccttcttgtgctgcttcacactcatcttcatatgcttcttctgaaggttgaaaagatccctctgaattttaatttttccgtccttcctactaaggatttcaaccatctgctggtcttgcttcagttcggtcttctctgatttctcctgcaaccgctggaggacttcaactgctgtactagatgatgatgtctctgcatagctcttcgatctacgcctcttcgcactatccctaccctcaggccgtgctgtgtctatattctcattcccagattctgcatggccggctacagtatggccttgagttgaaggaggttccattcgatcaggtgatgtagagttgtttagctcaagaaacttattgttccatttggcctcgttgtgaagtagtttccaacaatgcatgaaggtaaaaggttctgtcttctcgtacatttgtacaacatcatctatctgcaaatatgaatatagattaaaccttctatcaaaaataaatatagattaaaccggttagaaagtaaccatatgtaaattagatagatggaggataatatgagtgaaagtatacccgatcctgctcattttttccgctctcatttagcctatcaacggctgctttgtgcccacagaacttgtttcgctttctgaatcaatgcccacctgtgctgaatagcaatctggctacggttggacccttcaggtttgtgctcattgaaataatcatgcatcctcttgtaataaccacctgaagtttgattcacacctgcatgttatgccaccatgttatttgggcatcaaagaattcataaaagatgttgcaaatgattacctgtaatagcgtctttgctaatattcagaaatgccgaacacaccaccatgtcctcctctttggtgaatgcagttcctctcctggacaccttcttcttctttgcagccctctgtgatttcaatgatggagggtcctcagagccaatgttgttgtcaatggagaacccctggctaggttgctcatttataggtgggcatgacatttgggacgagccatgcatgttgaactagtgatgaaaaggactgttaatcatcgatgtattgatatgtaaataaagaaaatcatcatatgcatggctgcaataaacctgggggttcggaggaacatcaaaagaatgcaaagcggcagaaaaaccaaaagcccactgatttgtcccaaatatttcttcagattcaccagcgcgagcacttgagccaccaatacttttatccatcatcctattacaacagagattcaatcaaacatggcacaaacatgctggggaaggtgcggtcaacaaaaatttgagcggcgtcgctggggctaggcacagcatgcggcgcgatgcgcccttggccagggtgcgagcggccgcggccaaatccatgtccagagagaggagagatgggaccggggatgaaggagggtgggttggagagagatccatacctgcgaagtctagctcagagcagatctcgtcggcggcggagctttccctatcgccggggccaggtgcgctttcctcttctctccacctcccgcgaaacagttgcgccaggtgtttcggtcgaggagagagggcactcatatttgggttccgcctcggctagcacctaaaataggtccttagtatgggtactctgttggaccctgtttttttccgctacagtagcctggagcacgcattttgggtttgggtgtcgctatgcctagcctgttggagatagtctaatctatacttccacttgagattgcattgtgcatgcactgagccatctatccatgcttggacctgtactgataggaaaagcttctcttttttttttgaacaagtggcaatcttctaattagttctgatttctgaattaacttttatctcctctcattactgccatagaaagaacatacaaaagaaatagattggcctgatgctgtgctgcttgtttaatttcaaccatagaaacagaaatacaacattggcttattttcttctcctgtttctcaaaaatcttaataatgcagaaaaatattgcaactatcattgcaatagagaggcgattttgcaaccctttatttggcctagtatagttttaaaatataaatgcattactcatcaggtaaagttgctaatttaatttactccgccgtccccaccgcggcctcttactctaccttccccgccgtccccactgcggccgccgtcaccaccgccgaagccgccgttcccgccgcggccaccgtgacccccgcggccacctttcctgccgaggccgccgaccccgccgcaaccaccgtccccgccgctgccaccgataccgtgggggccgccatcccctccggggccaccctcgccgccgataccgccggggccaccctcctcgggcgccatctcggcgagccccaaagcggccgccagcgcctccactgccgccgcggccaccacggcctccgcgaccgcgccctcctggttggccgggctcaccaggttggccaggctcgccgggttggccgtccaccggagttggcgggcatggctgcgcttgatcgatcggcgtgagatgggtatcgtatttatgggattttctttgttttggtaatcaagtacgctcaatctttcctttcctttagtaataatgatatgtttcaaaatggaagggatcactagctcagtcttaatttcctttccaaattaaggctgatcctccgtctctgcgctccatcttcactaatctctacttctatgcttcatcgtaaaatacgccttcgaacttgcttgcgcacttctgctagcctgtctctgaagaacatatgctctcatttttaactttcaagtttcaattctgtactagaaatcatgtatatatcccgtgcatgttttatataaaagtaagcagtgcaaaaatcttctttcagatacagaatgaacaggtgatatgcactaactaaggttcaggcactagcggggaacccatcttttgtcctggtttgtaacccctttagtctcggttatgcaaccggtagttccggttaaaataaccagaactaaagatgcataacaagtaaaaaaaccaagacgctcaatacaggactaaagatgtgtgccagttaaaataactaggactaaagatgtctataccctaaagatgcataacaagtaaaaaaaccgggacactcaattcaggcctaaagatgtctatagtcccggttaaaataactaggactaaagatgcataccaagtcaaaaaatatagacaaaattccgtatctagcatcaaaaaaagttgctcttccctctatagcaactcttccctctattgcatccaaacttcaaaagttccctatctaggcaccctcaaaatttttcttccctgtttggcacttccgttagttttgagggtgacggtgttaactagcaggagaaaagacggttttgcccttttttaagtttttgagggtggcggctgggggcgacagctcaggcagcgtacctgcgggctcggcggcagcaagtggaggccggcgacaatggactcatctctcacagatgagcgcccgtcgttagtatggatggcgctgcagcacatcgtcgatggcgtggattgggggtggcagttgggagcagcggcgctggcggcgcacctacaggctcggtggctgcgagcggaggccggcggcaatggtgactagtctctcccagatgagcggccatcgttggcgaggacggcgccgcgacacatcgtcggcggcgtggttcgggggtggcggcttggagcggaggcggtgactacgagcagcggctcaggcggcgcacctgcaggctcggcagctgcgagcggacgccgttggcaatggcgacttgtctctcgcagacgagtggccgtcgttggcgagtacgacgctacagcacatcgtcagcgatggggttcgggggtcacggctggtagcagaggcgatggctgcgagcagcgacgtgcgacctcgctggcgccgcccaccacatgcgccgctgttagcattgccgcttaaaccgcgccgcctctccccgccagctccgcgttgccgtcaggacgcccaagaggcggccgacgagctcgaggtcctgctgccggctcgcgctgtcgaagtgtgacttcttgggctccatctccaacaaggacgtgtgggaggcagcgttgacagagaccgcatcagccggcacagcggtggcggcgccggcgaggtcgcgcgtcaccacttgagctctctcctcttgcgcttggtcgagcactgtaatgggtcacgagagcaagagctacagggccgagtaagcctggggctggctgcccgtgctggtctcttgatggtgggtccatgtctcttgttttgacggtggaggctaaccggagtaacagaaatgccagatagggaagaaaaattttgagggtgtctaggtagtgaattttttaagtttagatgctatagagggaagagcaactttttctgatgctacatagggaattttctcaaaaatatatgtgagatgtgggatttgaactcaagatctctcacctcagtcctcacatgcgtttgttaatgaccaaatttggtaattcaagtatcggagctagagataaaatcgaagcgaaatccaagggataagttgtttcggaaacagagtaaggatcggctgaagtccgaatcggctatggtcaagatcggcagagtttgagttggacaaggttagccgattaagccgattttggtaatatgacttggtacacgtcatcgggttaagacaaggtgcttcatatggattgccacgcacggattgagtcccagaaaggcaattgtatctattaattaggatattttatgttatttccttagagatatgtttgggcaagagtctgccgtaaagacttgtggtgtcttagagttgtaatagagttaggagtcgtgtccggcaaggacatactatgtatctcgggtataaatatagcccgaggaccatgtaaaaaacaacacacgttcaatacaacttcggcgcatcgccaccctttttactttcattctatttcgacgagttcttgctttcgggtcgagatgcatcaatttgatcttcaaccagaggtatacttgtcatggcggcttgcgttctcgggattagtgcttccatctttataacactctaattctgtttatgtaaatcgtcgagttatcatatatgcgttataatctctattaatcgcactatataacttgttatcggctgattcttgttgttaggaaacaatcggtagagttatattttgctatcgatctagattatatcgtgtatccaccatctcttacatattctcatcatcttgcttacatcttgcgcttgtctttatgcttaatgctgcatcggttgagtttgatctattaagtaatatctataatcatgatatctagtttgttttatgtttatctagggagatagcatcggggtttcagccgatcttacctaatttaactactttatatccttatatgcttgattgatatattaaatatgccctttatgttaagatcttattgcaataaagtatattagacttctgtttgatatattctagctgttttaatatcttaatatagagtagtattggagtattagccgttacatactagatctatctgatcggctatgctatagacgtttataatctttatgttaatgtatacttcgatctaagtgatttatactgtctcggcatggcgaccgatctatcccaatcacttgatttaaatatacatcgacagaagaattatatatcgttaatatctacagccgatcgagtagatttagttctgtcttgcttatttataattgccaatcgattcaaatatgacatcggctggaagataaatgatatgtcatcagcgactggccgatcggctatcatttatggatttaaccacgattttcctgtctttatttcttgttgattgcaggatcaaatcaactggaacgctcacgaacctaaaggcaagatttttggacctgcactgaagttaagcagatcttccaggccagtgtatgtttttcacagccgattgcctttatatcattatctacatatagctgattgctcaaaaccctatcggcatcggctggaattggaatcggctaatatcggctatcggctggaattactccatcggcttgtcagccgatcggctgttttatctgctgtttgcatatcttgtcagttgcaggatcaaactgactggcacgtccgcatctcatcaaccttttggaccagcactggagctaagcagatctcctagggcggcgtgttcgattttttcgtcaacacaaattggcacacctggtaggaccacgaattttatatccacatgtctgaagaagaagtcaatgccaagatcatggtcacagtggagaatttaacggaggaacagaggcaacagatggagcagtttgtagttgattttcaaatgcgttgtcttcaatgtttcaacatgacactagaagggccaactcagaagactcgattccccaagccgatagttgaaatacttcaagatacagttgatgaagcaattcatcgcgcgcattgtttaatcaatctggagttttggcagatacaatacaaagtttgatcaaggtaacagttgatgagttaattattcagaaaagccagctcggggggcagattgcagaacaacaacaatatcggctcggggggcaaacatatcagtatcaacatgatgagccatatcaatatcggccagaagaacttcatcaatatgggcatcaatataacaatgatttggccgatagaattgcaaaattagtagaggagcagtttggaatgagacctaaggaacagatccatatgtatcggcagccatatcctgagtggttcgatagagttccacttctgcaccgatacaagattccagatttctccatgttttcagggcaagatgatgtatctacaaaggaacacatcagccaattcttagcacaatgtggggaggcatcggctgaagaggctccgaaagttagattttttccattgtctttgactggatcggccttcacatggttttcatcactactatcgaattctatcggagaatgggccgatcttgagaagcaatttcatgactacttttttgctggcatcaatgagatgaagctttcagatttgatatcagttcagcagcaagaagaagaatcggctatagtatatatccaaagatttcgtgatgttcacagccgatgttattgtttgagtctaagtgatgagcagctcgcagatcttgcattccaagggttgtcagcacctatcagagatagattattttgccacgagtttgatggcctggctcatctaatgcagacggtatcagctcatgaaagtcgattgcaagaagcaaaagaagatcagttttggagttatcaagatcagacagaacagaattttggagcatgagtcatcacactccaaaactggggggcatgtgttaacgccaaaatttggtaagcccaaggtcatcatcggcttagagtaactatcggcttcagcatctcgaaatcagccgatgggagttatcaagtcgccaatagtcggattcctgctatattcggttaaggaaattaatctactaaaggaagcttatccataagcaactgagttcaaagaggatgcggcatggcagtttatctattaattaggaataatttgttagtttccttttatctttaggaaagtgtgtttagtgtccgataaggactttatgttttctttttatctttagaaaagttcatttcttgtcctacaaggactagtatctacccatgggtataaatatgtacacccggggtcattgtaatcaatctctcgatcaataatactctcggcgcatcgccaccctctttaccgaggtttttacttatcatccggcggaacttggcacctgacgcggggctgcatcggctttcgatctccggcgaaggggtaagtcctacgttccaccggtcctggtgaatctatcggctacattggtgttgtttaaggctgcatcacttcgatctcttggatcgctctggtttggttgatatatttgcctacctgatatcttaattctatctctaattgcattgtgtttagagacacatcggtttagttgggactatctcggttaggtccgatcttctgtcttagccgatatatctctacaatcacaatgctgttctaaatagatttgttatatccatcacattagacagatctatcggcttatcgagtattagattatcatatacaaatctcgtgctgcatcggttaggttcgacctactagattgttattgataatataaatcttgttaagccgataggttcatgctactgttttattggggtgctagccgataagttatctggacgttgcatcggcttataaggattgcatatatatataagttggatttagccgatgacaacaaaggtttcactgtttatctaatcttgtggattttatgacatcggacctccagccgatatatatttcaaccttcggatcagcgcttattatattatatcatgttgttagccgattggtttatactggattatattattgttatatcatattatcaacagccgattgcctttatatcattatctacattggacatatagccgattgcttaaaaccctatcgacatcggctggtatcggcatcggctggaattactccatcggcttgtcagccgatcgtctcattgatctactatctgcatatcttgtcagttgcagggtcaaactgactggcacgcctgcatctcaccaacctttggacctgcactggagctaagcagatctcccagactagtgtgtgtttttcgcgtcaacacaaatacaacaaacaccaaaaatagcattgtagcgaatttccacagcttaacaatggcatcggagcgaatcccatttttacgatggcatttcagcgaagtctatttctaacgatggcacatatacaaatttgcatatgtgtcatcgttataaacaggctttgctacaatgccatcgttcaaatgggattcgctcgaataccactgtcaacccgtgggcgttcgctagaatgccattttcactatttgttgcatttccaaaacattttccctcaaaatatatttttctcagaccgttttgcccctaggagtcgtgcttttctctctctgtggctccaacgcgaacagatcgagcgagagggagaatggccaccgccggcgctggcgccgcccaacgcacgaggccgccgccgccgctgccctcaaaccgagcgctgccagcctgccggcgccgccgcccgactcacgcgcgcgctgtcggcctaccgctgcctttcccccatatgcgccgccgcattctttccccaaccgcgccggcgccgcagcctccccccgcccagcatccattcctctgggtcgtctcctcaacagccgctggcgccgccgcattctttccccatcaagaatcatcatcattcctcagccaagcagtgacttctttgagcgctcaacgttaagaatcatcatcatccgactctgaggaatctccagaaagagttaacagcatcgcagaagctccatcaacaaagaccgcttcacggtctttacttgaggcttgtgcaggaaaaggtatcagagaattccaacccaaaagccatgcaccggcctcacaactacagattgggattcaacgtaccccctttccaagatcagctgttgcaaaaccaaagcatgcatgtactgttgttgctgttgcggcggcgcggataggggagaaggcagcggcgcgcacgtgcgtcgggcggcggcggcggcgcgcgcgcgtcggctgtcggtggcaatgcacgcgtgcgtcgggcggcagcgtcgacgtggtcggcgtggtgtcgctgtcttcgcccttctctccctctcgctctatgtggtcgcagacgccagtgtgagagcatctccaacagcatggctatctcactctccaagctaaaatttagcaattttggataaaaaacagactccaacaaattggctatctcactctccaagctatttggctggccagactgggttcctcgctggccaaacttggccagccaaaatcggatggccaaccgtggggcccacaccgtttctcttccccgtatccctttctctgcacacttcgatgccgccccatccccttccactgcattgccggcgtctcctctccctgactcccctaccgtcccccttccgccatcgcctgtcggtgaggcggcacctccccggcccgcgcggcccgccagagcagagggagcaggaggaccggagctcaacagagtcggcgaccaccagatcttgagctcgagcttgtcccttcctttcgttgctctgcctggtagaggaatggcggccttggagcggtggcgacggacggggacagagcaacgagatggagcctacctcggatacacgtcaggactcaggacaagaacccaccaccattagcatctgacagatacctcactgaagaaaacaaagatcaatttgtcacgatgtactcattgactgcacacgattaattatgctcagcgcggaagcaacaatgagaacgacgatgacgcccctctgtgcagcggcggcgacacatcccagctcccgtacggcggtgacagagagttgaggacccgctaccgcccttccagtattctcgcccttcatcttcgccatctcccgctgttcgtccgtgcaacattgaggatcggaggtcggaagcaaggtcgagaggcggaggagaagcgccggtggggcggcacgacggcgagcatcgccaaggcctcccgctcgcggccaccggcgtcgagggcatgaagggagtggcagcggcaaggtgttgtcggcgctgtctcctccgcgccagccgcctccgaccctggccgcatccgacgcggccgccctcatcggccatccagcattgccccctccacctccgctccacgggttgtcgtcgaggtcgtcgtagagagccgccgccgccgtcgccagcctctgcgtgctcaccgtcgtgcgggaagagcgctgagaggagaagaagaggaagagaaaaaggaggaagatggtgtaggagagactgacgtgtgggtcccagtgtcataagcttataatagagagtgtagatggagaggctgttggagcgaggaatgagtttggcttgacaaatcaattggagagctagttatatgggtgtttggagagtccgatttagagaggctgttggagatgctctgagaaacgcatatgtggatggtcttaaccacatccacgcccaggggtaaaaccgtcccaaaaaattatttcgataaaaaatattttgcaaatacaacaaacaccaaaaatagcattgtagcgaatgcccacagcttaacagtggcattggagcgaatccctttttacgatagcatttcagcgaagcctgtttctaacgatggcacgtatacaaatttgtctggctcaaaggcatatatacaaggcccactgccagccagagcacagctgtagcagaatcctagaaaattcagcccaatccagccgcagcccagggacttgttcacctgggcctaaatgcctaatcaccatacaaaaatcgaataaagcagactgaatctctctctgtgtgtgctcagccagcttgctagatcacctacctaccaattcgaacaaaagcatccattatttgatcgatcgatcaattagctcgatctccattaacaagttgttgatgcatcgatccatgtttacatccattgattaatttaattagctgcaagagcaagaacatcatatctgctagctcgtcgtcgcaatcaacgatggactacttcaacgggacggacgcgcactgcggcggcgccgtcggcgccatgggctcctacgtctacaacctcacctcctcctacgccgaccagaagaacgaggtctccatcgtcgccacctccctcaccatgctcctcctcgccgccctcctcctcgccttcgacctcctcgccggcgccgccacgctgcgccccgccgcgcgcctcgtcctctccgtctccctcgccctcttcctccccgtcacctcctacctcttctccgaggccaagaacgacgtccccggcgccggcgacgccaccgacgccgagctgcctctgcgtgcgcggctcattctcgcatggatgctgctcgtcgagctgctccgcaagaaggtggaggccacggtcaccggcactaagggcgccagtggcggcggccccaccagccgtgccggccgtgtcgccttcctcggttacctcgtcttcttcaacgtccacggcgccggccggaaggcggtgttcggcgcgctctgggtcgtcgccgctgccaagctggtgcagcgcgtcgcgattggtgagttcgttaagcgctccttcgccttcggcaagaatccgcagcttctcgccggctacatggcgcagacgctggagcagcaggagcggcgcccgcggcgagacgacgagctcatgacgagctgcaagtacgccgtcatgggagaggagaacctgcagagggaggccgggccgaacggctacctcgtcgacctgcgcaagacagtcgccggcgatgacgacgccgtcgtcaccgtgggcagagtgtggtcgctcgccgagagtgaccagctgctggtgtccaacccgaagctgaagcggctctgcctctcctacgctctcttcaagctgcttcgccgcgagttcgaagagacgccgttgaccgccgcggaggccggcgactgccgtgagctcatcttccgaggcctgtgcaacgacggcggcgccgcgacggcggcggcgacgctgttcgaggtgatcgacgacgagctcgggttcgtcaccgagtactaccactccgtcctccctgtgatgctcgcgagccccttcttcctcctcgtcaactacatcgtcttccccgtcctcgtgctcggcctctgcctcatgaccgtcgtgctctgcggcaacggctacatcgccttcatcgccggcagcatcaagagggacaactacgccgtgtcgttcggcttgctgaggatgacgaggtgcctcctgagcagagtactccggtcgccgtcgcgctcttctcctccattgacctctccatcacgttcctcctcttcctcaccatcctctacgaggaggcgtgggagctcgccgtcttcctcctctccaactggctcaccgtctccatggtctgcgactacgccgtcaagccgccgagccggctccgccgcgccgccatccgcggcgtccagtgggtgacgaacaggatgagccgccgcaattacctccgtgtcaagcagtactccgtgctctggttctgcaggctcccgctgaagctgccggcggcggccgtgccggaggaggcgaagcaatccatcgtggagtacctcgcggcgtacgacggcgccgtcgccccgctcagcgccggcaggtcggcggtggcggcgaggaacgccctgtgcaacgcgtcccggctgatctcgtcggcatgcgagagcggcagcgtcgccgaggtgatactcacatggcacatcgccaccagcctcctggaggtgaggtgcccgccgcacgcggaggaggaggcggcggcggcggcgaggtcgagcacggtggcgacgcggctgtcccgctactgcgcctacctggtggcgttccgccgggagatgctccccgacgacgtcgactgcacggcgcgggtgtacggcgccatgaccacggagctcaagcgggagctgggtctcaagggctactacttctcgacggacgccacccggtacgggaagatgatggctatcgccggcggccaagaagacgacgaggcggcggcggaggagacgacggtggtgcgcaagggggcgaggctggggaaggcgctgatggacgaggcggccggcggcgacgaggcggcggtgtggaagctggtggccgacgtgtggacggagatcgtcgtgtacgtggcgccggcgagggacgccgagcaggtgagggcgcacggcgaggcgctggcgcgcggcggcgagttcgtcaccgtgctctgggcgctcgtcacgcacaccggcattgcccgccccgccgccgcgtcggtgtgatcgcggcatcgatcggatggtgattgaggatactgatggttggagtggtacagtaaagattggtttgcatgcatggattggctaatttttggattgattgattgttaatcacttcattatgattaatttgcatcccaatggattggtgtaacatcatatatctgtgtgttgatgcatgtgatatatacatacatacatgatgtgtgttactgtgttttttttcatgtaaagatcatgttgtgtatgttccgaaaagccatcaaaatgtttgaaaaaaaaacaagataagccaatatttgatatatgctcaacaaacctataaatttaaatttaacttatacacattattcacagttttttgtacttgtattgtaggttgaatttgaatttgcatgtttgtgtaatgaaatatatctatcattctattttaaaaaaaaaacaaatagtgactatttaataacctagaaaaatgagaggatactctaagggatgaaatgagttttcccatgttatatgttgatgatacgtacatataaatgcgtgtgttttaatggaattgatttacatttgtacacatggaatggagttactagtcacactacaattcgtacaaatgtagacattacacatcatcgatcaacccatgcattacaccaaacatgttattgatgttatacatattaaaatttcaatcatatttgcaaaatatgaggtagcgtcacaaacggttcagaccagacctcgcaatataccaatcacacaacccaaaatcaaaccatatgcacacgcatatacaacacaaacacatgaaatcagccatggcaatcaatgggcgtagacgaagcggtggcggcggcgctcttgttgtcggcgacgacgaagtagacgtcgctgcaggacaccctgacgttgtacggcctggtgtacaccacgccggcgaccttgaaccgcacctgcgccgccaccgccacgttgaatggcccgtgtggatattatgggtaccccatacccatacggcatggttatccgactagtcataggggataacttatatctatggaatatgtaatagatcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgacacaacctgatcgtcagatcaatacacactcggcggattcaaatccccaaacaggagtagggtattacctctcattgagagggcctgaacctgtctaaatcctttgtctccgcatccatccacttttaggtctcgtgcgctacccccttttattattgccgaattcatgtttcgacagttggcgcgccaggtaggggtaaacgccgagtttcctgacgacgagtgcgatggaatcaactttatgagtcgccggcttcgtcttcactttgggagctccttgattcctcgccgccgacgacttcaacaagacgaatcgtcgctgctattctctgcctgatcttgttcgcatcagcacgacggcaacgatggggcaacgacagttcgacggatttgatggtcgtcctcgtccaccaccaagcctactggtccaatctacccaacgaggatgccatggtgttgcaagatggatctacaaacacgaagcatgccaaaaccgatctaatcggatccataggagacggctgcagccacgccgatgccttcctgccgtcctgcgtcgtgctgatggacaccaacgccgcccgcgactgcgacctccgcctcctccgctccgtctcggagtcagtcgaagagatcaatctcggcgagttttttccttttaatctccgacttcgccgggttttttccttttcaacttattgttgtttattagattgatctctaaatgtcagattaatctctcttggtattttctgctgtttgcatgtaacgccgcggcactactcttgccgactggtgtttccgtctgcatggctggcctattaagtcgccgccgactggtgtcttcattgttattgatggacgactttgttcccacattggccacttctgccatcaccaaggggaatattacaaagctaagtcatcatttattttattctttatatgatattttgtcttttccttcgcctcactacatcaactggttcgccgttgactagtgagtcgggggctatagatgttatatcgtattttttaaataattttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgccaagtattattcggaataaatcaaaagcatagagatgagataaatttattttctgctcttaataattgcaaaagtacccgagtagtaaactccgatccgtgaaactttgttccattaatgacgaactcatgtcactcatatgcatgtttgggaagtgcttaggccgactcccagtgcttggtggctatgactagtcgggcagagtgtttaaacgtaatgagtcatctgctcggggaaatcaaaattaacaagagaagaaatacatattttaaaatacttgattttttctcgagtattatatttatattagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacgtcatcaccaccggctcgcctcgaccgccgccgactggtgttttcgcctgcacggctggcctattatgctgccgttgttgggcgtctatgtcttcaccgaccggccgccgcatccgctgctgactggtgtcaccgcctgtacggctggcctgttataacgccaactgatgctatcttcttcacggctggctacatcgctgtcactactaataggcatcagtatcttcaacacaagctgcctacgtttgccatggctgccgactggtttctgcacttccatggctgcatgattctgccagtgttgattggccttaccatcttcatccctggtcgtctcgtctgctgctgactagtgccctcgcctctacatctggtttatacagctaccactactgatggacatcatcgtcttccgccgccgactcgtgttatgccgccgccgactggtgcttttatcttcacaactgcgcgtcttcactaccggtttgcttctgttgccgccgacttatgttcacttcattacggcaatacaactttgtcatcatggtggagcgacttcatctttattatcttcggcaccggcaaactctattattgctacttcgcaagttttactacttcaccaaccacgacgttgttgtgaatctcgacatctcggcatgcgatgccgtgttattttactacaacaagtggctctccaacattcatgatttctacttggacatcttcaacacatatcttcaatcaagcaataactactcgacgacaagaagctataattctcgactctatgttcagttgtttcccaactaaccaaagagtcgggggctacacaaatacaaggctcaaaattaatttgacatcaactctcctccaagtgaagcatctacaacagccataacattaatttgatggattattgtcactgacatcatcaccagcacctctgcttcatcggccctgacatctctgctgttgctaatggatgattatgttttcgccgacttattatttcaccttcacggttgacctactatgcaaatgctgatgagcgtctttgtcattatcattggttgctacactgctattggctggatcaccgacatcgtcatcttcatcatgtcggttgcgtttgtcgtcgtcaagtattttcttcatcttcatgattggtggatttcgccatcaccgttgatgcgcgtctacgtcttcatcgtcggtttgcttttgtcaccaccgactgttctttcgttgttgttgggcgcctacatcttcactgctagctgacctggctgtagccgactggtttcttcgcctccatggttatgcaacttcattacctttgattggtgtcattgtttttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgtttcggatacattccacatggattcatagtcatgagtctattttctatgctcaaagactggaccaattatttttccccgtaagggctatcaaccgaatacttgcgccagtcgggattcaattattatatttattttggagtatcccataagggataatcattcagatcagaagctattcatatgagctacacttggtctatattacccagaagatttgttactcgggagcatgtcacatgcgtcatcctttaaagggtgtcgaaggcatattttttggcctaagcctaatatgtctgcagcccatattttcaggtgtggcctgtcacgttcttttagggacttaggcactttttgcttaggccaaagtgcgcgtgatcaagtgcccaataccttaaaatccttttataccgcagttacttaattttttaggagttggtacaatgcatcttaaaaggtgtcaaacagtaaagctttatatagctgtcccgctgacttttttatatataagtcaaggtgctgtttgggtttttaagcaattgattagatacaatatcattgcttttcgccacgtaagtgtgcatttttattgaccaatattatggcttaggctgattatatattgtggtcattttctaggtggttggtaaatcctttatgagtttatttactcggattttacaccacatatgccatatatttccaggtgtggtgaaaccatgtgtcttctagggacttaagcacatctgttaaagcagtgtgcgcatggcgtatgcccaatactttggaaatttctttattcacaatatacaagcttctttatagctattttgctatatcactcatcatattttacaaagcagttggtatatcactcggatcatgttatttggaggattcacaccgcatatgctatatattgatatcaagtcacttgattgattacgattatcaaaaccactcggttggttggattatttattccttgactatatgcttggtttgttcaattaaccacattgtcgggggctgcacctattaggtgcatctagtcggtgcacctgactttattttccagccctccacagtcttcagatttggtaaaagtactcgggagaccatgacaaagatgattgaagcactcggctttggagtaatctggttcgagagaagattatcttttcgactgcgaaggtctcaggggctactgtggatattatgggtaccccatacccatacggcatggttatccgactagtcatagggaataacttatatctatggaatatgtaataggtcatgactcgggtattacgtttccttatatattacggaacagcctaaagtcctggtttgataatattgtaaagtagatttaggaaaccgataccgtattggttaaggtttctatcttgtaatcctgccccccaccctatataaggtgggcaggaggccctctagggggcatgacacaacctgatcgtcagatcaatacacactcggcggattcaaatccccaaacaggagtagggtattatctctcattgagagggcctgaatctgtctaaatcctttgtctccgcatccatccacttttaggtctcgtgcgctacccccttttattattgccgaattcatgtttcgacagcccggttctcctcccttcgccggcgacgatctcctgcacaaacctgtcgtccagcgtccgcgccgtcacctccacggccgtcgcgttgcgcggcggctgcaggagcagcgccgcctcgtcggcggcggcgaggccgacgaggaggaggctggtgttggtctcgatgtagtcggtggtgccgtaccagagcatgacgtccagcgcctcgtactccacggcggcgcgcccgctagggttgccggctaccagggtcaggttgaggaacgccgccttgttctcgtcagtggcgccgctcctcgcgtcggcgacggagaaggcgagcggcggcgggcggaggatgaacgaggcggcgatgacgagggcggtggcggcgatggctccgacgagagcaccgaggagacaccgcctcggatgaccatggatcttggccatggcgcccatcttgacacagctacgtgcatgagctgagctcaattcttgctagctaccaaatgtgcaagcgacgttgcatgcaactagaattaaaagacgccactggaccagcagctcatcagcctccatcagttgaatggattcgatcgaataaagttattaggcagttaatttgcattatttctgaattcagatcggaagcaggaacgctaatgtcagtaggaattatattcgaataaacttattattagctgttcgtataactaaactattaggaccatgcatgcatgcatgagatagcttaatgaacaatatttgtatctcagctgcgacatgtgagcagaataggttctttttttttcgccgggtcggagcagaataggttcttgcagctgcagaaacagctactagctagtgagtagcagattgcgttagctagtgggtgactctcaagtctcaatgggatcagcagtgacgatcgacgtgcacgctaccacagaatcgattttttttttataaaatccctttaggttgcaggtggtccatagctgctttcctatggaaaaatcgttccctcaaacacagttcaaaaatcacgtgtgaaaataaatctattttcgtaagacggcatgttcaaagccccgcctgccaccagctcatcagatcaagcttacccttaaaatatcaagtcctctctctctcttatactcatcctctccgctctccacccatcacttcctccacctcctccacttccgctcctcctcctcctcctctctccttcggtggcggacgggatcaggagcggccgacaacaggcgagagcaggagcgaccggcaaccacttctgccggtggcaggcaggagcgggagtggcgagctcgggagcggccgacgaccactttctctggcggtggacgagagagggagcgagagtggtggggagctcggcggcgggcaggagcgagagcgcgggagggggggtgggagcccggcggcagcgggtttgatacggtggagcggatggtggcgatggatctagcagtgatgag

SEQ ID NO: 13685 - DNA, 13618 bp, Oryza sativa
cgcctacccatcccgcgcacatggatccaatgcatggttctagtggcggcgatgggagacggggatggcggcggcgatgacaacaaggatgaatctcgggctcaggagctgctagggttctagattttttttttgccgttttttctttttgcagcctgacgatttatgtacccacatgtgaaaatacaattttcggaagcggttgttctacccgcatgcaaaaatcgcagacacctggatgtaggcgggctaccccacccgcctacgaaaatcgattatgaccatatgaaaaaatcatttatgtagtagtgttatgttttttgaacgaatcgataagcgccaatttcattgaatagagtttaactttacaagaaagggagaattgctcttatgcccttacttttaaacccaattgtgattttactctcgctttttaggatttttaaatttacccctaatattttgaaatgaaatcaccatttacccctacaatgacagttaggtgggttccactatattgagttagagaattggaagtcatcaaaagagaaaattagtttaggaaatattagattaccgttctatccttaagcaatatcatactgattcattcatacctattcggtcagatttgttccccactgttcctatccgcaaacccttggggttggggaggagatagaggaggaggaggcggcgattcttccacacagcggccggtcctcggcacgagcaccaggaggcggcgccgcgggtggagaagctccggtcaatggtggcgctagcgacgcgagcagcagcgtggcaacaacgtaactcgtcggcgcggcggccctcgcgtcatcggcacgagcaccaggcgacggcggggcgggtggagaagctccgtccaatgatggcgcccggcgatgccagcaggcggcacgcggcggcgctggtggagaagtttctgtcgatggcactggcagcaccgacgacgtctcctcagcgagagcaccagctggttgctggtgaggcttttcttggacgaaaagctcacgcagaccgccgtcatggctgatgctatcgcgatctctagcctggagtaagacgcgccagaggtggtggactgactgacttcttcctaagtattttgcttctgtatcgtgtatagcatcagtactctgtagcatgtgtgggtttgatgcttgctgctaattaaccagcagattatgaatggatttaactgatgtgatatgcaggcatactttggttgatctcccgtttgccatttaagtcaaaaaaaatgttaaatttgtcatatttatcataatttgtcagaaatcagaatagatttgaaatattttgcatgaaatctcagttcataacaaatgcaaatgtcacgtacaaaataggagtaaaaaagagtagttcaaagtaggggcaaatatgcaatagcaagcaatgatataaaggtcttttcgcgcttgacataacaccgttaaactgaccatccaaaccagggacaaaacactacttcgttttaaaaaaaaaactgggacaaagacaaaaaccctaaaaagtatgagcaaaacaacaattaaattgtaaagtaaaggtaagaatgcaatagcccctaaaaaaagagggagcagagaagactgtaccgaaaaaaaaaacctaaaagcccactagcggcaaggtagacatgttgctaacttcctggtcccacaagggaccatgttgtggtctcctccttgattttactgactagcccgattgttgacagcttcgtgtgttggaagattcgttgttttttttctttcagatctcccaattgatcagtagtgttagggtgcgtattgcttgcttcaacacctctctcgtctttgcaatcgcctcccaccactcctgcactatagtggcttgcctccactttgtgcggtttagattgtgacatgaaacccaatccacaatttccccccaaattctcctagtgtatatgcactctgctagaggtgcagtcctctcttgcgtctgccatccctttgttgcgagtctgtcggatgtccagaccctgttttcgatcactagccaagtaaagatcttgcactttcatggcgctcagggtttccagatgagtacgtcaaagtccgattttgttgaggcaagaattgtgcattgtagatcgacgtcgtcttgtactcactgtggtttgtaagcttccaggtaattctgtcctcttcactctctatgagttgtacaatttgggtgatcatcttagttgtccagccaacaccggtcagtaggtcggggtcaaggaggcattgaccgttcctgatggcctgctgtagtgatctattctttttcttgatgctgcacacactagcagggccatgtctttcagtctttttccctgcagttaggcggagtcccagaactttgccctagcttcgttgcctattgttattgttgttgtcactgcgaaaagtagtttgacgttttctttgcatggggtttcagatccgatccacgccttttctggtgatttccattcatgcagggattataacactactacatgctagagcacgagacgatggccgtcctcgaccttcacactggtcggtgatgatgggctgctgtaacgtctatccttcgtgaggcgttaaaaactaatctaatgaaactccatccgtaaaaaaacactctttggtttttatgtcgtataagttgtgccatagatgccaatccagatcctttcctcttgatgccaaaaatcaactagtactcctcaatattcctattccagaataatgctagagtttgaattaattcccgtatattcgaatttcttccctaaaaacttatccgcaaaattcctcatattcaaatctgatatccgttccacacttgtcccccttaaacacttctgtaaattcaattctcaggtttgaactccccaaatttacactccctgtggaatgcttcccaaaatacagtctcaagcctgtaaaattaattcattcccaaaatatccaaatgtccactttggttctcatccttgactcctctttcttttccccgagcccaaatatcaattgaattcatcgaatccaaatgccgtattaattaggtattcaaaccaaccattcaaacaaatccctgaaaatagtaaagtatcactattcatctggaccgtttcccctcctcctttctcctaaataagcccaacccctccttcctgtttgctcctttacattccactatggaataagttcatttgaggtcccttaactttacaacgaatccgattttcgtccttggaccccaaaatcagatatactcggtccataaactttcaaaaccggtgcaaacgaggtccatcggcggttttggctgacgtgcgcctacgtggctggtttaattaggtctttgtcccacatggtattgacgtggcgcttacatggcaattctatcctggaaatataataaaaaccttaggtccatatgtcagctacacacaaaaaataataaaaatggtggggcccacatggaccccacatatcattccctttccctcttctttctcaacctcactcctctcctttcttccagccatggaaccagctcgccttcctccccttcctcgcacactcgcggcaggcggcccgacagcacgaaggttgtggccgtcttcgggtgcttctcctcgcgccgcagcaccgcctcacagccatcgccgcctcatcttcctcctagtcccagttgccgctgccgacaacgacgcgtggtcgtctgggatgacgcagtcacgcaggccaacacgaagtcgacgagggggacaaggtctctatctcctccctttcgacccacggcgacgagaggagaggggagaggggagaaggaggcaccgccatctgtgggctggccaccggttgctcagcgtcgtccgtagcgccgtcgtcgttgtcgttgtcctcagccaccttgcccctcgcctgtaccacgaccgccgccagctccgcccgccacccaccccagccttcgcctactccggtcctattcttgcaggagagatagagagagaggggatagggagagagcgccgcagcgtgggcctgggcactggaggtgcacgcactgtggaaggacttgacgcggcaggtggcgccggacgtcgcggcgcgccccacctcctccctccctaccctaccccgctcaacgtcctccttgccttatccttctctacgcccgctccggccaccgctcgggccgctccgccggccggccgatctgccccgcctgtagcccacggcgacgagagaagagggaagagagaggggagagggaagaagggagaattgaggtttacatgtgggcccacgatttttattatttttttgagatcgaattgccacgtaagcacaatatcaatgtcacgtgggacgaagacctagtcaaaaaagccatgtatgcgccaggtcagccaaaaatggcttccaaacaaccaacggacctcgtttgctccggttttgacagttcagggaccagttgtatcaaatttttgggttcaaggacaaaaatcggattcggtgtaaagttaagggacctcaaatgaacttattccttcctctactaggccacgactccttatccttccattggtctcagcccaatccagtatagatggacaaatgggccacttggcctagcacgatccgacaccagtggagccgacatggctctctcaatggccgaaccgggccatgcccgcccacgggctccacttatagcccagacacgacccaataagagttgtgttgtgccggaccggcctatcgtgtccctcctcattgagttgtgccttatatatggcttgaataagtctattgtgcctcccttctctatgggtcgtgtcttatatatagcagaaataagtctatattgagtccctcctcgttgggtgcttgaagtaagtctattttgcctccctcatgtctcgtgccgtgccgggccagcccactgtgccaaggcagcggcccaggcatggcccaactgtcaggccgtgccatgcttgggctgggccatatatggccaactatacaacccagtcaatccgtggcccctcatttcttctccttcttcttcttcttccatcatcttgcgccaccaactttgtctcatcacactatgaatttcctctaacttccccttccacctagctcagtgaaaatttccatagccgcactgcagtactaggtacgatacatatgcagcgttagaaatactttccgaccgacggacataataaaaatgcatggaattatattattaattcatgaagatataggtagagagtagcacactctataagcacacgtactcacgcaattacagtagtagagacattagttattacaacaaaagaaagaaagaattaaagaaagagtaggaaaaacaatcactttgatgcatgcatatatatgcatccaaattaagcaaataattaagaaagcaagcaaatacacataatatatatatagctagggccttgggatggacatggaccccaataatattgatcgaatttgtgctgctttaatttgggggattactacgggtggtgttcaaccacgatttcgtggcgatctcgggtaatgccggtgtgtgtcgtgagagcccaaagcacggtgatgaactcgcctccttggcatagcacattcctgtgcgccatgatacgctccacctcgttggacgcagccacgtacacgacgatctccgtccacacctccgccagaagcttccacatgtccttttgtaattgtagcaataatgtggccaactctgcgcccttgcgcacgcttccctgtttcttgctgttgttgttgtcgtcgtcgttgttgttagccggcgatggattgacgatggcgttggcccgcttacggcctcgagagaaatagtagtggtaacagccgagcatatccttgagctccgtcttcatgtcctggaacaggtcctccgcattctcactgtagtcggggaggagatccggttggaacaccaccaggtaagcgcagtacctggacagcgtcagatcacttgattcaatctcatgtgattcaaggtttgaggatccaacacttaataacttaaacatgttatagggtatttctgtctaggattcaatcttccttgcacatatatgtgtagcgatgatacttgtcgaggaggttaaattatgaccttctggttcttctcaacattgaagtggtcaaatttcttctcatatcttcggaataaagctgatgaatgatctttgtatgttactattggattcaacatcttcctagacaatattttcttccaatcttttgtaatttctttcttaacttagatttcagaatctttgtctttactatctcataatttcctaattactttgtagtaactgatctcctgtattcccctactacattctttaactagatattgtattccttatggtaactaaaatttctcccttgtttgaataacatccgatattgaacttcatattctttatctgtatctgattattttctttaatggaaattcgtgtcttggctgcttatttggagttacatataaagaggtctatgctagcaatcctggtatataattcactacctatacttaagaaacatcgtgagatatttcaaaatccatgtagtttaaatggtagtgaatttatttccatggttgcatagaattatttccattcagtcgcacttttagttgctattttattcttcctgtacatcgaaattcttgccttcaaaatgattggcctgtagtatagctctttgagttgaaagtgtttaacaagacacttttctttcatggttttcttggtatctagaaaattgataacttgtgagtaagaaaatttttcataaatgatttgtgtccttctaatccaaatatattgttggtatccattcaaacttcttgtacatatctagagtgcaaacctctagctctagtcatgaatcttcaagttgtgtatagtcatcaatacctaggagagatcttgttcaagaaatattctcaatcaataattttgtgttgtctaattattttatccttgttgattcatgagcttctatgttgtttctcctcgtgtcaaagaaattgggaattcaatctttaattgaagatgaagaaatttctcgtagataatccatatccttttatcccaattttattgtcaatatccgttcagactcttggtacttgttgaaattgcaaattttcttcctttaatcatacgtttccgagtagcgacataatcaactatgtctagaaaggattttgtacttctccaactaatatttttgtatccttaaatttcttcagatctattctcctgttctgatatacccatttatatttttggtataaatgagtataattggtttcttcagcattacaatcttgactcttagcgggttcagatccatctttccagttcagggtcttgaataaaatatctctattattgttcaggcattgataattggttatctctggccttctttgtcttaaccttaacttataatctctaaattatgaataatcatgcttatgtgttgtaattaccatggcacataagtcactaatctactttcttgtataagccttcattctattctttctacaccttatcgtaataagactcaggttcatccattcagactccttttgtaggtcttgatattttccgttcagtcacgcttttagcttggcagagaaagctatctttaataatgtagatgtatgtatactctatggaaatgtctccataaagtgcagcgataaatattccatgaatattttgttcatagaatatcttggggtgctgcctagtcctaagcttgtttccataatgattattgtcttgtatttaatttggtaaatgctaggtagataaaatctcttgcttaactccttagcataaagtgttggttgcaagagtacatgtgctgacaatctttttcaaaatccaatatttactgtacctttcgaggcttcacttattcttctccacgacgaattgttcatcttcaagttatttgtcatacagagtatgcaactcctatacctgaccttaaagtccgaaattaccttaaccaataggagttctcagcttcttggatttgtcgctccatatactgctcaatcataatgtggtatctataggtatatccacctcttgttgtacttctatagctttaaattagtgcatcttctgaaaattggctctacctatggtttatgatggcatagagatctttgtatggatggaagaggtcattctcttctaggttacatatatttctaagtagggtagatgatggtttgggtacaaaatcttgtttgtacaggttattcaatggggtttggccttgactatagaatttgtacaggttattcagaaggtttggaagtggaggtggcttataactggttccggcggctttcatgaatcttctcggttggctgagtgtattcagagtgttctccatgaattggaatggttgccatcataccatatctggggatctccatatattgctcatatttccacaggcataggttcttcaaccggatctctataatctcggtagttcttcatttgaaatggctccatcggtggaacgcaccttcatatccgtcaagtataggaatcgtcactggtcttaataccgcgagtcttctcgatgatatacacgttgaccatagatcttgttagggtttaagagattaaaactatccttcaccttgcatgaaatcaaagcataaaatgggacatcttttcttttgatctcgcaaattctttagtccaacatatttctcataaatatctttgtcatggcttaggcatgtagaatgtcttgtggactagtaattcctcaaatcttgtacatcttgttgcttggattgcaataattttgactcatgctaacataaccaaaggcttttatttactgcccttctggaaataccaaggactagagtcttcggagggggttatattattatagtaaaatagttattcttttgaaaggaggtatgatgcacaaataaaagcaaaaaataaaaccaataatgaaggggagttcattctaataaaggccttagcaaacttattaggcaaaattttagtttttaacctaattatcctatataaatgggaagttattcataaaggggttagacaacctatgggtttaagactataggaaaacatatactctgataccagttctgtcgggtcccaaaactaatgattctgaaaccgacatatttagactgtatcaagccctggattagtagattgatacaagttcaacaatctggatcgtctttgcatacatttaaacatagctttgaaggagattttaatacataaagtaatagggcgtttacaagcttgtggctaaccattacagcagaagctatagaatgacctaactctgctgttttgctatagacttaaaccatctaaataatctagacttgaggactaagttaaaagggaactaacttatgtgattgaactcccggcttcgataagaactccaaaaatgactctgaaaaaggggggttgaagcaagggtgagtacaacgtactcagtaagctattatattaatcaataatgaatgcatgaaatggtaatatctgtgtagagctaggtttacttgtggaaagcagaggatatagaggaagaaagcctgtaatgttttaaatgcaacagtatttaataaagtttggaattaagtttctaaccaaataccatatgagtcccgatgctcaaatccgtgagcacagctattcgaatagtttcatgaatattcatactgcagtagatgtacgctttacccacagcccatgacttgttgataatcatcaatttcgtcatggcctagtattagattactaacaattgtggcacctgtttcattaactctagtccccatgcgctctgaacgtacgttatcagcaacgtgagaagttctggcgtttccgaggtatttaagggggactgatcgtatgataccatgtcatctcgatcagggtttataaacactacaacgggatcgcttatctctaacgggcataatacctcatcactttcgggtaggccccccatcactgagcaaaggtcagtgatgtgagaacatatctcaatcgggcatccgaccatcacggatgacacacatctcaatcgggccaacactatagcccgtcacggatgactctcatctctaacgggccaacactatagcccgtcacagatgactctcatctctaacgggcctaaattatagcccccgtcacggatgactttcatctcaatcgggcctaaattatagcctgtcacggatgagtataatccacaaaaaaaataaattttgttttttggctagcctcggacctttgctagccatgctcccaagccgggctcactcgtgtgcacccgggctgcacacttgaaaaaattttccggtcggtcacccatcccaaaattgctccaggccaagcacgcttaacctcagagttctttggagatctgcttccggaaaagaagttatacattcattcacatacacaaccatcaatatatttaacacaaccacgttcacataacatccattttgatcacatatttcacatccattcacatgtttcaccagcaaaaccgacttaattggagcaaatatatatatttagcaagtattaacacgatgaggaggaaaatcagacttctaggcaaaaatgaatttcgaaatgaattttatgataataaatgaactcatatgaaaaagttgtcaaaaacattgtttacaaaattcacatatctctcatctggtcttataaactagagaaaattccttgtatacccctaaaaatttagctaatctcttctatacccttgaattttacttacttccttgtatacaaccaaaatttgattttgatcccttccatacccctcccgtcagttgaccgttagttgaccatctaatttctataaaaatgaccattttaccttcagatgaacatataaatttatgaattacattattaaaaaaaataaaagcttctcgcatgagactatcatagttatgagtttgttgtgcgatgcattatttatcccaaaattatttttatataatgaaataaaaatatgtatttattttttaaaaaaaatcataaaaaatgaggagcattcatacaagataggaccaatgttcacaataatggttttatgaatcctcccgataaaaaaaatccattgtcctattaaaatttcaaataaaaactttaatttattacttttgttttattttcaaaatttatgtcaaaattttctgcattaattatttagtctcattagtttcataaaatgcacatactgcgcactcaaacaaaattttcaattgtttctgaaggttatattcaaacctaaagcatcaagggcaaaaaggtcatttgcaaccaaacgtcatagtgaaatgatggaaaatgtaacggtaggggcatggaaggaatcaagttgaaatttcaggggtatagaagggatcgggtaaatttcaggggtacggaagggattgggtgagttttcaggggtacacatggaatttactctataaactataacacagatatgtaaattttgtgaataatgttactaacactttatcggatgaagaaatgacaaaaataaaagttatagatcttgatgagttatacaactttgttgttgatgactttttcagttgaaatcatttagtatttgaaaatattgtttgaagttgtcatattttcaaattcaaattcaaactgttcaaaaaaaagttatatagaaaaatgaccaaaataaaagttatagatcttgatgagttatacaactttgttgttgatgactttttttagttgaaatcatttagtatttaaaaatgttgttttgaagttgtcatattttcaaattcaaattcaaactgttcaaaaaaaagttatatagaaaaatgactaaaataaaagttgtaaacattgataagttatacaactttgttgttgacaatttttccatttgaaatcatttactatccgaaaaattattttgactaataaaatgaattattatactacagttaattattttgttacaggtcaactcacaaatataaatatttcatatgaaaaataaaaaaacactaagtcatctcaatcgggcattttagtatagagcctgtcacggatgagtcatctgtgacggacctagttgttatcgattgagatatggtcgcacccgtgacgggcaccaacttggggcccgattgagatatggaatgttatctcaatcgggcctaaactacggcccgtcactgataagtgtcatccgtgacgggcatgagttttatgcccatctaacatgtttgtgcgaccatatctcaatcgggcgttttttcagcccgattgagatgacttccttgtgacggcccgctaattctagtcatgttaaaggccgtcacggatgaaaggatactagtgaaataaaatcacatacacagtgtgcacgatatttacccttgctcgataaatataataagagagaatccactcagtgccactgagtttttcccacttctacaatctaccactgactttgtcaagttgaacaatatgccatcgtgttttcccaaacatctactaagtgccatcgccatccacaagccgttaggatgcatccgtttagtgtattgattttttttcttaatgactaaaatacccttaccttagcactttgactgaagaccctagccgtgcaatccccatttgatctgcccagtgtgtggcagcgccgactcccatcgatggaaggccagccgcccgagactccgaatggtggcgtgatttttcgggttggaatggattcaatccatgggttaaggtctggatcgatccataaatcacgaccaacccactcgctcaggtcatgtgctactagctgtgctctcctcttgcaggtcatgtgcttgctttctgcctcccccattatccatggcggcatggcatctctgctgctggcagctgccacgccggcggcagcggctatgcctactccacggaaacgagacgaggtgcccggtgccccaagggaagcccggactgctgcgtcgtcggcaagcgctacccgcggttcatgtggctcacagccggtatcggacatgcgccggcgatcccgacgctgcatatgtgcttccgccggaacatggagctggtcgtcgagctgtactccgggtctgggtggctgtgcctcgacgacggcggtggtggcgcacgctgccgccgctgcaacgggaggatccgcgtcgtcgtcaccgccgccgccgtgaatggacggtctgtcgttgtcagggtggtggacgagtgtgactacgtgaacgggtgctgcaacgaggacggcttcgcgcccccgtgccaggacaacgttggcggcgagtcgctgactgtgtggaagaagcttggctcaacgagaacaggggcaaataggtctttttacagctctaacagatgtctaactaacgg

SEQ ID NO: 13686 - DNA, 2590 bp, Oryza sativa
ccctgctcggcatatagttgcctcctactcgatgacttaaaaaaagaaccactgtacagaggtactaccttgttattaacataatactaaatctatccccatacttagaactatggtcgtacccgttcgttcttcacaagtacttggccagtcttatgtcggttggaacagtactagccacccggaaatcaaccaattctaccgtaccgttccaatctaagttcattatatttttatgcagtctaactaggcagggctaagcaaaagctagcatatctggtttgctatgttcaggttatgcatttgaaatcatgaatgactaatgcatagaatagaggtatagaatatagggcatttatgctcaaaaaggaggaataataacttgccttactccaacgcaaataaatccgagataggcaacctgattatccgatcctcgaaataccacaggttgccatccagaataaaatagactctactgaagaagaggaagagccaaattcaataaaaatctatgaaatatcaaaagaacgataaacgacttaggaaggctagggtttagggtataatctattcctttggtagggtatggggattattgggctaatatatcatgtataggttcctaagggttggaggttagggtagagaggattaagtaactattgtcgcttgtattttatgtgcaggttttggttggtggaaggataggaagtagttggataattggactggttaagtgggtatatggctagtatttgctggtggtaggtttaggtagtataataggtagggtttagttatatgggagttgattgtggagtaggacagcatatcggctaggctctatatgtataggttttggtaggtggagagtaggtggctgagagtatggtggataggtgggtatggaatttgggtgatgacgggaattaactaggaaggtattggttagggtttggttgctagtcgttgctagagttggacagcataatgactaaatttgatatcttctctagccagtgtcatcatacagcataacgactagaggaataggaagtttgtgtaggaagtgttactccgacaaccgtgagtagcaacggagcggttaggatcacacagagcttaagagctaactatgcggtgtgtagtggaggtcgagggaatagtgaagctccgaccattgtacgcattaaggcgtaaggtgccaggagcagcatttcgaccttaagtttggttttgccggacttaacaaccaacggttcgacgtcggagtcaatagaccgcgaacgtccccatggaaggggtaaagttctaaccagtggcttttagtggctaaagggtatttttaaaataaaaggaaatatttgaaagttaaatataagtttcaattataagtttaaatcaaatatttattcaaatggtatttgaataaattaaggaaattcaaataaaatcttaaaatagcaaatttggcatcaaaatgtagattttgaatttagatgaatttaggtccaagttttactggaatcggatctacggtttaggagatatgggcttctaaagaataggatttgaattaaatctagaaaatataaagtggtactgtacgggggcccacctgtcagcctttctttttccatttcttcttcttcttcctcctttcgttttcctctctgtctcacagtgagccgagagaagagagaggagaggccgagtggggcggcggtgctccggtggctgggaggctgcgacgttggcggtgggttgtgttcccgagcgacgcgcacccggggagggtggtgtatcgaagagaggaagagggatgtggccggaacggcgagtagaagagtttatcttcggtggtaaagagagggggggtggtggcttgatacaaaggggaaaggaaggagagatgggcaaaatggattcgctggagtggagccagcatagtggcgcaagggaagaggaaggggagctacgaaggaggagatcggccgacggcggcgacggccggacatggatggagggagacagaaaagagcttcaagctcgatgtggggaaatgatggggtattgccggctatttataggcggcgaagggcggtggtcaatggcggtttgcagaggggaagagggagttggccttggtggcggcgacgtgagaaggaagacgacggcgccggctgtggcctgtgattggtcggcgacggcggcgcatacacgcggcggtcgcgggagggttgggtggcggcggcagtggagtgcacggcacggagatggctttgccgtggttggcaaggcagcggcggcggcaagcgtacgcgcgccacgcgcgcccatggcgccggcggcagcgcccacagaaaaggaggcgacggtggtgcggctgggagttggatgggccggtttgggccgagaagggagatgggccgaagggagagagaaggggatttcagcccaatgacaaaaaggaagaagtctaatttgaataattgatttggatggctaggttttgcaaagaatttgaataggaagttttggaaggaaatttggcaaaggagggattttccaatttatttgagtgcaa

SEQ ID NO: 13687 - DNA, 5407 bp, Oryza sativa
aaaatggttgaaggtaaacataaaaaggatttgaatcctaaatttgatagcaggaatatttgaagaattatttgtggctaatagggaatcaatttggaagaggaggataaaataaaaatctattcttctcagcacaagagcaatcattcacaatatttgtaatattgctattcttctgccaaataggaaatccaaccatagagattaacgatggctagatcaaagggaggaatttggatatttaaaatttggaaagggaactaagtataggtttggaatcaaagcataggtttaagatcaaaggatgggttaacaattaattccaatggaatcggaattacggttgtttaggttcaagggcaatatggaaaggatttttggaccataattcataacaaaaaaaaagggttttcgaactaaatttaaagaaattatggtcggaggaaagtattgaatcaaatcaagaaataacccaagatggttttaaatagaaaccgcaaaaggaaattaaataaaaggagaggttttgagttagttttaggaagtctctctaattataatattctaggtttaagaagttattaaaaacataagaatcggcgtggtgcataattagaaaattgttaattttcaggatgttacagtactggattgacgtcaagtatcgcagacgacggcgagaatcgacgcacggctcacaacttgcaggccgtccacggacagcaattcctctcgcagagcgcgacagattatttaacggtgtaaaccttttagagtagtggtttctttttaaatttggacctctccgctctccggcccaacgaaagcgacgacgaataaagtcattattatatattagcagtgcgtataatttctgttaggaccatgaggtagagtaatgaacaatactctgatcctaagctgagaaatcaatgtatgtgagcagaatatgttcttgcatgcagctgcagctgcagaaacagctcgtgattagcagattgcatttagtgggtgggctgtcaaatcgatcacagtcacagaaaccacatgtgagcagaacaagttcttaacataggagagatgacatagcaatggaaatggcgaattcgtgatgcacatatataaagctagcaacaggtataggcgatgtgtgtgcttgacagtgtacagtgcagaccatgggtggcgacggcaagcacaccaagttaccatggctgggcgtggcgaggtacgcggtgaccgcggtgctcgcggcgacggtggcggcgacggtggtgctggccatcaggatggtgctccggccggtggagctggacctgtcggtggccaacggcgcggtgtccgtggagcggccggagtcgccgtcggcggcgtcgctggtcaagtacaaggtgacgctccgcgcctacaacccgagcggccgcgccgtggtccacttcggcggcgacaacctcgtccgcctcatctacggcgccgcggcgcagacggagctcgccgtgttcacgctccgcgcgttcgtcgtgccgcagcaggagtcgcacttcgtcaccaagtccgcgttcctgaacgcctccgcgctgccggcgtcgctcgccgcgaggctctacgacggcgagaccgaccaggtggtggtgcaggccgtggcgtcgctcagcttcaccatcggcggcgcgcgcggcgtgagcgccggcaggcgcggccacaacttcaccttccactgctggccggtgtccatctccagctactacgaggtgtccggcggcgaggcgtcgtgcagccaggacaccaccgaggcggcggtcgccggcctcacccacgaccgctgcatcggcggcccttgcccggagccgtacaagaactccggtaactgctccgggaataatagcaccggcatcaaggggtgatcgatcagctaatttcatttcgcggggtgtaatttgatttccagatgctactgtaattaactaatttattacaaattgaagaaataattgtattgaagttgtgtactgaaacttaaattgtgcttgaacaatgaaaaagtggaaactaaaggcattttgatttgttgccacgttcaacccgataacatgtattgtacacacaagtttagagtgcacgctcaattaccatacacatcagctaacaagtaataaaaattctaaacatacttacaagtacgtgtgcacgtactacaactatacataaagtttcaacttcaagtttaactaaacataaattgatcattatcaaaatatgctaaacttgtaattttgggataattttgtttttaaatatgtggatttgtgatgcttggctctaaatttatagttttatgataactttagtgctaaatatgtgtttaatgatacaacgtctcaaatttatagtttttatgatagtttgatcaaagttatatacatagttttgtcaaatttactctgaactaaaaaatatatatcatcgagccctaaatcaaacaatgggcctaaatcaacgagaacctgtgctccaaaacccaaactggaaacgtgaagggcccgtgaaataagagatgagctcaatgggccttggcctgccaagaggcccatcagatcacacggcccaataggaggccttcgagaaggttctccgctggcctcgcacgctctggacttcttaagccgcaagcacgcgacgcgacggcgaggccacacgacctcacctcgccaccatgcggctccccggcgacgctcgcctcgccctcctcctcgctcgccgccgcgccctcccctcctcctcgcccgccgcgtcggcgtcccccttccacggctcgcgcgcccacggaggtgagccgccgccgccgccctcatccccgcactgtggctctcccgatttcctgggatttccttccagtgtgactgatctttctttctggttggttgctttggtgtgcagcgaggtggggcgacgcgtttcgcgccgcggctcccgcgtggaggtcgccgttctcctcgccgactagtgccaggctcttccacggtgaggacaacaatggggaaaaaggggaagaagggagatgctgctgtttctggtttggtgagcttggctgagtcgattggtgatgttggattcgtgtggctctgcagggacgaggccggtggcagcgagggactactacgatgtgctcggcgtgagcaggaacgcgagccagggggagatcaagaaagcgtattacgcggtatggttggctctggaatcaagactatgtcatgcttagggtgtaaattgagcacaccaacgcggcacatcttagttctatatcgcaagtcttgaattataaagtgaagactaaacttttagttgctaattttagtgatagactttggaagttcccatcattacacttcaggacttgtgcatagaaagatcatcacccatttggattttggaacagtaatgttaaccgcaagttgatgggtatctaccagtttttttgtctaccagaatgtttctgaaaagtggttgatggactcttgagtaaagggcagttgaggttgtttgatttaccatttctcatcctcaattttagttatgtattagccttgtgttaatatagaaaacattggcatttcctttccttatgcaccatcgaaagaaaaaaaaaatcatcgcgtattgtttacctcacaatccctttttttttctttgttgtcctaaaagcttgcgaaaaagctccatccggatacaaataaaggtgattctgatgcagagaggaagtttcaagaggttcagcgagcttatgaggtacagttttcagcatggaatacataggtaaaggttattattagtttctgataatatactgagacatacttatttttccttctttgcagactttgaaggatgatcagaagagatcattatatgatcaggtaacaatttcaacctatttaattgaacaaatgccaacattttagctgtcaatgcctaaggtctattatttaaattaccatgggtctggaacctcaatttagtgtttaccaaggccctaggctgcctgcctaggtaggctagacaggaaggtgctgccaagccgcaagctttcaattaccttgtagagcactgcccagattcattagttatcctattctcataattagtggtagtaataattcaacttgactattatgtgattattgcttttcgttgctataccctagggtcagaagctatgtcttagaagtttacaatacaagcttttgaacacaaacttgtccttgacatgatctattacaggttggccctgatcagtatgagaaagcttccgctggaggaggacctggtggtgcatatgaagggggttttggcaatccgtttgaggatatttttggtggaggtggcggcggcggtggaatgaatgatgtatgctatcttttgtttaattatttgtcatctggttttattctggtggttctgctcccatttagtttgtattgttttctatcactcatgttgctgagtatatacagaaaaaagatactgttgtctggaaattcattttatctttgtagttttatagttattgaattgtttgagttttagcagaaacttgtgtcctacatactgcgacattgcctctttgatactttttccataagtggttttctgtttctttcattgcattatttaattattttacagcttgataaacaaatggcatctcatcatccttcattttatagatgctgatcacataaccacatgctcgtatactttaatcatatgagtataacggcactaatatgacttttgttgtctgtgtgtataatgaagttctttagaaacatattcagagagagagaatttagcgggcatgatgccaaggttagctctatactcatttttttttcacctatcatgtttttgctctgtgaatcgcagtttcatgttccattctacaggttgcacttgaaatatcatttatggaagcagttcaggggtgcacaaagacgatcaattttcagactgctgttacatgtgacacctgcagtatgtagatgcgcttctatttactgcacatatcaaactatcgatgtcctttgaattgttcctaatcatctaatgagagttctttgttttcccagagggagctggcgtaccccctggaaccaaacctgaaacttgcctagcctgcaggggttcaggatttgttagttcttcctctagcacaattatttctatttaatgtggtatctcatttaaatgttagtactgtgcttatttgtctttgtttttcatgtgctgttggaagatcttcatgcaaactggtcccttcaggatgcaatcaacatgcacacagtgtggtggtagtgggaagactgtgaaggtatgatgtccctttgtgttgataacctgcagtcaggat

SEQ ID NO: 13688 - DNA, 2382 bp, Oryza sativa
cctatataccttttgtacagtgtctagattctgattagtcacgatgagctggtgattgcaatgttcttgtgttgttaggaattctgcaagtcatgcaaaggaaggaaagttgtgccaggaacaaaaaacatccgactcaacatagtgcctggtagttttcaaattgtcagcattcatgttatttgtacgcatatactcttattttgtgttactaaatgtccttgagcattattctgttcattcaggtacggatgatggtgacgttataaagttggttagatcaggtggagcagatccagatggtggtagtcctggtgatctttatgtaactctgaaggttagtcctctgcacattagcagttataccattggccaatgaatggtaataggcagttgaaaccttactttgggatcagacaggaccaagcactcggtgcaactagctgtaggttgatcccagtgcaagagtagtgtctggtcatttgttccaattcttttccccttgatgcaatgatgcacggctctcctgcatatttgagaaaaagatgataagcagatgacctttgtaatgctgttttttccaggttcgtgaggatccggtatttcgaagagagaaaggtgatattcatgtagatgctgtattgaacgtgactcaggtaagttgagcctgattattttttctgcatcctatgcttatatttgccactgcacagctcagtaatggacatccctagcgggaaaacagaaaaactcagttaccggccatacttcgttgtcactacattctgttttggctgagctggtaatctgagtgggagtgtggtagtggtctgtaagcaggattgtgcatagccttctagggctgggtgataacaagttagtgttagcagattatgtctgttccctttaatcttagaacaaactgttgttattagactgttccttatttgccacagagcaggcaaacaacaattgtttttcacagtagtttgaatgttaaaactagctaaagtatgttatctctagcgagtaacgatgctgtggtgattgtctgataatctctagtgatactaaacaaaacttgtaatgttgtcgagtaggcatctcctccacagttctcatatttcatcagtattcagattaagattaactgcaaacatctttgtaggcaattttgggcgggacagttcaggttccaactctctctggagatgtagttctaaaggtacctccaaaatcagtttaccctcattttcaatcttctcctttgtttattatgtcggaattctccatctgccttgcatattacaggtcaagcctggtactcagcctggccaaaaggtggttctgagaggaaaaggtaaactgcactacatagtgtttaccttttcgtggggcaaaattttttttttagttagcataaattgcatatggctgcatgtttaatacttcatgctcagttacacatccaagtaaaaatggagtctgcaagggccttgttttattaaaacccagtgccgtcatggctcataaatttgtagcggttgatacatttcattttgcctatagtgataagcatcactttatcctgcaggaatcaagacgagaaattcatcgtactatggagatcagtatgtccacttcaatgtcaacatccctgcgtaagctctcctcggaacttactgaactgccctatgctgttactagtacttctgtcaaatattcatgtattacttatacacaggaatttgacaccgagacagcgcgtgctgatcgaggaatttgcgaaggaagagcaagctgaagaggagaaagacgcaaaggcagcaggagcatcgggatagctgattttaggagcgacccgtacatttgattagtgctttagtctcatcatatatcgcgagatagaataggctgctgcctgaaatttgcaggggcaagaagatatagtttggttggatgcatggaattttacatgccgacatatagcagtttcaaattttgtagctgggaataatatacaccacgccgcctgatgtttgcaatctcctaatgtcactagcatcagtgagacaggcggcaggatcctgtattgtataattttgtgtgttaagaaagtatggaactcacggtaccaacctctggactcgtgccactcgttgagttgatattggctctattcatttttcaggttctcaattttgttcccagcaattcttgctggaaaggacactggaacagaacagagttcataaatctttttatgcattgtatgctggcaccgaattagtatttcagatgatgtgctgaattggaatttgttaacttgcttaaaaaacaatccaaatatttgtctcgcatttctgtctgcatataattcgt

SEQ ID NO: 13689 - DNA, 15212 bp, Oryza sativa
  unsure (1)..(15212): unsure at all n locations
tagtgactaatgtgttcttcttcctcacttagcttgatgtggtgttgctcgacgagctgctctcttcccacatggggggagctcgaggttctcagtgccagcaaggagagctggtcaagcacaagcacaaccactaccccacgtacgtaccccgtagtgctggcgagctcgttgattggtctagccttgctcctcttcggtggagacgaagcaaatgcacatcttggtgactgcagccccaccgacgagtggatatagtactgcaaaggctttggtgaagatcaaggaagtagagcacatactgcagtgggagctgagcttgaccttgatctatgctacactactaaacatggccttccttgctcagatcggcatgcctgggcaattggagaagaaagagaggaggaatcgagagaactggaggacaggttcaaactgaaataatttgtaaacatagctagcccaaggtgaaaatatggatttgcccctagcctaaactgcaacattggtgaaaataggtggaccaatgtgcaattcactcttttttttgagattcctatgaaattttacacgatttttcaaatgaattagttcgctttttgtagaaaaagagaactccaaaattcgtcgaatccaaaggctgcatgcgttgctgaattctgtccacacgctctccttcacacagcaaatgctggtctcgtgttcatctccacatcgccggagaagaggaggatgatgacgtcgacgatggcgaggcccacgatgctggcgtgctgcaagctctacatctccgagagccgcaacgccgccgccctgcgcgccatcgagcaggcggcgtgcggcggcggcgccgtcgtcgtcaaccgcttcaccgacgacgcctacaaccgggtgggctacacgctcgtcgcgccgctcaccccctcgccggcgccgccgcctccgccgcagtgccgacgtttctgttcggcgcggtgcaccgggaggggaggacgctggcctccatcaggaggcagctcggctacttcaagcccaactcctccggcgaccaatggcggggagcgccggagacggacgccctgcccgtcgcaccggacgccgggccggagaggtcgccgagatccaagggcgtggtggtcgtcggcgccaccggctgggtcgacaactacaacgtgcccgtccgcaccggcgacgtggaggcggcgaggcggatcgcccgcgccgtcagcgagcgcggcggcgggctcccgtccgtgcaggcgatggggctcgcgcacggcggcggcgtcgtggaggtcgcctgcaacctgctcgacccggcgagggtcggggccgagcaggtgcagggcatggtggagcggctcgccgccggcgagggcctctccgtcggcaagggatatttcactgattattcgcaggataaaatcgtcgagttatacttcaaatcagcagctaacactgagggttaactgcagtgcgaccactgatcactgagagtccagcggctgacactgagagttaaacttcaaaattgaaattgagttgatttggttggggtcacaagttctcgaccagtgatcactgatgagttctaactcaagaaatgcaatcacactttcacgcgtaacattttaccaaaaaacataacaaaacaaattcagagtagacgacatgtagctcgctgtgaaaatcatctaactgatttacaagtgtgcacatggccgaagagttcagcagcagcaatgcattccaagccaggtactttcaagttttccagtaattacagaatgcgatacatccaaagatgtgagaatcaccagcatgaaaaatagcaataccagcgacaaaactattaaagcaatttttagattgttccattcagcatatgctagtaaggcctcaagccacccaggcggctttgttatttggcttctgataatcagatcaccgttggttctccctcctccgggcgtatcgggtcctgtcattgtacctaggcctatctgatgctctttgtgggacaggttctacccgcctctgcctctccggggacctctgaacaatctctccattgacgaagagctcagctgtaaaacaaaatagaaatagattatatggcatgagtataatatctttccaagaaatcagagtgcagcagagcaactcatcctaccaacctcaagccaatagattcacacaatggtcagattttgttcagcatgtaatatctactctaaacaaactagattaaccaaaaatacaatgatgcatttaatgtaacctctgatgtctcaaatacaaacagttaaagccagtgaccacgaataagttctaaatgtttcatctcaactgatccacacagcttcactgtactgaagagcagaagagaaaaagaagagttctctttaagtccattagcattcaaaacaaggcattgcctaaatagctatcttgctttgccaagatggactgcataacatggcacaaatccatggggaagtgcataaattcattcacattcagtaagaaaccataaatgatatgataaaaaaagccaccctaaattatttatatagctaaatgtgccaccttcaaatcaggtaaaattagaaagcggattctaacttgtcatagggaaaattttcaacctccctatgtttagtggcatgaccatgttggcatgtttcatccccactgacctgtacctcatttcatttgaggtgcagaaccgttgaagagacattttttattagtccattagcattcaaagcaagacattgccatataggcttcaccactttgccaagatggactgtgaagtctagaacagcagtttggtactgttgagtcagcaacataccaaatcgttatgaaacaagcaagcgagagaaacacaaaattgttttaatagctaaatttgccacattctagtcaaggaacattgggaagtggattctaactcatcatagcataaatttcaatttccctatgtttaatggcatgatcatattgcatgtttcatccccactgacctgtaccccattcatttgaggtgcagaaccgttggagagacacttgttattagtccattagcattcaaagcaagacattgccaagtaggcttcaccgctttgccaagatggactagtatgtctagaacagcaatttagtattgagtcaacaacatactaaatccttaaaaaacagtaaaacatcaagactcaagggggatgtggcagtaaatacactgttagtgtctctatctacactgatctgaaccccaatttggtaaggtgcagaaccgtgagatacatttgctattagtccattagcattcaaagcaagacattgccgattaggcttcaccgctttgccaagatggactacaggtttggtaaacagaccaaagccttgaattaatcaaaaactgaagaggtggtaaagtgttcttaatgtctcatctccactgatcagaaccccattttaccaaggtaccgaaccgttagagagacatttttttcagtccattagcattcaaagcagggcattgcctatatggcttcacagctttgccaagatggactactagcaaaacatcagtatgtggtcggaataggctcacatgccatgaaaacagtctacatacggtatccagacaatgttccatttcattttgatgcagttctattaaaatatactttaacttcgatcgcattatcctgtaaaaatggaagcaacaaatgcctataggggggccaattaggatatagtatctacaacatcagtcaatcagtgatcatatgaaatgacaaagccattgatctcctaagaaaacctgcagaagttgtgaggttgtgcaagaaagctacctccatagtccttgtactcagggtcgacataggaatcagggaggacaaacagaacaccaggaagccctgtcatacaacacatacatagtgcatcagatacatgaacacacacagtgcgctaaaagtattctcattccaggtatttataaaaccaaaacataggcaaggaacaaaccttccagcttgttggacgtctcctcatcgatctcgcacccgaaaccaaagtatctctcgcaggagacgttgtagatcttcttcttcgcctcctcctcactgcagcaaacacaaccacataagaaatcgacctccgaaccaactaactggaagtgaggagcaaatacatggcaaggttagcacaaactgagagacaaatcggcggagagagaggcttcaccttccgaggaccttggcgagggtctggatgtagcagtcaatcatctgctgcttggtggcgccctccccgcctggcttgtccatcacgatgagccagtgctcgtagtcgcacccggggaacagcggggccatctccgtcggcgcgcggtctccgcctcctcctccgccgccaccggaccgcatcggggagtacccatcgccgcccggccgccgcgcgaacccgcgaaggaagccgacgcgcgagaccgcggcgacggtggggcgcagcagcgactccggcgcaccggggccgccgcggcggaggagagcggaggccgagaaggaggtggcgcggcgggagaggagcctccgcgcggcggcggcggcggcggcggccatcgcggggtaaaaccctagcggagtgaagggagaagggacaacgcaacgaaggctggggtttggaatcgcgaatttaaagctgcgtggcgttgaagtgaggttcgtgtttagatgggcttttagtaggccgtatttgaggacgaatgaagcccagtgaatgaaacatctcactggtggctgatagtactgagcaatgcgagcaatggcgtgtttatgaagtttcaggatgtcttttacgacattattcaaatccgagtaatttacaggtcgaaaaattcaaactcaaacgtgtaggttacagatctgtaaaaaggctatatactccatccggtttttaatatatcatgccattaacttttagacatttatttgatcatttggcttgttcaaatcttttttacaaacatacaaaatataagtaatacttaaagaacttttaatgataaataaagacgcaactaaatatatgataattgtataaactttttgaataatatgaatggtcaaacatatcacaaaaattaatgatatcatacattagaaatcggaggaagtacactctattgaatataaaactaagaagtatataggaatctcaaaggccaagcaagtgataacgagttcaatttacatccaggagaggaagagagcatctaattgaggtgtcagatcgacaacaattggctacaaagagaaaaaaaaaaagcaaggtaccacgttgagttgtacatgaattggttttttctgtatgtataatgccgtataatcacatactatatgttatctatacctactagcatggtgtcagaaaaatctgaaaactgtaaagacagattggaggatatggtcgcgcttccagtcctgaaatgacacttttgccgtctcaaactgcaaactgctgcagctaatcaacagaaaatggagttccgagcaaagaattaaagaatctgcttcaattgatttcattcccttgaagagctatttatcaagtacaggaactattgctgagctgggttcgatattggatagccgtgcagcacctagaagttgctccgggagctcgtcgtatgtgtttgcctgcaagtgtaaaggtagagaaatgtgaaccagttgagatatactactgtttattagctatagaaacataagtcttcaaagttcaaactggatcttgcagtttaatcatttggcctacagctgataaaccgtaaaacggcttattaggaatcaaaaataatttgagtaaaacttttatatatcattaccgacttaaaagcaaatgctgaaaaataaactatgttaagaaaaacctcaagatcaattctaaaattaagtttcaaaattttagttttggctgcggctgagccaaaagggtgctcttggagagtaaagactgaagaaaatgagggagccactgagcatacatacctgtataagaaaagccatgtcaactattaaagtcgtaacgacgccaaacaccaagcccagaacaccattggccactgctgaggaaccaatgtctacatctacctgcataacaatatcaaaaataaatttgtttgttcaagagatgccctaaataacctaatgttctactgcttcagtcatatctcaactttgccaggtatttacatgctcgaataatgtatttctccagtaattaaaataataggagttgtgttgtgttaatatttaaggtgcctatattcagtgtctcacttctatgtactcttgaccacgcatataactgcaatcaacagcctttcccaataagcaaggggtacttccgacgctctgtcgcactatccaagatccctgaagaaatcaacatgctcaagtgagaaaggccttcattataaatcaacagggctatacactccgaaagttagaccagacctttggaacagatgggatgagcttcaatctgctatttcggaaatcatcatcgccatcagcaaaacgttgtaacagtgatcctttttccaaggttcttgtaacaaaatagaggaccaagctgtaatggcttgatccaggaatctgcaaatgcaaacagacctgatcagcgtgaccaaaataaagaagacgagccctgatggaatcacagaatgaaaactggtatttttcaagggaaaactgaaagcaataatgatttttttctctaagcgaacaaaataatccggcctaagctataaacaagccaacaaaactggtatgatcattgaaaactacacagcaggtcactgcatctgctctcattggcaatgttaatcaaacaaaaaaaaacaagagattctgagctagggttttgtcaaagtgtaaccagggagttctatttttcttctaatagcaattgtgcaaggaactagtttgtcaaagcgtaaacaatttgtcaaagtgaaaaccaggagttctcttcctgtaaggaaccccgtgagcacagcagaaagaaactagccatggaggagagaccataaaagaaatatgatcttacttgaatgtttacaacaaaggtgaacatccccttctcagcagcaacctacattggtaaaagttcaatgagaatcatcatactattagtatagtagatatacttcattaggacctcacttaagttcatgcagataaggaagattgtcttcagtaccatatatataatatgcatgtgcaaggatctcttttatcaatagtcaaactggaaaacacttaacatcacaacaaagtttcaagcaaaaaccatcaactctgttaacataattgtgagatacttgctgattgcaccatctcactgattctcatcaactttcctatcctaagtaatggcgaagtgacgcgcacttccaatttcaaactatgcaagataaagtctaaaacaaagatcaattaaaatacagtccagataattctgtcaaactgtatcaacgttcataattttacacatatgtagatcttacagcaggttatttgttcacaggatacatataagtaattaggtacatattcaaagtgctcactactagaacgcagagtaactacctgaagcaatgaagcttctacacagctaaagtttaatatgcaatgaaaaaagattgatagcacacacaaggtcgatgaaaagagtttggaaaaccgatttgtttacaagtacaattctggtagaacaaacagttctgcaaaaggtaatcgttctatattattccaattttcaagtgctactttgcatattagacactggaattttaagcatagacataatcatgtaatagtggatttcagaaagaagggcacctagatgtgggtagagcatgaagtaaccataaactatttgcttacctgagctgcacatcctttccgcctagcaacatgatccattcgctttatgtccctaagccagtcgattgctacaagctccataaggtactttgttgcgggaacctgtaaagtcaggtaggaaatgcactaagctcttaattgcctgctatacttcagaattaggaaaacctgttgtgccacttttaatgtttggacctttgatttgtcatgtggaaagctctcactacgaactttaaagagcttgctatcaggtactgtccagcagttacggcttttctcatttgcatcccgacgaataatgcccgaaaaacaagacaaatctattggatctgtatcaaccaatataatgacaaaggataaggttaaaaaatgataaatcatctaggcaaattatacacatatcagactaaaagaacaaacctgtgtacttagcatcactgtcagatctggtaggtgcctcctgtacatgaatcacataagacttcagtgttaaatgaatcagcagtaaaactttcttcaaactacaaaaatagtacaaatgtaagtgtagtatgtattttgacctcaagattagcttcaggaacttgatagtcatcatcttcttctgactcttcatctatcatatccaaatttttgttatcgacttgtccaaaatcagcttgttttgtctttaagtcagtttcttggagtttcttatcctttttcaatttggacacagtagccatagtactcatcacaggaatcctcggaactggatgaatatcatcagtttgggaaaagtactcacgcaatcctggacataaatgcaaatgttagaccaacatagacacatactatcaacacgaaagaacgttgtgattaattaacagtatttatttgtcatttttagcattcacgggaaattaggacatgtcatcaaaagttaaaagaatggtttgtactttgtaccagcaacacagttgagcatctgcaacaaagagtagtactggaacgatgaaaaatagttgacgccccatccctttagatcaatttgcataaggtgttgaacttgagtgcgtggtctcccgttgacgcatttgagaggagaaattttaaaacctccacctgaactagtaggaagttaaggttaaaaaacaaaagttgtgcaacacttgttttaatatatcaagcatcctgataagcagaaggcaaattactttcaataaacgccctcacaaatcctggttggggaccacaattctgatgctcagtagatcggaacagtacaactgcaggtttaagaacattgaatcaaacaagttgcttcagaatgatgaaagtgaccaacaaggagacatccaaagattaccataacttccatcatcattgcgccgccaatatcgtacataacaaagatcccggggccagaccaacctacatgttcagttatctattaaattagatgtagctatgttattccaaatctgaggtaatgcaataatatatcgatataaagtaaagaacccaggtcttgtggagtatgatactgccatatagaagttctcatcctacaattttaatttagcaacagttgtccaaacagcaaaaacagtaatgaatttggcagttggcattgccctattgggtgcagaggcaattccaacaagtgaattgtacaatatatgccaggcataaatattctacactcaagtccaaatgaaaaaagttcgtgctcaaatagtttatttagactttcaataagatataaaatgcaatcctcatgcaagttataacagaaccagatgatatgtgcacataaataatcagtacaagaaaaggtgttacattgaaaaccagttcagctgtagccgatgatatagtattgcagtgtgaccatcaacctcttcaactaaactcccatactggaagctacaatcccacctacagtggagcataaataatactgaggtcagcattcatagaaaagcaattaggaagtaaaacacttaaacagcacacacttactcatatcgtgttacatccatactcattattagcccaaaaatggattcacatgtggcttccaccacaccaacagctctcattgctcggctacagcttcttgcctgtaagggtgcacaaggcataaaaggttactcatagcattggcgtgtctgcctttgacagtatataggtaagagaggtacatacaaggtattcaacctccacaagttcttcaaagatgcgcaagcctgccaatcataaagccaggaaactctaattgtaacttcatttgaacaatcctaaagttgaattcaaaattttaaagtaccccttatatgcatgcctatatataatctacgtaaagggctgtgaacttaccattctgacatctaagtagccgccagttctttcttgagtaagcatggttggtgtcattctgatctgacagcccaatatcaggctccttggtccaatcatgtaccgaatcaggagggcctagaaaaagaaatggtgtatttaagttctctcgtgtagccattacaaaatattaataaaaaattaaaagtatgtttaccattcccgatagttgtcctacgaagcaaagtaggccggggctcttcttcatcttccggtctataatagagtaaaatctcctattacttttaaccagaaggacttacatacagctagataaaatatgaaatcacttgcccactgtcacgatcagagaatgataatgggcctccaaactccatgtcaaagtccagtgaagcaaaagctttgcggtttttagccgtcatagtgtcttgttgctgcagaatgaatatctccgatgttatgcctaggacagttcattggtgtgtcatagaattattgaaaaaatggatgttatagatttcttttgaatctaatatgtacaagggagaaccttcttacaccgtagctaaacaagaaactaatgaaaaaggggctgaaatatccttattacttcgaacaattgccatatgttgttacagtctgttggacttactacacctgatcaataaggagctctagcttctttttccagaccagggcatcctcgatatcatgcgcacccatctgtagaagaacaatactaggattaagatggtatttgaataatgacaagtttactgtatgagaaattttatggtccttaaaaaagtacctcgatgtacctaaattttacactaattttttttgtatctcaaggtacttaatacctggaggtaccaaattttatactagaaagtgtggtacctctcagtactttttcaaggatggtaaaattacccttactgtataggtatatgtgacagaaaaaggctataggatactaaatgaaagagtacacacaaaaggaccactagcatctctcccatatgtagtgttacactgttattgtcaattaaacttgagcaaataaaattgcatagcattagtcaattatcaagcagagaaagggaatccaaaagctacactaatgctagtgaaagtagcgtcttcttttaactatatccaaaagctacactaatgctagtgaaagtagcgtcttcttttaactataaaaccagaatgatgtagaaagggcatcgctcccttttttaggtcaacagaaatatatgacccataaacaaagtacacaaaaaaggatggcaagaaaagggttaacatccagcttatatacttgctttttccaatacactgcagtagtaaaaactatatattgcagacaaaatatcagcaagtgcgtttaaaagcaaattctcaaacatagagtgtattctggtttggcaagttagcatcgtaacgaaccgtgatatgattctccttttctttcttgttgtatatgcacagaacatagaccatctgcaaaacaagaatatcactacaaataagtaaatgacggtattaacgtcacaacagtacagcagtacccctcaaaagtaaggtgtttttcttaaactaaaagatagtgaatttattcaagaaaaaggtatcaagaaactttcccattgaaggaattaaatgatacgctttatgctttatgctttatgttatgatgctagatgaattaaatatgagaagagggaacttacttgaccatgatgtgttttaagccctctgtcttccactctgcaatttccatctatttgaagcgccttcactggcacctgcccatccacaaatcttaaatgaataatcaaaataaagcagccaccatgctcctgttgcagaatttccaatctaaactcgtgtatcagtatggcaatttattaggttaaaatcctccgaataaggcgtacaatcaagagtacttcagctgaagtactctacaataaagagtacttcagctataagaatcttattcaagaatcataatccatgactcattcagacattcttactctccaacgatatgctttacatctaccgaagcagtacatttacagcaaacgctactctaaatgacccagagctgaagagacaaaactccattacttaacaacagtatgtcattaattagcacttcctagcctcaaattaaaagcatccggagatacagatggtaaacagttccaactcagcttcacggttaaatagttggcatcagtttgcaataatcatataccattaaaataaggcaggtggttctatgtgctagtcaaaccactcaaaaatccaaaataacggcagaaaactcatgtgcatcgcatcatgatgcaggcaaattcccctacattcagatttagttatcgtaactagaacatcctccgatcctccactccacccaattggacagaataaaccacaagtcacgaaatcccgctaaaaattcatgagaaactcttgaaaaaaaaaaggtagcgcagctttctgcgagactacgacaaatgaatcgcatcgcgagttcgcgagtatgacagcaaaatcaagagcataagttgcaggatgatgatgtgtataccatgttgtccttgggctgcttcttgtagtaggcgagcagcttgttgtcgaggacgaagtagcgcgtgcggacgaacgacctcccaatcttcctccgcccgtaccgcagcatccacccctcgtgccgcaccgcggccgtcgccgccgccgagaccttggggagctccccgctccgcgccatcgccgccgcggagggcctcgggggatccacgccgccggcgcgccccagctcggagctcttcgccgccgcctccctcctcgaggtcgacgagctcatcatcatctccggcggtgatttcgaattccaactgggtcgcgtcacgtcccccgggccgccacgtcaatgagccataccccagcgggtgaggtggcaccggaggggaacgtggaggcctaggcaaggcgcaggccccgccgaatcacggcggccggagccggcgaggtggccggcgacaggcggaggaggaggggagggtttcgaggcgggggaggcggagagagaagacgagagattaattattattgtaagccactattaaatccccaactactactttgcatttttatttcaaatatttggcttttgcctttttcgaggaaatttctggtctagaccttgtgttttgtctaaattacttattgttgacttggggggtcttttgagtccattgaagttttgtaattttggagatagtactgttttaaaatatgaaagacaatagtacaagcattaaaggaatttgtggttttccaccttttctgtgacattttcatttatttgaaaatgaatatgaccacttcttggtcttcaacttttgttttgttcatattcaatggtacaaaagaatgaattgaatatagcaagttaaatgttgttttaaaaaaggtattgtaaaacatttatatatagaaagtgatactcttcccatttagaggtttggaaaacgtgcacgtcgtaatccacagtcataagagaaaacagtgatggttagataagccactctaacaaaaaaaaccgtaacccgtaagtctagaacactcttaaccaaaaaaaaaactctcaaactagttgaaatacccttcactaaaacaccatgttgaattttcgattgttaagtgtacaacatctaagttttttttaacgactcacgtaacatagtgcgaagttcatattgatacaaccctgataagtcgtaaccagaaaaacgaaaaattacaatattacagtatctatgttgacatggtaccaatatgaacatctgatatcatcttacatgtaattttttttcctttgagattcaagattttattgattatgtaaaaatgtcacatgccagacaggaatggtgctcaaaacacacaacttgtggagtttaatatttattcaaataaaaaaaggggaaatagatgttatagaataaacgaatcagtgtatgaaaaaataatttgtagagaaaaacaccattcacgtgcatcaatatacaaatggcctaaaatgaactgcactagaacaaacacaaagaattgcgattcaaagttttgttatgaccatgaagaaagtttggtttcggaacggatgcataattatttaatattttaataatcttgtaatggattattatgtcactagatgtcatataaaatgaaaatgttccaacctgcatacgtaggaccaacttctttttcctgaaaaacttatgtagtaccaacttgaagtaggcaagaaatgcaggccgtcaaaatatttcttatcaacttccaccggcaaaagcactgatacggagtagtggtatcttctatactacttaaactttactagattcgaactgaaaaggagcaaaagattaacagagccttccatctgaaattctcaatggcatcagtttaataattaagttgtgtatcatgtgctggcctcggagagctagaggggccatttgtaattatcttgatttgaaggggctatgctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13690 - DNA, 820 bp, Oryza sativa
  unsure (1)..(820): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgttctgaaacttagcagccaggtagagcgaaccagcagctatgtattggggcttatactgtaggcacagtgttgttttaagcctacgagcaacagaatgaatacatccagattgatcagttgaatgaatgaagcatcaaaacaataatgtcacaaagtgatatgtcacatctcataccaatcatttacaaagttccaagctacttgtttcacttccttctgagagatcccaagtttttccatagcatcaagtagtggtctgtaaggatgttggatgttgaaatcaaaccgaacagttgtaaggactaatctctccccggtcaaaattagtgctttctgcttctcaaatacatcctgttgatagatactacttgtcaaccattaactggatggtacatatatactgaaaactcaattaatgatccaactataccttctggtggattcttcgagctgtagctgggtccctcctgtacattgttccataggccactctaattacttggtccagaggacaaggtgtatcttcaacttttgaagccagaaatatgcacactgttgcaatcgtctgcaataaaaaacaagtaaagctattggctctggaatgacaataagcaaataaaataaacaccaattacttgtaatagtatttagttatagacagcttgcatcacatgcacagctttttttttcttttcttgagcaat

SEQ ID NO: 13691 - DNA, 34298 bp, Oryza sativa
attttagcttctaataacaggattgtaagctgtattcctgttggctaatggcaatagtgtaacttcaacaggaatgctgaacagacttgtcctcaaaaaggatgttctattgtattgtacaatacatctcaatactattgtatcttccaaacatcccaagcaaatcaaccataaatcagactatatcaaaactttacagcacagtaaaaaagtaaggaattacaatataggattactgattggcacaagtagatccctttggaattgaatttctaaatcacctaatggcactgtaacatcgccatgcacttaataagcaatacaagattaaatgttagtgttattatgcagcttcatatttattgtacaaccgataatagatcggaaagttaagcacaagttgcaaagagtatatgaactgatcaagtataaaaaatatgcaagggttatatatgttccttgagaacctttgccagtaaatattttttaaagagaagattgtatccaattgcttttctaaaacattctttcagaaaaatgctttttctaaaagacaccaacccaccacaacaaaagagataaattaaaaaaaaaagctccttacctgccatccgtttttggcaagggactggtacagatagaagcgatggcagaacattattgctgttgctatagtcatctgtggtctgaaagaaaaatgttaaaataggtaacaagcttagcaaacttccagaataaaagaaattattgtgtgctaactaagggcacaaactagccgtaaaaccaacatataagtttgaaaagtgagctatactgacattaaaaggtacactcaacaaggaaattggcacatacagtttcagtctaatgccaacatcccgaatgaatgaacagtacaactgccgaatttctgactccattatctcagtaataccatctttcctagatggggaaaatttctccagttcttccctggtgaagtaccaagagtacatgtgctcacatgataatttactcgtctgggattccccatccatcagtatgtttgaaaaaacctgcttaaggaccctccaaaatcttcagtgtagtttcagacagaacttccgaattgcttgtgctgaacagcctgcagaaccatgaaatttatgtatataataaaaatatctacaatatgaatccacatactgagcaacgaacattatgaatgtaaatttaagccaatatgtacagattatagctaaattgtgcatgttttacatgatctattcctttgatagcttgctacagttgcattcaccatgctactgtgaacatttttacctccctttccctcaattggcagagaacgaaattaacagaaatgttaaaaaagtttctcatagccacaaaggaaaataaattatattgatgaagatgatattttttaatcaaattaacatacatggtataacaagatactaatgtattccatcccagaaaatctctcccctatatttttgagtataacatgagccatcatattaagccatgtcatcatcattaaaatgctaatcatctgatgattttactttaaaagaaatccataagatgacctatttcaattttatccataactaatcaagagtcacggatactgatttatattcatcaaaatgctgtgtgcagttatattcattacatttccttccatttaaaactcttttgttcagaacctgtacagacatgtgaattccacgagattgaatcttttgaacatgtactcctaatggaagacgatatccggcattgaagcgtctatactccagaggaaatcaatgtgtgctgatgagtttgaattccaaagtctaaattccaaaaccttaccaaaaatgtagatgagtttgatccgcctcaatgcactaataaaaggaaaatagcactgagcagagcttagaaattctaaagcctacttgcatggtccaatttgtaaccataatcacttatcagttgcatttcaagatttctatgcaaacatcttgcaattactgatttgtctgttcatttcagttcattgttgtttgtgccctcttatgtgccaattaaattgttgtttgtgttctctgaagtgcaaacatcagacattctgatctgttgccatgcaatgtggagcattgtatggatgggatctatcgacaactatacatgagacaatgtggatataggagtacgatgtgagatttccgagatatccagtgtaaatacatggtgaaatgtttaactaggtcggaaacatgtaaaccacagaatataagttctcaaaaagagttttatttgaaaaaaagaactcaatgatagctatatgaaattagatgggcatacaaaattcaagataaaactcaactttgtttgtgagatattaagtttacaaatagcaaagaaaaaaacacaaataaagaatactctttttttcctcactgtttatcaatttcatatgtcctgaaattttatatggttgtctaatataaccttcctgtatgtgagatattttagaaatttatgcgatagttttcccatgtttaatatccactgcatgtttttcccatatatcaatgtgcaactacacattacccattgaaagttttcgcatgtattgcctttccggttagaagcagacaatacacaatttcaaggatgtggtacacggcccttgggttctgcttaataacaattgcacctgagacaagttaacggtattccattatacaaagagaataatgctcttatgccacaaagttggatgcgaaaactctcattttgaacaaaagtttgaagcctttactaaaatgccacaaaattgagtaccaattcattcttttaccacaatacagtgtgaaattccaaattaatgcccaccttcttctccttctccatttttgtcctatccccacccttcttctctgtgtccagcaaggacagacctagctctgtccggccaaagtttgagccagacctggcagccagcccactcctgcacgtccgacgccccactcctgcatgtccaacgcgcacgccatctccgtgcacctgagctcggcatgagctatgacaccctagctccagtagccagcttcaaccttagcattacctccgcctctggccgccagcagcacaacaatatgcgtcctgccctcagcaactggctctgtgcagcccacctactccgcgcacggctttcctcctgaaagccagttccacgcgccctgctcccggccgcagtggcggacctaggtcctaggcctgggtgtaaaagcccatagagagacatacatttttaagatataattttctgttgggccaaacacagtgggcaccagcccgtgcggccaagctccattcacaaactcatagaagagagaaagagggtgcagaagaagggaaaattgcacatttggtgggttaaaatggtaaagtgtggcagataaacgagtatacaactgaactttgtggcatttttacaaagccaacaaatcatgtggcaaataagagtatggcatgcagctttgcggcataagagaaattttctgttgtacatacaatcttcacagtatagaaattctggttacaacaaaaacaacatgctgaaaactatgtcttttgttggcagaagattgtaatatctcatccaaatccaagcttaactgaatgtagaaaagatttctcaactagcagtaactatttatgtataggcacaatcttcttgaccaagtaaataatagattctacaaactgcgctcactaaaagttggcagactttgggtgtaatttcaaccaactcccagttaataaactgaccaaatttctcgacaaaagcaaagcagtttgtccacccctttaggataacatctttgaagacaaaatcaagaatacacacaagctagtcccagcccgacaaaaaatctagcccacaagatatcgttgtaaaaggtggagaagcaatgaattcacatcgacttctgcatatgccatacggccaatacgtcaaacagcgagaagatccccaaattgaataggaaatcacgacgaagctcgtcggctcacccatgaattcacctcccaattcgccaaagacagaatctttgacctaaccgggggcatgatggggttcagttgaacccccaaatctattgtttgtggaactaaggcggagagaaaagcttccagatctaggagagaagataagggattaaaaagaggatgacgcgagcagggtgctcaccggcctgcgaggatgcggcagaagcagcaggctgctactcgccctcgcgagatggagatcggcgcaggcggcgggtgggcagtcgaggccgaggggacggggatgcgggggagatcaatttccctaggccgggcgcgacgactcggaggccacctacgccgtactgcactcggatactattgacttgcgtccagtgccccaaaatccacccttgaaatgcatccaacgtctcaaactgcctcccctactatccggtgtcactggtctgtaccgtgtaaacagctcacttccaaggtcggacctcgccgctaattctgctatcatattttggtctcaaatatataattctaaattactcctagctattcactgggtgaataaggccatctacaatgtgtcttcaacccgccccagcgacggccgttcgcttttccgttcgagccatgccctggtgatggcgcgcgacccctgcttgggagacgcgcctcctccttttcggctagggaacgggctagaggcacgcgctgcggcgacagacgcctcaggcgactgtctctccaccaccatattccccttccacccctctccccctctctctcctctcctccgttctcatcgcgagacggcctaccccgctgagccgagctcctcctcgggcaccgccgaggtgcgccgtctcctcagcctctgctagcgggagagagagaggcggtgggcggagtcggccaccgtgcggcagccgtctgccgggctcgtcttagccatcggcagagggagcggcgggatctcgagctacggccggaaatagcagcgacgagagagagagagcgcgcggcgagcggcggcaacggcggatccccggcggaggcaacgggttcgcggcggagtaggcggctctcctcgtcgccctcgtcgacaaagctccggcggcgagggtggtcctactcgtcgcccttgcggccgccaccggagagagagagagctggggtgggtggcgacgatggcgtgacggagaaggccagggaggatgccacccgcctctcgccgcttgccgtcggccaccgcagcggtgcgctgggcctgagttggaggcggcggcgagagggagaggcgagtgcggtggcgaaaaaaaggagggggcaagagagagagagattaggggtaggatagtaaaaataaatatggggctttgtaggctgtgatacctattgtgggttggagtgtctctattaagttgtttcagattttgaggagcccatccaggggtatcctccattccgagctgagttcctctacagcactctagaagtggctcacattgtggattccctaaggacaatagcagtacaatctactcaaaatcatgcctcgctatgccacataggatgaggttcctatatggacactagctccacaatggaggctccacctaacaactttttttcatctcagcccttaaattcttctatgtcagcccttcctatattttgtattaacaaaccatccaattttttatatttcagaccctgcaacaaaaaaaaaagatctacacacataatcatgcctgcccactgacccacttgtcagccatcccttactttttcctccccctcaccccgttctctcgctcccaattgcatttaatcctcatcccctcccaagtcccaacgaagacgccgacgcctctccatcttcgccgcctcaccaacatcgcccccagcttcatcgcctactctcctctccatctccgtcggcgccacccatctccgtctaccctctcccgttccccatccatcccctcccctccagcggcaaatcaagttccaatgatgcaaccaagctcggtggcggtggagcttcggcggcgggaccgaactccggcatcagcgaattgaactccgacggcgcaaaacaaggttggctttctcctacgtggatcaaggccgacagtgtgggcggggcagtctcgtctccggcaagcaccaagtggagcaacgtcggggccatcgcgacgtggagcatcgacggcatcctcgggctcatctctggcaagcggcgagtagagcagcggcaggcccactcgtggtcgttgccacgtccggaaattcactagtaatttccgaacttatttgtgcataaaaccctcgtccaggaatcagccgaggtacacaaactgacaatttaatatacaaatccatcataataataacgttacatacttacaaaagaaaagaaaacagcagcggaaataacggtctagcgatgacttcagctccattcccacaggcagctcaactggggtataagccaaacgtcttctccttctggatcccttttcttcaattgaggttgattgattattgcaagaataagcatatgacatactcaacaagccacacagcaaatatgcaagtgcacaaggataccaaaggatggcataatataggctcatttgtaaaagcagcatttagcaaagatttaagagtagtaaaacaatagagtaattaatcatcaattttaatcaacactgaacagcaccccaatgctgtacaggcccaaccaaacctgaacaaccaaccccggctgtacaaatctaactccaaaccaggagctaagcaaattattaccaattatagcatcaataattattgtgagatgtgtgagactaatcacgaaaaacattgctcaactcgcccataaccgcgggcacggctattcgaatagttttactctggccagaggtgtaccactgtacctacaagacacagcctcaacatcatgtctaccatgcgtcgcgatactggaaagtacccgaatagaggctatgacaataccctctgcacaacacaactcaccacagtgcaccatacctggatcataatcaccccctctataaatacaaccagaggcatggactccccagcgacccccacggacttctcgccgcttctcagtctggtgccccgcaatgaatcatgctatacaaaaggtaaagccgttgcctatgctggcttgtggttggcacggttaatgttttacaacagtagctcgcgaatcggtccttaattgccatgagcacgaccttcacaaccatgtgctcacaacccaccattgacaaattttaattggcaataattaattaaccaatcacgattgaccatcgtgagctaccattaaatataaccataagtgatagtgtaacattagttatcccaatcatgtgctaatgtttctaagcatggctaagcaattatatatatatagcatttagctgaacccaaaccaatatataaggttctagctaatcaaattataacccataggaaaataaagccatcttcggccattaattaattgtgaaaggctcaccacccgatgacattcgaaaataatgcataagttgaaatcaaacaatagctttaaacgggttcaacatgctcaaagggttgtttgggatctttgtgacttgccttgagcttccgcaaacacttccgaaccttcctcaacgaaaacgctctcctccggaacgtcggaaactaaaacgaaagaacaaaatcaacaaaatagtacaaaaacaagcataaccagtacatgtggatatttttaacatgtagatcttgattttagaaaaatttagcaacttgaaccactcgaatccgaggtacgatgatttagttattaatttccgaagtttaatcgattttcatctaatagagaaaactaagaaaagggattaatgacgtcatcgctgacatcatcaatgtcgactcgacatcagcgacgacctcgccggcgctagaagactcggccggacttttggagggtacctacgcgtagaggagaacaacgcgatctcaccggtactaaccaatgcgacgaacgacgaccggcgacgagcttgtgcggcggcggcggctctccggtgaccggtggtgacggcgaaggggcggccgagcttcccctcttccacgcgcacccgacggcgacgtgaggaggcggcggcggcggctaaaacgacggcgcgaggcggctgttcgccggccggcgacggcggcggtttgggtggcgcggcggcggcactacggggcacgagagagctcgggacatggggcaaacgaaagaggacgactaggggatgctatttataggcttggattgaagagatcggactccaaccgagaggaatcgaagccggaaaatccgagggttagttggagagataaactcgaaaacgaattcgattccgcgttgatttcttcgtgataaagtccgattcttgggggaaaggatagaggaggataagaggaatatttcccctcaactaattttgcaaacggagcacgggatgcggcggatttggtggaggaagcggcgtcggctagagcacaggacggcagctcgggcttctgtccaagcttgaagacgacactgtagcagggaggagaattagacttttcgtcttgggctggctgaaaacaaagcaaagaaagaaagaggaggagctcggatgggccgacttgggctgcacagcacgcgcgcgagggagagagatgttgggctgaaatcagcccaacggcttaggagaggatttaaaaactttttccaattaaaataatcactgaaatgatctttgaattgttaaaaatacttccaatgctcaaatagtttcaagaaaaatcctgaaaatacttggacactcaaagtacttaacaaaattataatcagaccatttaatgattaatttaatatgtggataattactgaaatgttctttgtatggttaaaattaggaattgagctccgaaaaatccgagaaaattccagagagtataattaaccatggagaatttaataaaaaataaatccgtccatgctttatatttaggaaattttatttcccacatttaacttctcttgtaaattaatgaacatttaatataaattctaataataatttattaaataatttataaatcctaaaacgaaaatcaggatgtgacagtcatcctcctcctcgcttcgagaggcggccccagtggtggatctctacgctgccgaccggtggtggatctcgagcggcatccccggtggcggatctcgtgtgacggcccggtggcgactccagctccatgagctctcatgatgaggacatcaacaccatcgatacatccacgtctccacgactacaacctcatggtcctattacctgttgacggtcattatagacgaatttcgaccatcaatactgttggaaataatggagaactagaaatgcttgcatgcatattcatttagaaataacctatttccactagtacttgacaaagtacttgtatacaggagatcacttcataaattaagaagaaatgatggaaaatcaccaatcagaggtcgacatgcggtagacatatggatagatgggcccacaaacctattgaaacacttgcaaatgggaccaaccaccataccactgggcccaggatccatcaggagacgttcagaaggaaggactggcccagggaggcctgccaggcgtcggccgacccaggcttggctccgctggcctaggcccaagccaacgacggttactactgaccttccaatgacggttgtacctgttttggcacctccaaccgtcattctcaagctataaaaggacctcatctccttcattccaacacacaccaacaaggaatcaagtgaagaagctttttagtttacatattttgctctagtgctagtagagtcagaattagaatagtcttccttagttcttcaagtcttctggagaattcgggtatggttctactatctcttccctctcttgtaagattttatccattaatgaaatatttttctttatatagttttggtcctttactatacttgtataattattcgagtaccaaatttggtttatacttgactcgtattaaatatgtggctagcttaccaaagatatgcaatggtattggcttagtgttcattcatatggttgctctatgtcatctgcagaggtgtagagtaatatttagtaatgtaagtgtggtgcttagattattagatattattaagtggtgttatatgccacagatctgtagaggtaggccgctgatggtgatagctcagcacgggtattcctccacgtcgtatatagggctaagaaggttcttggtgcaggtactcctccatatctttaaccggttggatagccatgacggattgtagtaaggaattcggcaatatggggtggtttctcaatatattaggaggacatagttagggggtattagccataaagttgtacaatagcaaatgtatactaaaatgactatatactagaagtgcataaatgatatttttctttttttttatccacttagcctagacttatcaattatcaagagtattctaaactgatccttctgtgtgtcaacctatccttatcctaaaatgattaactcctgcaaaagactttgattttatataagtgtaatatgaatttatagcatagtactctcttaccatatcttttcttggaattaaataaatacgatacttggaaatatttccagttgaaatgctacagtggtatatccgtgaggatttattctataacccataagaataccgtctaatatctctggcaacattgcttgggattaatttcctagtaatgtcgttaagaaatatcaacattacctgcgcttgtgcacgtcaatatcaacattacctgcgcttgtgcacgtcaactcaactatcaggtgagttcattcttgagttcatgttcatcttatttatacccccagagacatgtgcactcttgttttacttaggaatgatagagaggatcaaaagggagaggattcgcgcgggctggattcaaactacaggacaactccaacttgtgacgaccgccacgacttcctacgaactccgatttgggcgtgcaagtacttcatggaaagcttatcaagtctactttgaaatggatctggcctcatgtccatatcaattctggagtggccgcaatcatcgctttatcaccgagcctttttctatcaaaggtattgcgtcaacttatttgggcccaataggctatgtatcaagttgggtccattaaggacgcgtcctatgattagagcacaaccccaacacccatgtggttgttctccccctcttcttatacctttatagccactgccaagaacaattggtttttgatgatcagagttagcaacttgctacctgcttgcagcgcgcgtgttggcgaaaccgcccgtctgcttctattcggaaccctgccatattgtgatttcctagtgaaactttcatattcatctagcagttctacttgttcttcgattgcttgcagggcatacgagtgccctctaggtcgggttgtcgtgcaccacaagttcgtgacgaccattggtgacggtatatcggttgctaaggcgcaacgtccttggacggttatagttgggccataaacgtcgtcttcatccaatcgagttatctccgcctcttattgaaagattgggatacaaatccctcgcgggttcacaacaggtggtatcagagcgtggttgatcagtgagagattatttaccctccgttgtttattttttttcctatagtctagaaaaagccaaaaaaaattagattagttagggcttgttgagttttcgattgcatcggttgtgtcaacttgttggtcttagcacttagtctattagagtttcttgttcttaccacgcacatcgccatcttcatcaccgccgccatcaccacttttgtcgtcatcagcaccatcacagccatccaccaaattcctttctgtttgtgtttgatatgttccttttattgagtttaattgtcgttgagcctgctgccaccagaaaggaaacagaaccctgattcgagtgatctaccttaaaggaaatagaaccctgattcgagtgatctcccttaaaatagtcgtatctttttcatatggactcgaaatttggcataatatatccacggacatctacctaaaaaaattacatcgccaaattccacactcgacaaaattaaaatcgcgaaattccacttgcaaaattatgtttttgaggcgagaagctttgcaaaacctttagatagaactttgaaaaaaatttacatgcttcatattttgtccgtttgagctaagaatttatgtggttggttccaatgtgctcctaactgtgaaaaaatatcaaaaaaataaaaataaaagttccatctctctcctcagcaccttccgccatttcctgttgtcaccactgtcatcgttcctgtttaggtttgtgtcttgtgatgttctttgtggttaggctcacgtctctacttcggctagcctaggaccagtcaggcccggcccgggggggtcgagctgggcctccacacagggcccacgaagtgaaggggcccaaccccatatatgctgtacataatagcccataggaactaagaagcccactagctcaggagaggaagaagcaaatgtacaggaaaaaaattgcgtcgatttggcttccttccgtgattccgtccgatcgcttcgccttcgctcgcaatcgcctgactcttcgcatgttcggctgttcgccaccctcccaggttccagccatgtttcagctacgtcgacgactgcgcgcggctatgcgtcaacggccggtgtcgtgctcagtgccgtcagcggcaccacgacagccggtagccagatgcaaatctcttatctctctgactctctgttcagttctaggagaccaggaggtaccccattgctctcccctttgatgtatgctaagtttatatgtttaaattttgggatgcaaaatgttactccccaattgctcctcttctgatttctgaaattttgatttaggatttagggatcctcgcggagtcgcggtgcagctgtgcaactagggcagtgaatagttattttctttagttctcaactaggtaatttgccagcactcatttttattataatgttgaattgaatctagtatgacataattttcataaattacttacttttttctaaatttacagtgaaatcatgtaatgtctcaagaaagattaaatggtttggcaactttatgcatcgagaagaaactattagatgaaattgatattgatgccatcgtcgatgacttcgcatcggtacatgttagaagaaaattttaaggtaagatatataacttgttttataagaatgtttttttatgcattaaatttattagaaacatagttatattattatagttgtattaaagggcccatttttctagcttcgctccaggccactgaattgacaggaccgggcctgtgaccagcactgtacaaaccttgaacgattatattattcaacttgatttggctaacttggttgctagttttctcttgagcattactttcagcccattgacaactcaaccacaaacctgactacaacttgataggtcttgttgctacggcaccgatacacctcgttccacggttgcagacttgtgggttgacgtcccctcctatgagtaaggtaagaattggtaagggcttgtaagataggctgagagtgagcatcttgcaaaagctacatcccaatagttgtagggcttatatttcctcatttgttgtttttgttgcctttgttttattagccatggcatgttcagaggataatgatgaggagggtgcgtttcattccccacgcaccaaaggcatcataaaatattttacaaggcaagttaagtagcacaaagaaggacttgatgctgatttgcaggtgacaaatgagaagaatggacaattggagtccacacagatcgccaccaacatcaagcttacagggttggagacatcgatcgcttgcattaacactagccttgctgctcttgtgaggcattttgatgatctcaatgctagaggtaatggtcgacgtaatgaagacggcattgaggatgaatatacgctgacactaaacaagatgatcgagatgctcttgatcgttgacaactacgcaataatcatagaggtatgggtggtcaccgccaacgcaaggtacgcaataatgatgatgtttttttttctaaaattaaatttaagatacctcctattgatggaaaatatgatcccgatgcgtacctttcttgggagattgttgttgaccaaaaatttgcatggcatgattttcctgagaattctaaagttactagttagttcactgatttttcttcggtttggtgaatagaacatggcaagaaaaatcctaataacatgccacaaacttgggatgcttttaaacgggtcatgcgggcatgatctgctccttactttgcgtgtgatttgttgaataggttgcaacaattgagacagggtgtgaaaagtataggggaatattatcaggaattacaaatgggcatgcttcgttgtaatttagaggaaactgaggacgctgctatggctagatttttgggtggtttaaatggtgagatttatgacatcgtagactacaaagattacactaatatgactcgattgtttcatcttgcttgtaaagctgaaagggaagtgcaggtaaatctacattatgataggcaggcaccacttctccggccggccgtactccttcctcatcttccacacccacacccagtcgagcagcacctcctccatccagtaacaagccacgtggccctcctgcaagttcaacgacaaaggctgtttagctagccgcgagtgcttcttcaattgcatccacgggtaaaacaagagatgttcagtgtcaccattgcaagggctttgggcacatgcagcgtgactaccctagcaagcatgttttggtagtcaaaaatgatggtgaatatttgtctactagtgatttcgatgaggatacacttgctttgcttgcagctgaccatgcaaataatgaggagccgccagaagagcatattagggctaatgatgcagagcactatgagaacctcattgtgcagcgtgtcctcagtgcacaaatggagaaggcggagcaaaatcactgacacacattgtccaaacaatgtacgtcatcaaagagcgttcttgctgcatgatcattgatggaggtaactgccacaattgctagcagcgagatggtggagaagcttgcacatagcaccaaacctcacccacatccatagtacatccaatggttgaacaacagtggtaaggcaaaggtaacaaaactggtgcgcgttaattttgcaattggaaattaccatgatgttgttgaatgtgatgttgtgcctatgcaagcatgtaggggtgaaatcgggtcaggttgggtcggatctcacccttcccgtatcctaacccacattttgcaatcggaatcgggtcaaatacgaatagtgtcgaatacggatacaaactcggataatatctggcacaaatatgaaatggatttgtaccaaaacatatatacgctatcggttacgaatgtttatttggatatctagtcaaaaaaacatccctatatatccctatatattcataacgtgactatattaggccattagtatcttacaatcaacgagcttctaatgtgatattgagaaagggaaatgaatcatcggcatccgtctttaactgtcctgtgtgaagtgactagtagttgtctggctgctaaccaatgaagtggggggggggggggtggagacgaggggtatgcagcgcaacgagctcatgagtcacgacggtttccagcggacttccgactgcgggtgcattggggtgtggtgaaccgacgggtgcagtggcaatggcggagactcgacggggcgtgcaggcgacggaggatcgacgtcacgagcgttgtggagcttcaatggacgcggcagcggcatggcgacaacggtgcgtagcggcagcggagctgtgtggctatgctacctatgtgttctgtgcatgcttgggttaggctgcctggctggtggctcgtgggccatttgggcctggtggctggctgggaagtagcatgttatccaggtaatatccggatatttaaccgggtaatatccacatattttaccggataatccatatccatcggataccaccctccctaactcgatacatatccgaaagaaaatacctgtattcgatgctattgtgttttcgaaagttgatttgcgtagtcgatgccaccaaattcacatgaaactaggggatgaatggaaaactgctttcaaaaccaagttcaggtgatatgagtggttagtcatgccttttgggttaactaatgcacctagtactttcataagattaacaaatgaggttttgcgtgctttcattgggaaatttgtggtggtatactttgatgatttattgatttacaacaagtctatgggtgaacatcttcatcatttacgtgatgtttttaatactcttcgtgatgcacgtttatttggtaaccttgagaagtgcaccttttgcacagatcgagtttctttgcttgtctatgttgtcactttgcaggggattgaggttgatcaagccaaggtggaagccatacaagaatgccctgttccaataactatcacacaagtgcgaagtttttttaggccttgctagatcttaccattgctttgtgaaggatttcagcaccattgttgcgccattgaatgagcttactaagaaggtgttggcggctgttaaatgccaattttataccaccaatacatgcataaaacatagattataaaacatccaacgtagtggtagggtttaattctgacattttccaacagtgttggtgtatatttgaatgtaggtaataaaccgccaaagttgggaggaaacttagaccaaagaggaggagaattctatctatacaagaatttgactcataagagtttactacttgttatgaacggtttactacttgttataattggactcataacaagaattggactctcaacacagactgtaggatcgagatgtcgactagaggagggtgaataggcgattaaaaattaaatgacacctaatcaaaactaacctaagttgctaggctcggtgagggacacgactaagtaagcaactaagttatgttttgcaatcctagggtgaaagtggctcaagtatatcactaggaaagtaaatcacactcctatgtcaatgtttagcaatcctagggtgatatgatctcaagtatgtctctagaaatgtaaattgcacaaatgtaaatccgacaatcaaaagagacaatgagacaagagatttttcaccgaggttcggaaactcgccggtttcctactccccgttgaggcgagcccaactccaccgctcaaccacgaagccaccgcacacccccttcgtcaaggggtgggcaaggccggagccggcccacggagaggactacccaagcctcgatcactcggggtagttcttccttcactccgaaggtagtgaactccaaaccactcacaaaccagcgccgggcctcctccacaatcttctcggagaggtcaccgggtaactcctccacaagccgtctaggaggcggcaacctccaagagtaacaagcaatgaaccggcgtggagatgatcaatcaagtgccacactagctctacaatggaagcaaatgcacttgacacttggctagaacaacctcaaccactataatggatgaacactaagctcaaagatgtgtgagagaggtgcaaggggtgtatgcaattgaattgggtgccaagagagtccccttgctgctggtgggggagtatttatactcgccgttgggggcgaaatcccccaactcagtgctctgccggtctgaccggaggtatgtggccggtcagaccgtgctactctacaacggctagttgctgtcattgggccccacagccgtggccggtcagaccaacatggggtggccgatcagaccggcctcggctcagtcagaccaccatcagctcggtctaaccgaatacggctctggcggctcgggatcggcacaccgagacggcaccatcctagccatatggccggccggtcagaccggcccgcacccgccggtcagaccggccttgaggtggcggtcagaccggcctagaccctgcggtcagaccggctgccctggccagtcagactggcacttgagccgcggtcagaccggccctggtcaggccgaaaacagtgagataaaagtttgtgtgtgtgtgtgatgaaatgagagcacaagtctaaatgcataatgacctaatgtggcaattaaaatcatctctttgctaggtcattaaccctcttaatagttcggcaaaactataaataaactagcacaattttgatcgcccaacgcctcgatcaatttagaaaagaaaacactagtttactgtcttctcttcctttagctttgtgccgtcaattttaatccataggtagacatccatgcgcacacataatgtgaacctaacttaaagatatagctcaaaagaacggttagtccacaattagcgcttgtcattaattaccaaaattaacaccgggggcctagatgcttcacacacctttatatgcatcgtttggggatgacaagtagtagaaaacaaaagcttagtccccaatttagcccacaaagttctccaaaaatggctatgaaatttagtgtcacgatcagaaacaattgtgtttggcacacgatgcaagcgaacaatttctcaaaagaacaaatatgtaatatgggtagcatcattagtcttatgacatggtatgaagtgtgccattttagaaaatctatccacaaccacaaaaatgctatcacgccccctcttggtcctaggcaatcccaacacaaaatccattgaaatatcttcccaatgaacactaggaacagggagaggcatatacaaaccatgtggatttaaacgtgacttagcttttttgacatgtagtgcagcgagcaacgaatctctccacgttttttctcatcttagggcaaaagaaataaccagcaaggatgtcctccgtcctgttggcaccaaaatgccccatcaaaccacctccatgggcttcctgcaacaacaataagcgaacagagctagctagaatgcatagcttgttagctctaaaaacaaacccatcattgaagacaaatttgtccctgtctttccatccttacaatatagcaacacatctttaaaatcagcatcatgcatatattggtctttaactgtttctagcccaaaaattttttagtcaagttgtgtcaaaaaaagtatatctctactagacaatgcatcagcaatgatattttccttcctttcttgtgcttgataacaaaggaaaagattcaataaattcaacccatttagcatgtctacagttcagttttccttgactacaaatatgcttcaaagattcatgatcagaatgcatggcaaattccttgggccacaaataatgctgttgtgttttcaaagtttgcacaagagtatacaattcattatcataagtagaataattcagaacagacccactcaatttttcactaaaatatgcaacaggttttccttcttgtagcaaaacaccacccaatccaaatcccactagcatcacattcaagttcaaaaagtcttattaaaatcaggaagttggaggagaggtgcatgcgtcaacttatctttcaacatgtggaaggcgttctcttgtgatgtgccccaagtgaaaggcactctcttctttgtaagctcattcaatggtgcagcaatggtactgaaatcccacacaaaatggtgataaaaccctgcgagtcctagaaagctccgcacctgtgagaccgttttaggagtcggccaactctgaattgcctcaacctcaatcccctgtggagtaacaacataaccaagaaacgagactcgattggtgcaaaaactgcacttctcaaggttaccaaacaaacgtgcatcatgcaaagcattaaaaacatcacgtaaatgatcaagatggtcatctaaagatttgctataaattagaatatcatcaaagtatagaccaccataaattttccaatgaaaggacgcaaaacctcattcatcaacctcatgaaagtgctaggtgcattagttaaaccaaaatgcatcgttaaccactcatataacccaaactttgttttaaatgttgttttccattcatctcccaacttcatacgaatctggtggtaaccactacgcaaatcaactttagagaaaacagtagagccaatcaattcatcaagcatatcatctgacctaggaataggatggcgatatctaatggtaatgttattaatagctctacaatcaacatacaaacgccatgatgcatctttctttggtaccaaaatcactgaaataacacatggactaagagactcgcgtacgtaccatttatcaagcaattcttgaacttgacgctaaatctcctttgtttcctcagagttggttcagtatggcgcacagttgggtagtgaagctccttgaatcaagtcgatcttatgctcaattctacgcaccggtggcagccccggtggtacgtccttgggaaacacatcctcatactcctacaaaaagttagtgaccacaggaggaaaagagatagcatattctcaaaagaaaacaaggcctctttgcaaatgagagcatagcaaacagtgtcacttgtatccaaattttgagtattattaactcaaattttaaaccacatataccattatctctactacttaaaaaatctatagtagtggtcttgattcctgacgtagcagagacactagacagacacgcgcagtcacaaccatcgaatcgccagatccaacggcgtggatcatccatcgcccattcgcccgatgctgtgagttttctttctcgctaaaccgctcccgatccccttcctcccactctcccgcgccgccgaaccaccctcaccacccaccgcagccgcgtcctcctcctccccaccgccgccgcatcatccccctccccaccgcctccgcatcctcctccccatctcctgtcgcgtcgtccttcgccacgacgatcccctctctccgtgcatccatcgatcccgcggcgaccaccgttatcgtcagtccctcctccacgcccccaacaccgatcgcgccgtcctatctactgtcgtcgcgtcctcctccttctccggtcctccccatcaaccgccgctgacgcccctgcctctgagtccactctagatccgccgacgcctactcctctgcccacacgcaaccaccgcccccgccgccgagtgtcctccccagcgctccctccctactccctggcgcatcctcccggcggtctctccttcgggcacccctcctccccggcagccctctggacgtcgaggggggcagtggcggccgagcaaggattgccctggggggacgacgagtccctgctccttggcatggcatcagcctcatccagcccggcgacctctcctttgggcgcccctcctccctggcggccctctggatgtcgagggggaagtggcggccaagcaaggattgggacgatgagtccctgctactcgacctggcatcagcctcatccagcccggcctccatcactgtgcctctctcttctcagatccactgtagccggagtcatcctccatcgcgcctctgtgcttttgctcaccggcgccgcctaccagcattacatctctgaactctcaccctctccatcgagagtttgcacaaggtacacgtaggcctgataacagcttgctcacttaagtctgtttatgtcttttttctttacaattttgcatcattactttgcctttccatcttccatatattccttaagagttacgactgtgtgtatttcagcctttataaacatattcaatcacctagcaatttggttgtgggagatgacttgcattgcataatggaggtaaatggaccatcagctgtggtaaatgaaaatccaacacaatgtaattccatacagggcactatttgaatcgcttatctggacaactatcttttatacaaagtcgtccccaattctttaccagaaatcttatgtttagttattggcaataattggtgaataattgatgaaatatgtggtacagttaatgtgcgtggcatgcaggaaagaatagccatcgatctggactaaaaatgttgccaccatctggaattaaaatactgccaatgaagttgctcagtaatattcccagggtatgtgccctgcagacaataaccatgcatttttttttcaatatactagattcaagctatcacatatcattgttgtcgcctgtcaaacaagtatgataatgtcatgatctggctctgaaatatcttgagtactgtttgaaggtaaatattcctgaaaggattatagtaatatgtggggcactttgcttaaatttctaagatacgcctgtcgtatgggaaattttcattattttgggtaagataccatgttttgctttataaattgcacatctactttttaccaatgcttgcaataaaatttcagaagttcatcatctcttggtgctactttccagctatttatattgcattatctccttctgtagccttttttattcgccgttatagccttctatgcctgctacaatatattgcatcatctagcaaggtttgttttaatcctcttcattattacaaacactactagaaaaataatttatcgccacgaaaaaaatcatagcatcaatgttaaaattgtggcaatagatacatgttgccacaatcttcaaatcgttgctagccgtggtaataaatagcgtggtaatagtttattgcaatgatttttatttagttgtaataaattttgatattgccataaaatggatgtggcaaaaaatatatattgcaacacttcacatcgttgcaataaataactattgccaccactccatgtgtggcattagttctacataccaaattaaatgtttcaatattaatttatcatcctaactattttcttttgatatcttgtcatggccaggattcgaaccaaagatctctccctcacgcgcgctctccatgaccaactcacctacgcatcaattttatttaaaaatgcatataattctatttgagactgcctaacgagatttgaatcatgaatttgagtatctaaaatatttcaaatgaaaaattgaagttttagatctcatcgagaactataaatttcatataaaatttgtcctaatccgtgtccatatgaaaagaataagttaaattatgagataataaattttttattacaacgaatttgttgatcatggcaatagaaaatagtgaaaagtaccatgtactatgcaaattgccacaaaaattaaatgtgtggcgatagaacatgtttttttttgcaatagtaatgtttttttgtggtgataacttattttctattacaacaaaaatactgaataaaacaacgatcataaatcgttgcagcaaagtatagttatttgccacagaaaaaatatcattgtgatagtacaatatatcgccacgaattattttttgttgtaataaattggtggcgatagctaaattatcttgtagtgaaacggattcacctagataggccagataacctgaacatgatcccatatttttcttcgtcagataagcagtgggaagcagttggaggaatttctggattacaaggactcgattgaattcatcttttatgagtagatagagtagtccttgagcatgagcctggctatttttacattatttgcacacgattaaaaaaagatggataaagaatatgaggtcccaataatttctacacagtttgatctgaaattcggaatattcatatcctgagactcagagaaccatcaagcatgtctacatgtaggatgtttttctttgatgctgtagtgtcatttgcttgtagtgctggagggttatatctattgacgtgaactgtacttcaaactttagagagaatctaacgtatcaaaggtagccctgtacagctgtactccatacatcacttcagtgtcttccttggttgttcgctagcagctgaaagtgttgtacttctctgaacgcgcatgcatgttttgagaacgaacataataacactgcagaggattatcttttctaactgcaaacatgagcgagttgtatcacagtggtgttgtttggatgcttctgccgctcctcttcaaaactttagctgaatttgtttcatgccattttgcggtttggaagattgtgttacttattattgttgttggtctatttaattgtatgttttggtgatcagtgctcaatatctcgacctgcctaaaactttgttcgtaatctgaattttcgctctcctttgattctcatgttgtatgtaattttaattttcccgttgcgaattaaaaccacttggctggttgaataatttactctttgactgtatatttagtttttcaactaatcacatagtcgggggctacacctattagtcgatgcacctaagtatatattccttattgtttttaatttttttaacccttgacagcctcatgatttggtaaaagcactcgggagaccattgttaagatgattgaagcactcggcttttgatgatttaagttcgggagaagattgtcttttcgactatgaaagtctcagaggctattgtggagattatggtaacatttacccacatggatagcttatccgactggagataggatgtgggccatattcgtatattatgtaaatatactagactttggaatatatattgcggtgtttctcaaggcatattccataagtgttactagtatacaattatgtaaatatatagaggatccgagtcatgtccgattgggtcttcttcctcgtaaccctgccccccgacctatataaggtgggtagggaactccctaagggcataaccataatcagattgtcagatcaataaaacacttgacggatacaatatctgaaatattaataaggtattacttatcgtcaagaaggcgtggaccgtccctttactcattcattttagatctcgtgcgctaccctcttttctattgccaatttcattaaattttgatttataagtataacaataagtgaagagaggggctacaaaaggtttgtctagggagaaaattcgatctatagcataggaaaaaaccgggtaccaaaaaatagcacaacaaatttcttacttcgatcagaagcacaggccactggtttttcttcaattcgtagcactcctgtctttgcgatccaaacatattagttgggatgaggaaagactaatttttcccttagtcctctctattgagccgccacccgtcgccccgccgcctcgcctccgccagtcgcgccgcctccacccgttgccccgcttctgtccgtcaccccgcctccgcatgtaagtcatcgtccccgcactgaggtagggcatggggaagggacactagtacgggagggagaagggagatgtagtatgggtggaaaaaaaacaggatggaagaaggttagttgaggctaaaatatgggtcctatttgtcatacttgtaatagagatgatagatggagaggctgttggagtaactaagagtttgacttgccaaattagatggagagttggtcaaatagacatttggagagttaggtttggagagactgttaggagatgctcttatattggatccttcgctcctccaatctcactcctagagcctgtttgggagagtttttagctgctgcagcttctcccagaatcagaagctcccccaaacagtccagcttttggtatagattctgagaagctgtagttgtagaatccaaaaaatgaactagacccagcttttccagactcacagaagctggctttcaaccagccatttcttagaatcttaggtggtgtttggatccagggactacacgtcagatgtttggacactaattagaattattaaacgtagactaataataaaactaattgcataaatgagagttaattcgcgagacaaattttttaagcctaattaatccataattagcacatgtttactgtagcattacatagactaatcatagattaattaggctcaatagattcgtctcacgaagtagtccaaggttatggaatgagttttgttattagtgtacatttaatacttctaatgagtgtccaaacatgggactaaaattttagtccattatccaaacagcctctcaagctcccaaaacagcccctagtatcggagaatgccccggatcggtctaccggcactcggcgcacaggatcggtcgctgccccagcgcgcacgtgtctctcccattgggccccaccacgtgtccctgtctacctaccacgtgtctccaccacatactccattgtaacaaatcacccatatattttggaaccctctattaagggaattcgtttcatttttttttccacaaaaaatatttcacttagtgtactcacaatgtttcactatgtatagatctaatgttgcagtgaacgaaacattcttttgcaacaaatcatccacatattttggaaaccctatattaagtgaattcgttttatttttttttcaccaaaaatgtttcacctagtgtacttataatatttcactatgtatggatcaaatgttgcagtgaactaaaatattctttcgctatttgctgaaatattatttttatataaggtgaaacaacacccgatttaaacgattgaaacattttcgatctacttatgaaacaattccgatatacttggtggaacatcatgcaacatttaaaaataatttaataataaactaaaaattgttttcgtcggaatatatccatgtgtggtcttgttttgaaaatttaattgtaatgaatttaatggtgcaatcagattataattttgataaataatttaaaagaaaaaatagtttaaagtggttatgtacgcatgctgtgactgaagtcagtgcccaatcggtagtctcctccccccgagaaagttgcatatctaccattgcaaaagattggattcgctagaataccatcacttaagttggcttcaaaaaaatgccacactcaacaaagacggattcgctgaaatatcatcgtagacgatattgtccctggatcctcttcttcctccttcgagcgcaagaaagctcgccggcgacgatcgcacgccatggcgagcaacaaggtggagccgtggaggtggtacaactgttgtctcccaagatccacaccattcccatccccaaataaagcaagcagccccacaccattcccatccgcaaataaagcagagcactggtggtggctccgacgagctagcgcgtgatgtgagtgcgcgggcggcggcgggggatccttgacgcgatgacgcgagcaccaggcttctgcagcaatggttccttagtatgatgatgtgagtagtaggccccggcggttgctcgacgcgagcaataggcgaaggcgctggtagcggctggtcagcgcgacgagcatcaggtggcggcggtggcgattcctgtatgcaataaaacgagcaacaagcgtaggcggccgttcctcgttggggcatcatagaaggtaaccggaggaaaagttttgcatcatccggctgaattgatttttttgtcatccctgagattgattcctctttcgctggaatcaatttccattgattcatgccatgtaatttgcattcatcactgctgattgagacggtgacaacttggatgattttgccatttttttcattgctggtgcggtggtgcccacgacgtgcagtcgttgccgtcgagcttcttcggcgcacgaaggagaaagaagaggagctaggggcaatattatctagaagggcattccagcgaagttatttgtattgagtgtggtattttttcgaagtccacttaagtgatggtattatagcgaaaccaatcttttgtgatggtagatatgcaattttctccctcgcctggtatcgctgctgctctggttgtctctcgtcctgagtctccgactgagcgcctccaatctcaacagccacctcccacctgttccggctccggctagacctcgccgccggcgatccccagcctcagcgcatccaaccgacggaagaacacaaggcgccgcaccgcaccgcagcgatgacgctgatcaccctcatccgcgactacatcgatcgcatgctccacgacatccccgggatgaaggtcctcgtcctcgaccccgataccgtatgcgctccctcgaaccctagcctcttctcccctgcggggatgggatccgatcaccccctgaccagatccgtgctgttcgttccaggtggggatggtaagcgtggtgtacagccagtcagatctcctccggaaggaggtgttcctcgtggagacggtcgacaacgcctccagctccagggagtccatggcgcacctcaaggccgtctacttcctccgcccctcctccgataacgtccagaagctccgccggcatctcgccgccccgcgtttcgccgagtaccacctctgtgcgtaatccccctacatttacccgtacctatatgttttttttgagtgaaatacatggctggtcccttgagtggtgtcacttagtttcatgaacttgacaattgtacgtttagatccgtgaacttggtttaatgtaccaccctggtccaaacatcttttgactacgtttgaccgccaacgtggtatgccacttaggcaacacttttgctctcagccccctccacatcacaacatgtcgcatatatctccttgtagctatatagacaccagaatcccaaaaaaaaacctcaaatcgttcttccctctcattcttctccctgcatgtacagaaaatgtggtcccgattagcaattgccgttgctctgcgctccaaaatgaccttatccttgcacaacgggcacttaatcaacaacaccttcttccggcgacttcaagacaaggacaagcttggagaatccatggggatacctagcgtgcaagccgcattgagctacctcccgctgctaatccaaccgcactgtgccaccgctaaccccgctgcactgcgctgtctcctgccgctaatctcaccgccgaggccgccacaactgctacctctcagcctccttctgctaacctcaccgtcgaaaccctagctgatttagggatattttgggggatttgggttgaaacgcactggtcagggcaagttatgtgtgaacgtatatgtggagggggctaagcacaaaagtgttgtatacgtggcatgccacattggcggtcaaacatggtcaaaggatgattggaccgggagtggtacattaaaccaaattcacggatctaaacgtgcaattttcaagttcacggacctaagtgacaccaccctacaaatttaaggaccggccatgtatttcactctttttttttctttcttgcatttctgtgcgtaatcaccctcttgcttgatttcttgtatgagtttcttaagacttaagttaggttgagaggtgcagacaatttggtagacagactagttgttacgtgatcaaacccaacttgaccaccacctcctcttcgctggttgaaactctgctaattgaatcttagatgcttttgtgtggtcattctccaagttatgtgcgtgtaggtgttaggatttcataatctctagtttcattctatgttggggtttaatggtgtgcaaatgtaatgttttgtgtagtgttttttttttatttgtttgttgattgattgtctgcagtcttctccaatgtattgaagattccacagattcaggtgctcgcagattccgatgagcaggaggttgtgcagcaagttcaggtatatgatatatatggtattatatgcttattgcaacgaactttttgtgagtagagtgaggagatgggatttttatattaatgttttgctctcttattccaggagttctatgctgatttttgtgccatcgacccttaccatttcacgctgaacatacgcaataaccacgtctacatgcttccaatggtggtggatcctcctggtatgcagagtttctgtgatcgggctgttgatggcattgcttctgtcttcctggctctcaagcgccgtcctgttattagataccaaaggacatctgatgttgcaaaaaggattgcacaagaaactgcggtgagtctattgcccctgtaaaatatgtctatttggatcctatgaacatataaattgatactgataacttttttatattgtgtttatttttagagagaattgtatgcatgccagactaaaaaaaatatttggaatgccactctaaaccttaaacatttctgttttgttacttcggcatattttttggtgttaactcaaaaaataggtacaatgtcccttgacacaatgtcaattattccctggcatttaaacacaatcttctctttctatctctcatctcatgactagctgttcttagctgctttctatggcacaatcctggagcacttccagcctcctgattgaattttcatcagtcgctaggcttatcttctactacctccgtcttgaaatataagggatcttggcaacggacgcggacaagcttgtccaggtgcgttgccaaaatcccttatattttgggaggtagtagttacaaagttatctttagagatcatttgttaggccagcttctcctataaagaacgtacatcacccactttggaaatcatgcagtctttacaaaatacttctacctgtccctcatgtcagcaattcttcctgcctaatctctcttctacctgcctcctgttcccattcattttactatcaaattcttatgtcctacccaggtactcttctagacttctactatccaagcgcataacaccaacttattatgcctaattagataagttatccaaaatgttccaataataaggatcatattctatcagtcaaactgctaactattcaaaatagccactaatatcgaacttgccctgaatcacttacattctgggtcctgcagagattgatgtatgagcaggaaagtggcttgtttgattttagacgaactgagaactcttccttgttgctggtgattgacagaagggatgatcctgttaccccgttacttaaccaatggacatatcaggtatcataaaggaaataaacaccgttatttttcatatttcagttgtacctgtgttaactttcttgcaattttgcatacacaggcaatggttcatgaacttattggaattgagaacaataaagttgatctaagggaatatcctaatgtccctaaagaccagaaggtctatcaaaatgttgaatttatgttcatattgtgataacatgcatctttttttgaatgttgatccatctgaaacatacttacacaggaggtggttctatcatcagttcaggatgaattttttagggctaacatgttcgagaattttggtgatcttggtatgaatatcaaaagaatggtagatgactttcaacatctttcgaagaccagccagaatattcagagcataagtaagaaacttttgcctttcttgtttcctacgaaagaaaggaaaaaacaattatgtcactggaaagtaggcagtgcagatttgcctttgctgtcactgacatgtagtcccaggactcatgtgagtcacacatacaatggagaataagtgaatccccctgaaagtaatgtttaagctagccacccttctttatattgttacatttggcaacctcatgcttccaatttttacttttcactagcattcgtaatacatacttacatatgtttattttggaccacttcagctaattttgtttctcttgccaatgctgctaaaattccatttcttatcatgttaggttttggttctgtatatttttgtgtatatgtgatgtgcatagttggggtaagggcctttagacctattcgaggtgtcgttggacccaagtagcgcaatggtgccgttgaggctgccgtgccacaagggcagggaagaagaggaagagtctaaagcctagtggctccgtttgatatagattattgcagcagattatcgatttaattatagggatacattaaatataataagaaataaacttaacaaatagctcaaaacaagtggtccaagcgatgaaatagaagaaagttttttttttttttgagaacgtatttttcgaagcatggagcaaataacccacttcagtaatctggtgaataagttcaatagaacatggagttcatttcttgcttaagatactatcccatcctcatgggatgagtgatgacttgactcttaagaaacatatcactgagattaaggaaatagctaagtaaatctcatcctatctagtttaaacacctgcctgtgccatgtacagtaccacgcgtgaacagtagcctcgtgtgtactgtttacggtggagtaccactagccctagggaggctgattgctcttttgtccctaatgggctgcacatgcagtataagtacatatctctgagcagtggcggagccagggccagttgcctgggctccgccggctgcacgtagccattccccagtagattacacctaatttccttgctaatcgtctttcttagtcaccgtatgaactgaagcagcagcaatatatatagtttacatacttaattaacgtgcttagcgcaaactagcaaagcaaattcttacaaaatgatatatggatttgaatagaattgtgtggactatatttgttgttaggcttgcccaggctcataaaaatttctggatccaccactgtccctgagtgagtattgacctttatgtgttctttcctatttttgtattttatgtctttcaccaatttagattttaaaaagtaaatttcacaaaatcccaggtattatggttaaggttgtataaaatctatgtaccacataccaaaacctatgtggttttgtgcaacatgaaccataattaatacctagggttccgtgatatttaattgattttaatgcatgtgcattgttgtcatggcaagctgtgaccgtgattgggctgtgtgcacttggattgaagtgttgaatgggttgctgacgatgcttgcaagctggtcctaggaagaagcattcatgagtaggcctgctaatggtttgggtaggaatgggtttatgcgtcaatttaaatttttgctggggtggtttgggtgaagctggaaattgtttggtagtggttttgtcttggtcgctaattttcaggcccaatacagtttcataaatccatggggacatgtggtttcaggttggcagccttgatcagactcctggaccttgctgccatcctcctggggattttgttgtcctgagttatcagtatcacttgtggttacgggcctccatcgctgattttgtgcccctagacagcttagagggagagggagggagaactccaaatccacttcttctccatctatgtcgaccactggagcccgcctgccggcacttctgggcccaatgcaccgctgttgctgtcttatccacctgtgccttcaccattggtggccctgttggcttggcttcctaactcatactcattagacactgccaacacgatttggttccaaattccaccgacatccttgggcagtgccccaacaggtaggggctcgctgtcgtccttgaccagtcgatatagagctgccactcacagttgacgttgctgctgctggtttccctctatcgccatagacagttcttgtcctcctttccacctcagcagcagtggctggatctggttgtcttgcacgtggtggcgagaccatggccgatggtcacagatcaggttattggtggcaaatgggccaaatggccaaatgggctgagtgtttaaggtggatttagagtgagctgaaatggtctgggaaagtggattctaaactcatataggaggaaaatgggctggttcagtttgggctcaggtgg

SEQ ID NO: 13692 - DNA, 6205 bp, Oryza sativa
atttagtaataaaattatcacaaaactacatgttctgcatcatgttaaatacaaaactacaacatttagttttgtgataactctaatattatatctatagttttgtgattggccttaaatctgtagttttgagatacgacgtcttaaatatgtagttttgtgataatttggtcaaagtacctgtagtaaatattatgttaccagcctgccatttttgtttgatggtggtgttcatctctaaaagtctgatttactaatggttttaggtgatatgtcaaaatttctgagcaactaccctgaatatcggaagactcatggaaatgtaacgaagcatgttgctttggtcagtgagatgagcagaattgtggaggaaaggaagattatgctaatttcccagacggagcaagagttagcatgtacaagtggacaagcagctgctttcgaggtattggtataatgaacatgaaatatatcatggtgccgtggacacattgttcttataaaatatcatatatgttcaatatcctcaccaccaaagatattccctcccgaggtttttcattttcaatcaaatttatctgctgctagagttcacttaagttctttatttatgccagtgcaatttccaaaatgggaattacacctataccatagttctttagcttatacacactaaaaaactgtggcacggatgatcttccaaaatatatttacaacttgactcatgcttttttttttattatcaaaagacagtgggggaggcacccacggtatatattataaaagaataaagtatttacagggaagacaaaaagagtggaaagaaaaagactaaagacttaaattacagctgatcaatccatgattgaactaaaggcctgttaatctctttgagtctaattaaatgtagactcaattgactcatgcttttggattgaatatcttattgaatgggctgtgtgcattggaaaatgtgttgttttctacatagcttaagagttatgcagctttctttgctttatttgccaccattagctgcatgaatcaaagcagcacgtccccttacagtttttcatctgtccttacatcacctctcattgtttatctcatctgatttgatgctagtaaaatgtataagtggtctgttccacgtttttggttcacctgttgattttctgcaggctgtcacttccttgctaaacaatgaaagtgtgtctgatattgatcgtttacggttagtattgctctatgctttgaggtatgaaaaggagagtccggttcagttgatgcagcttttcaataaattggcttctcgttctgctaaatacaagtcaggggtatgaacctttaactagtgacagatcatgttcttatctaagcgttcttctattttatatgttgttttgatgttcatcttctttgtaattatttttagtggaaggtttttgctttcacagtttgaaccataaacaattgcagtcttgacatcactgttacgtgccttcagcacatagtaactatctcttttgtgcaaatcatggacttcccttgttgtgaactatgaggtcttctaaaaagcatccttgatttcatttgatgtactgggagcactgattcactgtttgataagtctactgccttggcttgaatattttaaaaattagactacaatttatttggaatcctagtgtttttaaccaggtttagttatcatttttttctttggttactaagtactcccttcatcccaaaatatagcaacttctagcattcaaaatttgtcccagaatataataaacttctccacctactagctcatctgaaccaatcacaaccatctcatttaatttctccacccacttcttctcaaccaatcacccttttccaatttaattctatctacttccttaatacctgtggctaactccagaaattcttatattttttgaccgagggagtattttgctaccagttttgaacaaaataggtaatatattttactaagtttttgagcaggctttccacttggtacactatgtgaattaaacttgtcgtgctagtgtaaaatggacacaggggcctcttcaggtggctgcctgttattatcggagacaaaatacctagccatattgtactgatggtttttgactgatgacttattctaattttgcatgcagctggttcaattcctcctcaaacaggctggtgttgataagagaacaggtgacttatatgggaaccgtgatctattaaatattgctcgcaacatggctcgtggactcaaggttagacaaaaaagtcttccttcgcacttgtggtacatgtaatgtggcttatttcttatgcacttattggttgcagggcgttgagaatgtatacacccaacatcagcctcttctctttcagaccatggaaggaattgtaaaggcacgattacgagatgctgattatccgcttgttggcaatcatttccagcagaacaggttagtcctaggatatgcacgattgtgaaactaaattctttaatcagactttgttttactgaatggacttgaatcctgccaccctgaagtaacattttattttccgttcaattttctgaattctgatccacattcttttgttgtcagcatggtttacttctaaatgtggagtaatttttaggagtactggctgattgatactctcctcacaggcctcaagatgttgtgctgttcattgttggagggacgacttacgaggaagcaagatcagtagccctttacaatgcagcaaatcctggagttcggttctttcttggtggttcagtggttctaaattcaaagaggtatattcattgcaattcttcccatttgcatagagtgggatatgttgcatcagtttttgctgatttgatattgtgcaataactctgaattgatttttaacatctggtttcaccgtcaaattgcagatttcttgatgacttaggagaggcacagagaatatcgaaatcgaggagtctagtatgagcaggctcttagcttctacagcttgaaacttggcagtctgacaattgaaacttgtggtgtttttgcatagagaatcaacttcgtggtaaattttgtaatgcacagctttagattcatagtgcaacacaccatacggaataaaattgttcacagttcacctaaaaacacattttttgtggtttgcaattattgctgcatatagggcgctccgggtgaaattaatatttaacgcagtttagttcaatgtcctgggagaatcaacattcaagtcgcgcattttgttgatattttgtcaaattttagcattttgttgtccagaaccaacttaattatctattactctaatagtcttatgaccagatatatagtggctaatgtggtaaattttagctgtctttagatgtgaaaaaaaattgcctcacttatatagcaacgtatcaggtgaactcagccgtgcacacatgcacacgctagaacaatccaactttcgaaagaagtataaacagtgctcaaaattgaaatttcatcagcgaacagacaaatatcaaaagagtgaaattgtacacgtaatgctgccaattgatagcatgcatgtgccatcttgaatcgtcgatggaatttgacatacctagaaaaggtagtagaagatgatgaggtcctggatggctggatgttcttgttgggaaagacgcagtggctggatggtgagcttccccgaagtggccaagaaaaaaggctggtctctcggccttttacaccccaaccgagtgaggcctcaaagggtacttggataattgacaaacataatagttgaactagcaagcaataatgctcctgcgttgcactgggaaaaaaggttgatggaagagagaaagagagtgcattgtcaataaaagcagagcaaggcagctatgtgaaaagtgaaagataacgaaaacaaaatacgcacagatgaccaagatagaaagtgtgtacggtgacgattgaaaaaatgtatgaatttttaaagtagataatccctcctaatatatgacaccgttggctttttatatatattcgacccttttgttttatttaaaaaatatgtaatttccatttattttgttataaatttatataacgatgtcatatattaaaaccggggagggagtattaaaaccagggagagtatgtttcaatatataagaatatacagggatatggaagagatagatatttaacccttccataccagaagccacgacattactaccaaaacgatttgtttttcctgacggactacaaaaccttgctcaaaaaattaaaatgaaaccctaaacatctagccctgccagtaaaaaccgatttttacagattcttattgacggggtttcaagagcgccacttgtaaaaatagaggtatttttacgagtgacgctctttaagactccacgtaaaaattcggggtttaagccagaaaagaaaatcgtcgaaggcaatgcacaaactatctcaacacccttcctttttttctcacaactcccacctacctctccctcgtactcagatctagctctcctctccaccactccctcaacctctcctccctctctcggttcgacggaaggggtgacggtagcaacaaggggagccgtgggcagagttcctccaacagctagcggcggtggagcttgggtcgcaggcagcggtaccgaagacatagctcgggcggtgggggtcaagccacaggaggtggagttcagtcgcgggctgcgggctgcggggcggcatatctggtgtcggttcggggcgggggcggtggatccgatggcgatggtgacctagggtgcaaatccgatagccaatgccatcgtatatgcatgtatcgtgtataataaggatgggtaaatttcataataggctcatcaattatcctaatccaatacatcaatcaattattccgtatacgcatcaactaaacatcgaatgcaagacttgaagcccatcaagtgtacaaagaaattagctggccgaacgatctattcatcgaggcgattggaaaaggaaggagatggatggaaaacatgataatagtggcacggtttcaattttataaaatttctagtggcacggctacgaatatatgaattgtaatagaaaaaatatataaactaaaattgtaccaaatatataaactttagatgattagggtttagtttttcatgatataagccctttaagaaaacatattcttcacatagattgttcgaaaatagattttttatctacatgctttaacacactaagattttctggaagaattctctcatattgaaatgattctagtgatataacatccattatctacatgactacatgttttcacttgtccatcgtcattttgccatattgactgcgatcgagaagaaaagaaaaggcgagaaagttaattcaagatatagagctagcatggatggtataatggtcgagtaaagcgatggagtaaaagaaaagagggtggtcgctcaatggtgcttggatatcgcgacattccaaaccttaggtagagaggcaagagaggagtagagggccgagtagaacacaatcagaattaaacgtggaaacaacgatgaatcaaatcctacgtgtctcaaattggaatatagttttacatcaaaacttgacatgaactgtgtgtcgcgtgggaacacggtcttgtcgagacaatcaaatctaatcaacccaaactttgacaatagaaggccttaaactgtaagcatgagtttcgagacggtgaagaatgctgcctaatggcatgaggaatggagaccagaacactcgttgcttagagagatactactctacaatgcagagttgctttggatgggacatgatgatttagcattttagccctttgtattttttaaatcagtctataaactttactaaaatatgctcttcctaaataaaaatgcaaaatagctctagcattagaaaaatttacattcatagccttggcccacctctaagccacacaggacattatcccagtctccagctacccttccttccagatgcatgcatcccaacttccccaaatatacaagttcctggttcgaaaaagaaaagaaaaaactaggcccccacaaatcgatgccgcatctctccgtccgctcccagaaatcaacgccaccactgctgacccccccaaccttc

SEQ ID NO: 13693 - DNA, 3041 bp, Oryza sativa
gttccggctccctttccccttcggccacggcccagggggccttggcatgggccttccccggcgagcggcacctcagccacggtgccctccccacgcaccggcggctttccccctcccttctcccacccccaccggcagtgtcgctgctcccgctgccatggctcacggcgccctcgcaacggcgccttccctggcaagcagcgccctacccttggtggttagcgcctcagccgccgcgccctctactcggctagcagagctccttccctggtgggtggcgtcctctcctcagctgcttcaccctcttctccggaagcggcttggtggtagcaccctccttgtggcacatggcggtgcgcccgccaagccgccatggccttagggaagcggtgtgcttggcctctgatgagcagtgacctgggtgatttagttgttttataatttttggggatgatttttgttagaagtacagatatgttagttatagataagagtcaaatacaaatatagagataagatatatcctagagataaaatagagtcctaaagatagaatcctagagataaatctactcttacttgtattgtactccaagcatccttcgtgatgccacccatcatccttcgtgatgccctagcgagatgagatgaatccgtaagctctccttgggcaacacattagctagctatcctctcctatcatctatatattagattatccaccgatctcattagatatattttccattaattagtaatagattagatcaattccttcattagccacgtaaaagccaatatcagtactgtcgtgtcgcccgggagcagcgctggagccttggagatcaacaacaagcagcaacggcaacaccatccaatcagctccgagcatgtacatctactgatctactccaagaccaacgtcatccatcgatcatcaccaagtctacggcaagatcgagccagctgctacatcgataaatgactacgtgatcatcttcgccgatcctacatcactagttatcttcatcaacttgctgccgccgactcgtccacgtagatggacacgtcacctcctctgacagattaatctgcaagacggttcatcgacgacgacatcgaccgcgtcatcgactacggcatcgatcatgttatctacaacgacaacaactgcatcaacatggcatcaccattgtgatgaccgctacacatgtcataaatatgttttttcgccttcggctatatgcggctacacctacaaccacggctactacatgatcagctacatcgacgaatgtctacaacaacaatcattgacggaaactctagtcaaagcgtacgtgtcatcgctatcatctatgacactcccgctataactgcgagagggaatagaggagagtccatcagagatccaatcaatgatggtgagtcgaacaagatgaagaaatagaagatttcaaatccagttgcaattgttcgcttcactccggttacaactgagggggaatgttagaagtatagatatgttagttagagataagagtcaaatacaaatatatagataagatgtatcctagagatagaatcctagagataaatctacttttacttgtattgtactctaagtttctatctcctatgtactcctatatgtattctatgagagggtcgatctaatagatcagaaaacatcagaatacaacaattagaattttcacaaatttgattcattgttgttggatttgtgattttgtgatttagtttctctcgtttccgtgcggagttctcggctcatgtggatcggatttgatctcctgtacggacgggagcgacgtggaggtgaatcagtgatgaatcggctacgaattcgtgggtggtttattggtttttttttttgcaatttctttctatcggtaactaaatcggattgtggtaggacatacatgacgaaaacgcggaaacaaagagaggtgacgaaaggaaagttacaaattttttaattagctaaggttaagactagaaaaaaaagcctatatgttgcaatgggttaaagcatttttaattttagttgtgcacgtgctttggcagataaatagttgaacataacaattccacgaccacgatgatgaaggaagcccaagaaaaaactgtgtacatgaagagtagaaggctatcaaatcgattgagattttcattactaattcgaagcttccattgctacgtaaggcagacgctcatatgtgattttttcttcttcttgtgttgtaacagattttcttatagatcataaaaaaaagccagtttattgtgtagtaagtcatatcatcgttaaatattgttcactaattgtgtccgcgctatggatgactaaggttaataaatacatgttactcaggatatcagaaaattggtaataacaacttctagctagcctccagaatttatctcaaaatataacaatttatacaccaatattctcttattaaccaatcacaaccatccaccattcaatttttccacctaccttcacttctcatccaatcacaattcttcattatttaattctacataccttcttaataactgtatgtaactctaaaaatgcttatattctaggatggaggaagtaccaactatcaactaatatttggattcaaaattttgattgaaaaatatatatgacaccgtacacttttcatataacgtttgatcatttatcttatttaaatattttacgtaaatatgtataaatataaattaaggttagagttgctcgagagtaaaaaaataagtcacaacagaatacaagccgacgatcttgcatggcgattgatatgaacgtgtggcaaggtacgaacctgttgatgaaggcccgtggctgagggatttcagtttaaaaaaagtacaccgaaggtccctcaacctgtcatcgggataaaaaacgttctcgaaccgcaaaaccggatatgcagggtcccttaactatacaaaaccggtcacctgaggtcctttagtggttttgaccatagttttggtcaacg

SEQ ID NO: 13694 - DNA, 11755 bp, Oryza sativa
gcgtgcgctggcacggctagccgtggctcgtaacggcgctgttcggggtgcatcggctctcggtgtgacgccgtgcggctccgtggccagcagcggttcgttgcagcgcgcgcggcggctccgtgcggcggcgtggccaacggcggtgctgtgcggggcacggctagcagcggttcacggcagcgcgcgcggtggcgcgagcggtggtgcccgagtctgcgccggcgtgccgtggcgcggctcgagagaggtaggcggcggccaggtcggcgaaggggacggcgagccgacggcgacaaggccgatctctccatccatggcagggagcacggaagcggcgactgccctatccttgcccggaggtgccgccgccgacgaggccgagcgctgtatccctgcccggagccgccgataacgaccaccgatgacgacgaggccaagcgccgccactccccatccgtggcggcggcccgtgggaagaggacatggccgccgccgtttctctcctcaacctgctcctgccttgccgctgctcttttcccctgccggtcactggtcaccggccgccggacctcctctcctctcccgcctctccatcctcgtcggcgccgcaccaagtcgctgccgcatcgcatcggcccccagacgagcagacgaggagaaagtgagagaaagagaggaagggagagaagaggggaaagagagagatgatgtggcatcctgacatgtgggacccacgtgggtcccatgctgactcagtcgccatgtagatcaaaaccggggtcaaaaccaccgagagacctcgggtgaccggttttatatagttaagggacctcgtatatctggttttgcggttcaaggacgtttttttatctcgctgacaagttgagggaccttcggtgtactttttcctttcagtttagttggggccttccataccgaattggaaaagaagcccaagtgtcctagccagccaacccaaatccaccaggcccaacattgctgaaaccctaactccccccaacccccatccccagctgtacggacgcgccgcacttgaccggccgccgcttctcacacgccaagtgacgccgcctcctcctcgcaccatgccgccttcgcaccaacagcatcctccttctcctcctcctcctcctcctccatcctcacgtcgcgcatccgtcgccgccgatggtccttgtgccgagctgttggctgccgcctctccttctccccgttgctctgccgtgccggtcaacccgaagcctcgcgatgcgtggtgactggtgagggggtggaccgtgcgcattgggctgtgtccgaatagttgatggtcgccttctcctcctcgttgtcctgccgcgcctgcaatgctcggtggcacgaggtgagggcatggaatatgagtagcaccacctcggtaatgtttaccatgctgataatcttctccacttatttgacttatctgatccagcagtttgtcatattttcggatttgtgtgatttttattctttttttctgggattattggtcagtgtagttctaatacttacaatgattgttcgattggtttgttaatcgatctttgatttttttttatttgtccggcacacacgagttagattttgtatcggactgtttttttttttatttttgccgttgtacgcgatgtaagttcgcgtgtgtggacggagggatggagggtgccgcttggttggattgacggaaaaaaattaaggcatgtttagattgtagccaaaataaaccttaagttggtaatattgccaaaattttggcagaatttcttatatatttactaaagtttgacaacatttttttttgacaactttaccaaaaaaaaaaatggtatcgttgaaaatatcatcaatctgaacagcccctttctgtggagattggaaagttactaatcttttaataattattacttcctccgtttcataatgtaagtctttctagcattacccacatctatctatctatagatctgactatacagagaccgcactctatattgtcttaactagagactcatcttgcctactaggacaccaaatgatacatgtcttttttcttcttcttctagatttttcttttaaattatttatccgatttataatcctattacactactgtgttcgttgcaattaaatctttataacaagatcttacatgactatattttgataaaagaaatatctatgttgtaaattacttttattatatatctaagttacttttatcatatatataaattacttttcgatttgattaaattacttattatacattcataatattgtgagttgtttattttattatcatttttagtcaattccattatttgtgctaattaaatttaatttctagatatactcacacttttacctccataacggatctacttttaatgtcatgacaaagttacttcctttttgttttaagttacttctataatatatgtaaattactttaaagctttactgaaattacttttatatgtctaagaagtagtttagtgaaatctaaaagtaatttagatatactataaaagtaatttgcaattttcctcaaaatataattatgtgagatcttgttataaagatttaattcttacgaacacaaccgtgtaattggatcgtaaatcggatgagtagtttaagagaattttatttgaaacataggtgataccaatatattttctatttacatgttgatatctagatagggtctctcgttagcactaaaacgagaggcctcttgatttagattttgccatctatctatctattatattattaaaacagctttgaaaggaggcactatgttcgcggtgggggctagaaattcccacattaatcgcagaaaaagaaaaagagtgtccaaatagaaatacagtttaaaaatatctgaaattcggaattaaaaataagcaatatggaaagaagagtccgtataagaacctaatacgagattaatcaaaatctagaataaaaataaaataaaatctgaaattagaaaagaaaaggagagtccaagtaggaatacaattttaaataactgaatttcggaattaaaaataaggaatgttgagagaagaatccgtataagaacccaatatgagattaattaatattcaaaataaaaataaaaataaaatctgaaatcagcaaaaagaaaagaagagttcaagtaggaatacagtttaaaattaactgaaatttgaaattaaaaataagaaatattgaaagaagaatccatataagagcccaatacaagattaattaaaattcagaataaaaaataaaataatatccaaaattagaaaattaaaagagagttcaaagtaggaatacaattttgaaacacttgaaattcaaaaataaaaatataaaaatattaaaagaaaaaagatttttaagaaataaattctgaaattataaaaagaaaaaagattttaattaggaatacaatttataaataactaaaattggtgataaaaaataaagactattgaaagaaaagaccatctaaaacacataacgagataaattaagtaacatgcctataaagaaatagagtggttgcggttgatactacatataaaaattgttaataaaacatcaaatagaatcctaatgacgattaaaaggagggatggcaggcaggccgtgaagtaaacgagcaaggcgattgccgagacttctagaaagtaaaaaaataaaccccatttataatcatatttgatttttaaaatctcaataacaataaaaaggagaagcagcgggcggggtgtataagagtatagttgtagagccgccgacggttagcgggacctctagaaaataaaaaataaattccgacgatagttatgttcgatttgtagaatcccaatgacaataaagagtaggtggcgaatgggccgtagaggagtatactgacatcgtttgacgggacttctaaaagttacaaaaaatgaaacctaacaagacaataaactctaaaaactacaaggtccaattaaggttcagaacttctaaaaagtaaaaaaaaaaactaatgataatcatgttcaattttaaaatctcaatgacaataaaaaagggagacaacaggcgagccataaagaagtacaatgacaaagccgctgacggtttggtgggacttttagaaagtaaaaaatgaacttgaatgatagttatgttcgatttttaaaatcccaatgataataaagaaaaaagacagtggacgggccgtagagaagtataatggcagcgtttggcgggacttctagaaattataaaaacgaaacccagtgagacaataacctctaaaaactaagatccaatttttaaaggtttcaaagagaatgaataaaaatagtggtagatcgagcaagcaaataaagaaggatatgatagaagtaaggggtagcagctagggcgacttttaaaaattatataattagaaatacggggatgataatgtttggtctttcagctatttaataaattttaaataaaatcatactgaaaaatattgtttgtttgctagccgcgcaattgcgcgggccacccagctagttcatatagatgttaatgaatctaaacatgtgtgtgtctagattttttaacatctatataaagatgagtcatctaccctataattcaccaactcatcttactcatatctcatccttacactcttacaccttacatatccaacggctcatatctacctgctctataatccaacggtccagatcgtgtgcagcttactcccttctccctccgcgctcctccccacgtccacgcggctccttctcgcgattgccccgtcaatctcgtgattcccgtgaatcgccccaatctcgcccccttcatcggctctagccgtgtctcccatcgccccgcgccgccgcctcaccatcgtcgtcgctcccttccctctccaacgccgccgtcgcctatcacgcccgaccccctccatcgcttccccaaaccgtgtccctccccgccgccggaagccctccgtcgccaggtcgccgccgacgctgatctgctccaccacccactccccgctgcacgcgaccagttcgccgtcacgcgccgtgacccgtgctcccacaccttcccgccgccggaagccctccgtcgccaggtcgctgccgacgccgatctgccccgccacccactccccgctccccattgcacgcggccagttcgccgtcgtgcggctagacccgttgtcccacacctccccgccaccggaagccctccgtcgccacgtcgccgccgacgccgatctgctccgccacccactccccgctgcacgcggccagttcgccgtcatgcttcgccgtcacgcaccgtgacccgtggtcccaccggttagtttatgcctagcgctaacacaatgccaattgctgtcgttcagtacgtgcaatgctcagtatatacaatgtttccgccaatatcaggttatggaatggggtgaactaatacatccggattggtgagatcagggtgattgggctttttttttcagttttttcttatgatgaaaattttgggatgtttctcatttaagtgggatggtaatgttgaactataaatctggtgtgtagcattgctactgtggcagcagtttgctgcttactggctgaataaactcataaaattgtttgcctatgtgctcaatgatgtacagttgacaccatcctccccagctccccgccgtcaccacgcatcccaccgcgtcgcccccagtctccgcatcgtcaactgcctccgctcctatgtgagtcatcaatcgcctccactccacctcgtcaaccacctccgcgcgtccacttgtcttggcctcttcaacaacgtctcccgcctcgacctgattcaccggaaggtatcatcctcctcccccctcaccccttctctttattacccatctgaaagaatcaaccaaaataagtgtatctatccacactttttgtttctaaagattgagagagggcatctatccacactttttattttacaaatatcatagtacattgagttgcacttcactggttatttgacaaataagtgtatgatatgcttctccataagaatggtgctggtctgcactgtactttattatcttaaagtcgattgctcaccaactaagtgaccggtacgggttatctaactcttaaatcagacaacacctattagcttgttacacatgtcagttgttcacggttatttaattcaaggttacttacatgttctcctatggtctttagtactgtcatccatattctgatgcagcttaacatttttcttaatatacatgtattagttacaatacattcagaaatttagtgcactgatttatatgcttttcaagggtttcgacaaggctattactgtgttttggctgtgtttgaggaggttccttcgtatagcaccctaaatttatagacgggataaaatattaagatgaatcagtgttgattggccttatgaagaaaatatatattgctcataatatttgttttacaactttgctccttgaaggttttttttttggaacgtattgatggttttcctcataatatgttattgaaatccgacacgctcacaatttcagatataaatagctgagtgtagggatgtcactaatcataactttgtttggggattacttagcgatgtgttgtttttcatgcaattgcagttcattatgaaattctccaaatgatactgctaagttgcaacttttagaaaacaacacaatgagctccttggaccctgttatgaaggcaaacttggagcctgttatgagtatttagctttttaatacacggctacttacctttctatttaggatattacgtattccatgattatttaacttcagaattaatctctgaatatcattacggcgacctccacctgtcactgacgaccatccagagaagggcatccctgttcctctctcttaatttggtgataccatttttgggtctttctgagtattcagtatactcattttgattttaatgatgaatgaattgcacactaactttaccacattggttttctagatccatcgccgtcatctggcaggagcagaagcgaccaattcatcttggcatatttcttaaggtaaaaaagttaacttttattgtacattgtagagttcctacctcctgccggtggatacgttcactcaagcttacggggtttctgttggcaaagagagttcctgggttttttatgttattgcaactgtgcaactgatgataacatatggtacttcattttacaggttggatcataggtatttattttgtaaaaaaattagctggtttagggcaacaatatggtaggtgtggatgtgtattgcaacagaaaaagctaaagtaacagtaaccattattgagggttcggttttcgtgctatgagcttttaaaaaaatatttcttcagttagagaaaaaaggttggattttcatataaaatgagtccaaatcgaattgttcgtgttggatcagttattgtaaaatacaatagctagagagttctgttccactaatcgaattgttctgggatatttattttcaacaaaattagacaggacagagaaaataagtatagtcgatagtgattaatgtgaaagggatgatgctcacatttcagctgtgatgaatgaaatatttgatggcactatggcaggacatttaattttcaggattatattcaactttttttttacaatttgtaatctgtagggtgtagactattcaggtttacaggttattatggtccatcaaatctttgtatattttttgtgtaccataaactagctccagtagcatgtgatgtcaaattacctacttcataactttaggggtaaaaggaagaattacctacttcagaactttagactctaaaaatgtaatggcagtgatttccgcctccagatcaccgacaccagccgcgccgtgattccgacaccgggactccttgcccctgcgacagcttctctaccgcaacaccgtcaagtgatatcttttgcaccctgaccggaaacctctctactgcgttgcgaacaaggtaatcatcgctcgatcattttctttcagccattactgtttaaactcaaatgcggattaaataatagtggatgtgattgtgaagtatagtgccatggctgaatgtgtatatatgcatatccacatattaaataatcaacggccattatcaagaaaacttactgaataaaaatgaatatatatatatatatatatatatgaatataattttcctccctaccaccatagcatacaacagtgggactattgaaatgttccttgtgaataaataatatgaacttatagcaacagttgagtacatgcgaatgtgaatttcttttactggaaatcagcgaatttgaatttaagtaaacaagaatatggtttcagtcaaataatgttatcttgcaaagttatgtacaaaatgttaagagtataatctatttatatatatctattaatttttatgctgttaacatacatctacttgcatggtactgtcaataggttgatgtattgtcaatattttcatgcataatggtgcatgttttgcttttgagttgctttcatctgtctaaaacattaattttcaggcattagtaacatgattggattttgtaatcgcattttctttgattgcaggttttggaaatccttaacggatgacttttgaagtctaaatttttctttcatccctgccacaggaggtacatactgtgccgtggaagatgtgtaatcctcagcaagtgatcctttgcctttccataaaaatgtgcaaaaaaggtgtaacaagacaatttgacaggataattcgtactaaaatattgggcataatgagaatatggcttgttgagctttatgggattatggtctttgattgagtgctttctataggtcgtactattaatatgtcctactgcatgttttacaagttgtgctacctatttatttattttctaaaaggaccaacaggtgctatactcattcaacatgtttatgagctgtcattattgatgttagtaaaacttggattggcagttttcatggtttcaaattagtacctacagtcttcattttacagtatagaccaaatgaagcggcaacattttttagtaatgtattagatggttaccatcaagcttttggaaaaatgtgctgatgtgcatgtactgtaaagctaagtatgttcattaatctcacaacttgttaattaggtagctatggatggaaattgccctgccaatggagcacgaattacgttgggtgatataaccaataaaccaagggtaaattgaaaccatgccattataattttataataatattgagacatacatagtatttattttgttcattttttcaaacaaaaatcacaggtaataatttgacagacaagcatgataaaatatgcgatcaaacaagagaagatagtggagagcaaacagtgtgccgtactgatggtactagagtgtctatgtcacgcacaaaaattcccgaatagaattccaagcagaatgtgcattaaaaccctcgtcctggccggggtacacaaacgacaaatttgacatatagatccacgtcttacaaatattataaaagccttacataaatgcagcggaaaattaaaagataactggagctaagccttgacttggactgcagcgggaataccacttcacaggcatcctcgacggcacggacgaagcctactcctcggaaaagccaccatctaacacgtactcaaactctggggtttggggaaaatagagcaagactgagtactacccactgtactcagcaagtcataccggaataggtgtatgatgcaggatataaccaaaggatagctagagcggttcatttgcataaagcgagcatttaaagacagtagttgaaagtagaaaaatagttgtaataattaatcaatattaaccatccactgtccaacgctacaccatgttgcaacaggcccaaccacccacctgaactaatcaattccattagactaagctagggtgagactaatcacggtgaatctggttgaccgcccataaccgcgggcacggctattcgaatagttttactttgatcagaggtgtacaactgtacccacaagacagccccacgacacgtttccgtgcgccgacatgccaccacgacataccggatagaggccgtgataggacccttcgcataaccccctctaaccaagcacaccacacctcaggtttcacccccactcctcgcaaggcagcgggcagtcccctctcgtgcctaggtgaatccggaagccgcataggccgtcgcaaggcccatccaaactccatcacgcccacccttgcctggatgtgtcagctagaggaaagctacactacaagcccagccgttgcccacgctggcttgtggtaagtacgataagttcttccagggcatcccgcgaaccggtccttaagtgccatgggcgcgaccatcaaaaccatgcacccacagcccaccatatgatatattttaattgaccaacaccaagatggtggcactaatccaacatcaacactagaacctgaagtctatgcattaatgcgattctcccattgtgtgctagttaaactaagcatggctaagcaatccctagtccaatatctagtcatgttatatcccaagctaacaaaggagcaaggtacaaatagcatagctaaaacagtaggtaaccatcccatggtatcattgtaaatcaatgcagtatttaaaggaaaacaatagagcctttgcaatataggatcaacatgttcaagtgacaagcatgacttgccttgctctgctgctggaggaacctcggcgactatttcaaaatacaccggagcgtcgggagagccggaatctaagcgacatacaaagcaaacaatataaataggccataagactactgaaacagagaacaaaaccatttttaatggattctttgcatttttcttgatttactgagacttgaatgggcttaaacggagctcggatgaattttctatgaatttaagaagattcactgtgtttttactataaacagaaaaaccctaaatgatttattgcgcaataattaaaaccctggagagagagggggcggcgctgacatgcgggccccacatggcagtgacacgggtggcggtccgcggtggaccgagtccacagaccggggaggaggcggcacaccacgtggcgctgatgtggcgccgacacggcggccatgcggcagccacgtgggcggccaaatggacggccccgatctaccgcccggtagatcggacggcggaggcggctcgcggccgggcgcgcacgggcacggctcaagccgacctgccagccgtggcgcgcgatggcgcggcgcgacgcaaggcggcgaacggccagcggcggagagcggcggcgaccgacggcgagcggcgatgcacggcgagcgacggcggcgcggccccgagcggcaaggcggcggcgctaagagggagagggggaaagacggcggggagatgctcacggaggattcggccggcacggaggggcgacggcgaacggcgacgaggaatgaccgggagacgacggcgaacggcggacggtctccggaaccacctagcgaacatgatgaaagggggttagagagagagagag

SEQ ID NO: 13695 - DNA, 1570 bp, Oryza sativa
tagagagagagagagagagagagagagagagagagagagagaggcgggatttgaaattcaaatcccggccatctcggggtgcgggcgagcgggagagggggttgaggggcgcgggaaaagcgggcgcacgcgcgggcgtggcctatgtgacgcgggaaaggcgggcgcgggcagttgcgaggcggcggctgcggacggcgggcggccggaggtgggagacgggcccaacaggtgggccccacctgtcggcgacccgaagggaggagggaggaggcggccggctgctgggccttggccttcggccggcccagcggggagggggaggggaagagaatgggccggcggcccattcgaaaagaaaaaggagggaaaagaaaaagaaaaagaaggaaatgaatttctagggaattaactattgcttgtgctcatttttaattggttaaaattatttctagagttctgaaaattccactaaaaatcttgttagcatatttcgacatgaagaactcaagaaaaatcccacatgccaattccgattattatttgcattaatttattagggtttcactcttgcttttacactgatatttttttgggaccatttataaatttaatttaggcttgagagaagaactttagggtgtgacagtctaccttttaactttctgaccaacagaaacgagaagagaagagcaaatatatgcgtgactggcgtgccagaaaaaaggctgagttaagtggtttaagcaaggtggtaacaccactcactccattacaagcagcaaatgttcatgtaccgtcagtacacggtgagtgtgaggtacacataactcatcttgccgaacttagtgacagacagaagagagaagagaagagcaaatatatgcgccaatggcatgcaaggaaaaaggctgggacaggtggtgttaatgagcatgtaacatctagcactttagtgcaatccacaattgtttctccaccagaacagagcgattgtaataaggtccacataactcaacttactcaaagtgatggaaatggactatttacaacgctattgcaggaaccaaccattgcatattctcagcatattgagagttgtgtgctgcagacaactgaactttctgaccaacataagagagaccagaatagcaaatatatgcgtgaatggcgtgcaaggaaaagggatgagttaagtggtgttggcagtactgtatcatctggcgatccaatgcaattagcagctatttcaccttcaatttagattgaaggcgatgattttcaaaaaaactcagcttacagattcaagtgataaacgaaagagagaagaaaggaacaaatatcaacgtgaatggcgtgcaaggaagaaggccaagttaagtggtaccggtaatgttacatctgacagtccagtgctagcaacaactatttcagcgacagaacttagtgaagggggtgaggtcgggcgatctgcaatctccagcacagaaaagaaagaagaaaggaatagaaagcaacgtgagtaccgtgagaggaagaaggctgagtcaaagagggttagtgaagatga

SEQ ID NO: 13696 - DNA, 671 bp, Oryza sativa
attcctgcagccctggacttctccaacaacaacctgtccgggccggtgccgctgcagctgatcagggaggggctcctggagagcgtcgccggcaacccggggctgtgcgtggcgttccggctgaacctcaccgacccggcgctgccgctgtgccccaagccggcgaggctgcggatgcgggggctcgccgggagcgtgtgggtggtggcggtgtgcgcgctggtgtgcgtggtggcgacgctggcgctggcgaggcggtgggtgctgcgggcgcggcaggacggggagcacgacgggctcccgacgtcgccggcgtcgagctcgtcgtacgacgtgacgagcttccacaagctgagcttcgaccagcacgagatcgtggaggcgctgatcgacaagaacatcgtcggccacggcggctccggcacggtgtacaagatcgagctgagcaacggcgagctggtcgccgtgaagaagctgtgggtgtcgcggcggtccaagcaggagcacggccatggcggcggcggggggtgcctcgaccgcgagctgcggacggaggtggagacgctgggcagcatccggcacaagaacatcgtgaagctctactgctgctactccggcgccgacagcaacctgctggtgtacgagtacatgcccaacggcaacctatggga

SEQ ID NO: 13697 - DNA, 390 bp, Oryza sativa
caagttggattaatatgcagtatatcacttcacaaacacataagtttaaatttgaattctatatttttttttaaaaaaatacgattgtgagcacatgtatgctagtacaagtttattatgttccctttgttacaacttgtggattgaatttaaacttatatgtttgttgagtgacatatcaaaaatctatcttatcattttttttctaaattttcataattctttaaataacattttctcaagggattaaaatttctgaactaaagctaagatgataacgagtccccttttttttccttttttcagctgaggaaaattcattcatggaagaagtttttggccgcaagtgtagtgtacatgtgcagttgaaaaggtagttagattctgttt

SEQ ID NO: 13698 - DNA, 1263 bp, Oryza sativa
ttcatatcatagcacagtccataattaatgccatagtgaagggactttttaatcctggtattttaatcgacgtagattagcattaataaaattaaaatatattaaaaatcggtccaggagagcaacgagagacggatcggccttagactcgctggctctgcctccctcgtccgacgacatacgtccacgtatgtatatactactcgtactcgtactagtatagcatatatctatgatctctcttattaaatcaatcaatcaagactaacgcgcgtcaaccgtagcggccatgcacctcttacccgacgacgtcctccgccacctgccgcgacgcagcctcgctgcctcacgctgcgtctgtcagtcctggcgcgtcatcatagacgaccgctccctgctcgccacggccgcgctcctcccctgcacgctccgcggcatcttcgtccagatcggcgtgccaactctgagcggcttcttcgcccgcccctcgccggcggggacgaggaggccacccatccccggcgtccttgacctagactacctcgacaccaatcaaatcgaaaaatcccttctcaccataatcgaccactgcaacggcctcatcctgctcgaccaccacgtcgtcaacccagccacgcgccaatggacgcgccttctcccttactcgccgccggagtcgtcgccgccgggcagcgaaatcatcctcgacggctatcacgccctcgtctttgaccctcatcgtgtcgccgccgcactaccagttgttcttgatgccctacgtcctcggacgacgagccacggtgttttctccatgtcttcgccaatttgaaagttttcaaatcttgaattgaaagttttaaaattttgtgttgaaagttttcaaatttaagttgaaagtttttaaattttgagttgaaagttttaaattttgacttgaaagttttcaaatttgagttgaaagctttcaaatctggattgaaaattttaaatttgagttgaaagtttttcaaatttgagatgaaatattgaaagttttcaaattttaacttcaaaaattcaaatttcgagttgaaagttttccattttgtgttaaaagttttcaaatttgagttgaaagttttcaaatctgcgttgaaagttttcaaatatagggtgaaagttaattttcaaaatttgacttgacgtatatatattttttaacctgttacttaaaagatcgtgaaaaaattcatccgtgcttgattaagagaaaacacgaaaaaa

SEQ ID NO: 13699 - DNA, 61 bp, Oryza sativa
caatatcttcccacccgtaaatccgtttgactccgttcaacttccaaaatccctcaaatct

SEQ ID NO: 13700 - DNA, 13112 bp, Oryza sativa
  unsure (1)..(13112): unsure at all n locations
ggtagtcttcctcctcggatccgtgcccggcgagatcagagatagcgctttcgtatctcctgacagtatccggagacaccgtaggggaatagccatgcctatccctgaagtcgatatccggcggcgtgtcttggcgtatgtaggcttgtatgttgtggcttctggtgggcgtgtgttgattgtcatgggtgttttccatggtcctttcccctctcctcctagggggtcttgtatttatacccataggtgtccccttgtccaagtagaactagggaaaccaatatggatacaatccgagtagtccttgtcgtttccatgtagaactctggttgtctttccttatccggaactccctcgaggccaattttcgtataagacatggtatgtggtggatcctgccgagatttagtcaactactattaggtatgtggtatccataaccatgacaactcgtggaaaatgttagaaataaaccctatcactatgttggatgtttttatactttcagatttatgcagatattgacgacgtaaatttggtatttaacagccgtcaacaacgatacaacatcaagtacacaaaaagacaagaattatactagctcaggcccctcgtatggtaatagctctaatccagtttatatgggaatatagaagaaaccatagggtacaaatgagaacaatggaactttgatattaccgacgagatccttgtcgagagaaccttgacgagatctatcgacaaattggcttcaagtcctccggattgcttctgtggtggcgtgtcttgcactaagattcgttgcctacctcctgggggtatatatttatatcgcagatcaccttggtctacaagtagaacccttatcccctccgagtagtactatgatattccctgctcttttaagagtatttccataagaacttaccgattttcttaacttaaattctttccgtatacttgaggatataccgtatccgtatatctcatgactcctaggatagagggtatggctttgacaatggtgtaggccacttttaacttcgtactagctcttaggagtagttggcaaaagggatttcaaaaacaatatcaattacttcgatactgattggaaatgttaaatatgaggtttcaaacacatctatacctaattaaaaaatatgcaaggcttccttaaaaaattccgtccatcatccactttatccacatgagcgatcggttccattaattttcgtccgtgcgtgtaacaactccaatttgttaccatggacgtggcctcactgaccactgaatagtcacattgtgtatcagcacatcatggcacaaccatcaaacttctctagccaatgaaacttgtggccgataggttgggagttcgactctgattgccccttcattttctgctgcttatcctctccaattttttctttttctctcctaagctgattatattttttaaaaaagtacatccatatgtttgaaattcatattaaaccagcaatatatgtaatttcctactgtgcgtccatatgtttgaaattcatattaaaccagcaatatatgtaattcatatgtttgtaatttcctacactttatcacaacctcttattaaacttttttgaaaagtgcgtccatatgtttgaaattaatattaaaccagtaatatatacaatttcctactatgtttttatacactctatgaccaactagtaatatgcccgtgctaaacactactgtgcattctatttatctttaataaattttaaaatttcatgttagcaaaaaatacttttatatgatctgtgcaattgagctttaattcatttcatgttgtatatcaaatatatttcatgcaaattacaataatatgatattgtgtgggcagaataaatcttgacaagaattagtaacatataatcacttcaatatacaatatacgagggagatatacgtttaaaaatatgttaaagttctaaaaaaatgttaaaagtatagagctattccattaattagttacgggtataaacaagtacaaaaataaagcatttgatacatatacagaatataccctatagataaataactaccctaatgtttagcatttaggatacatttaagaaattctcatgtatcgctagaaatgttgcttttgcactcattttgttggtacattagtagatgtagcaaaaattgttgccttagctcatcaatatcctacaaatgcatttatttataaaataaataaaaataatataaagtaattttcaagacacgcataaagagatgtatcatacaacccgacaaggtactaagaaatttgaatagttagctaccttgcattagacaaataaatttattggttagaagagtcatacataaaagaaattaaaatggaatatccattttaatatgaatacaaacaaatactaaaataaactatttatcaaacacaaggcaaaaaataaaagagatgtgtgatattatccttgaaaaaacatgcctgacatgaatcgtaatccagagtttcgcacaggaaaagtccatctgatctctacacatagcttttttttccaatatgtaacaaaaggatagggcatatagacagttcatactacccatccaacaaatttaaatttaaaccatcatcgagattgtttaatgccatataagaagatgaacgattgcaaacatcctcgattttaccatccttatcatacgtgacataatgtatgttaggaagatgaaattggagctgcaaaatagctgaataaatatcgaactgtgggaaaccaagaatcctatacatagcctctggcaatgatacgtatctggcatcattgtaatgtcctatctcatttatttccctagacggatcaacaaagcaaaattactatattttagtggttttagatttacccaaacaaatagttaagccaagacactatcaaaacctagtattcatattagcatactgagtatcacgcaaaacaagtttcagacaatgtggatctcatcaagcagtgtgccatttcggagaattcttgggttacacaaattcaatccccattacttattaaaattgtaatttttgtacatcgagaaaaaaaagaaaaataaatatatgaaaaattggactctcgtgtgtccgcaagattgagtgaataaacactggatgtccatagcagcaactttcaaagcacaggctttttgctagttcattcaaatgtactcaagtgtccatagcagccctaatgattcatttcacttaatttaaaatgtaaaaggtcaatcatagttaccagaagataccgtgcatagaaaactcaactaaaccaaaaaccatcgccaattaatgtagtccatttattatccatgctaatccagttcttccataattatgcctacagataccacaagtaactgttttcatctggatgacagaaaagatagattgcttttagcaataaaactataatatttttttaacacaacaaattgcaagatacaagaaaccaatccaatcacttgagcccaaatgagaaaactgtatgccagttgaataccttattggtctgatcacaatataaaacattcaagaaatctagaacgctcaagatgtgctcaatgaaatgcgtatgtgctgccaacttccctgtcgcaccagagctgctcccctacatgaaaaaaagagcacaaaatagaaaaggaatcagaaaaaaggaggccacaatttccttcagcagatgccagcttagaacgaaagaggttccacactttgtttgtatccaaccttaatttcattcttgttatgtgcatacacaaacagcactgcgttgcacactgcaatatagaaacaatagttgcaattatagcagtacatggatttcgttactgcttaaggcctcaaaggacttggattcgccagggaccatgctccgtgcccgcacttcctgagattttcgtgccgaacagactacctcctctgacctcttcctccactccctccgtgtcctgcatgaagcatgaatcttggacaagatgataatggtgaatcatatagttcttgtgtgctgccgtgcttgaagaactcgccaccaccatggttgcatgagagggaggggagacggagatgatgtaggagagagaggacaccggggacaacgtgatcatgacggattgcgaccggcgcgcggaggggtgtggacgcggtcgaggcaaggttaccttgttgcctggatcgtgtcaccgctaactggacgcctccctttcgaccgccgcatccttctctcgagtctcgccacttcacggccgcccgcctgaccagacaaaatccatcctacatatgccgctgctgcatccttggaccttggtccttggtccttgttgacgaccaaattcggtaaattatacatcagattcgaagctaaagtcgaagcggatttggtgagagatcgtttcctagaaacggagtgcatatcggctacaggagcatcggctaatgtctgcatcggctgacattggatcggatgaagaacagccgatgtagccgatcttagtaaggtggttctagaatcatctacgggatcgattgatgtgctgcacaagtattgccacgtatggattgagttctaagaaggcaattgtatctattaattaggatattctggtagttttcttagagatatgtttggcaagagtccacctaagggacttatttgtattttaagttataatagagatagagtcgtgtccggcaaggacatattatgtattttaggtataaatatgacccaagaccttgtaaacaatttaacgacagttcaataacactttcggcggatcgccaccttttctactttcattgttttcgatgagttcttgctttcgagttgggctgcatcgggttcgatctccagcaagaggtaaaacttgtcatggcagcttacgttctcgggattagtgcatacatcttatgatactgtaatcttgtttatgtaaatcgtcgagttatcacatatgctatataatctctatcaatattgctatctaaccctaaatcggctaacatctatcatcagaaggcagtcgataaggttagatatcaacgttgatctaggttatatagtgtatctaccatctcaaagaggttttcatcatcttgttcagatcttatgtttctctttatgcttatgctgcatcggttaggttcgatctactaagtaatatctagaatcataatatttagcttgttctatgattatcgatagagatagaattggggtttcagccgatcttacctggtttagtcatcttgttccttatatgattactcgatatgctaaatctgccctttatattaagatcttattgcattaaaatatattaagcttgatatttagtgtatttcgtttgttttaacatcttaagatagagtggtatcggagtattagccgatacatcttagatttacttaatcggctatgctatgaatatatataatctctatctcaaagtacttttaaacataagtgatttatactgtctcggcaaactgtccgatctatcccaatcacttggtttaaacatatttttagaaatagattatatatcattaatatctacacccgatcgagtagatttaactttaccctgctttactcttcattgcctatctaatgcaaataacatcggcttaatattgaacgatatgtcatcggctatcgtttacggatttaactttgttttcttgtttctcttttatttcttgttggttgcaaaccaactggcacgcttagaaatcagaagcaattctttggacctgcactagagtaaagcaaatctctcaggccagtgtgtgtttttcacatcaacagtcctataaagctataaccagccactgcctccgctagcccaaggggaacaatgacgctagggttgagggggcgccgatgtgtggatgggctcacgggcaaggtggtgcaccgaatctgagtggtggcgacagcggcgtcatttgtggagttaggcgtgattttgcgtgatttcaggggaatgagatcgaagagagggagggagcgcggcgggctatgtgacgtcggatacaactcaacaaatgattttgtattgttggatatgtcacacgatgaatgagtaaaaccatttgttgaactgggtagatgctgcttatcctcaccaattttttctttctctcctaagctgattatattttttaaaagtgcattcatatgtttgaaaattcatattaaaccagcaatatatgtaatttcttaatgtgtttttctacactttattacctcctattattattaggggtaattgtgttcttgtccctatttcgagttgcaattatgattttacaaggtttgtaattttgctcctgttttttcaaaccgaagcttcagtttgcccctactctgtcaagtccccttaatggtgttaatttagtggtagaaggacaggtgtgccctttgcattctttgtgaggatgcagtgtttttgccccgttgtgtcatgcatgcggcgatggatctggcatgcatactaaaagatttaactttgagattgtatggcacctccacacaaatcaatttattgccagtttttcaggaacatataagttgcacatatatacatcacgaagggaaaaagaaagaagaaggcgaccaattttccaaacaaatcaatttattacccaacttttcatgaaaaaggaaaaggaaaggagaaccagagccaaaaaaaaaaaaaatcccaaatccacacatatagcagagccctcaatgatttatcccagctgcttgccagttaattcaatcaacaaaatgaaccatcaaggaggcggcgcatgaggcgatgcactcggcgccttcctctacggcagatgcacccaatggcaaaatgttgttgccaacacagttgctgtcgtgcgggcatgccgtcgggccgcgcgcgagcccatccgccgcctttgcgcctgctgctcccgccgccggccgccgcctctgtccctgcgcgccggatcgcgaggccgccgtgcctccctgcgcgctggcccgccgcattgcgagctaggcccacgaggccgccgcaccgcctagcctcctgcgcgctggcccgtgaggctgccgccgcttgctcgcgtgcgacgccgcgcctccctgcgcgtctctgccgccgcttcctcgcgtgcgccgccttcgatctaggtttttcgattggggaaatgccgattcacacgtggtagactgatttagtgaaatcaggggcatgatggtaattcacaaattacaatatcgttttttccctcatttgattcagaaacttggggcccacctaactaccgtcaaaaccaagggtagacggttgcttcatttaaaaaagtaggggcaaaatcacaaaccctaaaaagtagggataaaatcataattgaactagaaagtaagggcaggaacacaattgccccttattattaaaccaccagtaatatatgtaattttctactgtgtttttctacattttatcaccaactttgcattttttttattgataacataaggaatatctttcaaatgtcacggtgaaattcatgttaaaacggcaatatatatataattttctactatgtttttctacacattatcatctttttattattaaaaaaactagcattttttttattgataacacaaagaatagttcttctaaatgtcatggtgtaaatcttgaatacacatcatgaaaatcctgtctgccattggcctactcgtgtggtatctgcgtgtaaattggtaaagctgaattaaattaggctaaatttccatttgattatattattcctttgtcgaggttcaccaagttgaggaaacccattcttccaatttgatgaaaattctaatgcaatttttgaaaggtatatacatatattactttttaaacatgtatgatcaaattagatttatgattgactacaatgcaatcctgattgaatttgaatgcagatctggcggcttggctttttcagtgcctaggtggatccttgttatctccagactaatgctatcattaagaattttgaactgctgtcatatttctcctcacgcgacaaatcatattcagttcaatgacccaccatttattagttcgaagagatttttgcaatcaagtgaagcaagcgctacacgatagcttgccatgtgggtcaacatcatgatccataatgtcaaaatactacacatgcaaggcgccatgaacctaaacgattaggttttccgttgcaacgcacagtccttttctagttaaataatatcatattccaaaagattactatcctaataagcagaaataggtcccattcgtttcttcttaaaggagtggattaaaatttggatactcatggcacgctattcaaactgctaaacagtgtgttccgtgcaaaaactttctatatgaaagttgttctaaaatatcagattaatacatttttcaagtttataataattaaaactcaattaatcacacgttattatcacatcgttttgcgtgaaatacttaatcttcatctccaggagattcaaacaccaccattaggggtttaaatcaaaatatagactttgggccttcgggaattttttaacctcgggccgggttttgaatgggccgttcaaggaagaaaaagaaaacgccaaatcgcccaaaaccctagactcgggcagggctcaccttcctcctcctccttcgccgccgctctacgtcctctcctccggctaccaatatcccagaaacctacccaaatgctcgcctccacctttgccacgcaccctgctgccgctgcagccgccaggcgacgaggtccgatccgctggcgcctgccgttctgttcccaaatcgtcacggtgacgctgaggcggcggtttccaatggcgaggctttcgatcacgaacgccctcgctagccagagcctcgagagtgcccctgcggcgcctcccaagcactcgttcccgatactggtaaggttgcttggtttggctctgcccttgttgtggatttaggaattagggccggtttgcttggtgtccacacacctcactttgccagatgtgttgcattgccacacaaaatgcaatttgataaaaactaacgaagtttggcaatccacaattataccgaccaactaagcactaggctaacaaattgtgtcatgcagcgtgcctaaggtttggcattgcaacctttggctgccaaccaaacaggccaaggccattaactcgtacctttggcattgcctaaggagtacttgttagtgtttactttaattatgattatcttccatccgaaactgggaaatgtaggaaaggagaaatggctgcaaaatgattatcaacacaataaagggatctatttactttttttttcctgttctgttccttaattcagccattatgaattagtgttggcaataatattagggttaattgaatccatgccattataaattcatcagttttgatatatgccactactattcaactatttagagccatgcctttataattttttaggtattggaaatataccactacatacccttttgatgcgtttactaaaatttttagaacaaattaccctcatcttcttccttggtctccttccatctctcctgttcattttcttcctctcaattcttgatgcgggttcagtgcaaggggttgccaatcgggacaggctggctcgagtcagctgtgccaaagatcgttcatcttcttcctatcccatttcttgcacatggttggtttcctgcagctggaggatgtactgatagttagttgctttctgctcgacaagaaggtagtggaatggaatttgggatgtttgaccaactcaattaggcacataaaaaagatgttcagtttgagattatactacaacaaaaatatagagtttggaaaatctaaccgctgtactactttactgaagatagagttcacagttcctcccttctaaaatatgcttttgaaaagagcattgaaaaaaactcaatcaaacttgccttttagctgcctgagtcacttaatatgttgtattcagtacttcagtttccagacaatatcctataaagcaatttcatatatagaaatgggtgcgtagcaccatgaaatggaagtccgacaggttcgattgcttgtttagtttcagttactatgattagcacacgatattaaaaagctggtagctgctgttttaccttttcattagttttcacgtcaacaatcatatatcgtgttgagctgacctgtttttttttttttttttttactttgtttgagtgttctgtaaatttaagatccagacgtactgaatttttctccttgcaacatctccacatcatactgtgatgcttgagtttgaagttactaagattagtaattacttccaaaattttcattaaagcaccgcttaactgcttctatgatttacattcctgtagatccattattttattatctcagatttcacttattataccaatatttacctgtttaggtgaatagttgtactgggaaaatggggaaggctgttgctgaagcagctgtatctgctggtcttcagttagttcctgtatcattcagtgctattgaggttcctgatggaaaggttgaaatttgtgatagggaaatttatattcgtgacccatctgaaggagaaagtattctcccttcgattgctaaggattacccagatatgatagttgttgactacactgttcctgatgctgttaatggtgagcatataaatattttctgttgcttgatctccttatatgctaaactctaccaaaagtaagcattccgtaattgcatcagcaaaaactgccggttgtttatatcagacaaatccctatctcatgttcagctcgagcttcttctacatagtgcatacaactgaacctagttgaaaattatcgtatattttgatgaatggatagaagagcaagttgtaatcattaagttgtatgttcgattataatgatcccgttagcttatgtatgtatggttgtctgttgttctgtttgcaactgtacaaaaagaaacaggaatatttaactacagaatccaatcttccttagttgatattctatcggaagtaggtttggcaggatagccgctactgctcttcatcttatgtcagccttttaacttttatttattagttagttaattaaattaaactctctgatatgctttatgttccttattttcatattatttgctcactattattgctgctaatctgacatttatggtgtttttgatgtgcagctaatgctgagctttactgtaaacttggattgccatttgttatgggcacaacaggtggaaataggcaactgttgcacaaaacagttgaggacgcaaacgtgtatgctgtgatatccccacagatggggaagcaggtataactatttccattgcatggtcaagctaatgatcttctccttattaatactgcttactcctatttttccttccaattaggttgtcgcgtttcttgctgccatggaaatcatggcagagcaattccccggtgcattttcaggttacaaactagaggtatagtttgatttttccttgcaagcattataactgtctctttgttcttcattcaacatcaaatttggtgcttcagttgattgatatgagttgtgtacttgtattcattatgggctcagtaatttgcttgcaataatgtgcaaacagaaaactttatcatattaacttgatgttaggaagtttattaaagaatcatgatggtatttagctcagcaatttcagttggtatggaagttttaagtgagtggagtaactagtaagtggtagagaacttatgaaccaaaccactggaacagtatccatgtggaacttacatgctacattaggaactgcagaaattagctatatcgtaggaaaatggaagaaagatcagcgatatttctgttaattggtaaccattatgatgtatgatgcattaatgttctaatcatttgaattaactaccgttaacaccctgagtatgcctatcttctatctgcatttgtgcttcagtcctaaaccacagtggtggagctagaattgtaagcctgtgcttgtacaactgtacatgccacatgaaagttaacttttcaggggtttagtctttgcaaaatttatgactgagatggttagactcataagctatttggaatcagcctcacatacgacttacacttgaaaagtgcctcctcttgacaagtcaacactctatttagatgttaagctctatggaacttcactttgaagcacagattcttgcaaattgaaacttcacagaagatttggattgacaactctatagtgactagctaaatgatctataaaaaatacatatctactattcagtgtcaacggtgctaccaggcccctgcgcatttacagtttcagggaacacatttactacttagggagatgtagttataggcgcaggaacacatttagtacttgacatatttagagtcgggggtccacagttattacttgtcagacgcagacctagagcttattaaaccatttagagttttcaccctttacatactagaaagtacagttagtattttagtataaatgtccagcaggatgcattcatttgtttagtcgataaggataactcaggcagtaagtttatcttatttatctccactgtgtggtattcattctggtttggctcttggaatcacatccagttgtgagtaggtttatcttatttgtctccattggaatccatctattgttataactgaatgtacatcatatactttagtttcatattttgcagtggcccatgactcttctttgaaataacaaaattggcaggtcatggagtctcatcaagctacaaaattggacatttctggcacggccaaagctgttatctcttgctttcagaagttgggtgtgtcatttaacttgaacgaggtaaatgttaactggnnnnnnnnnnnnnnnnnnnnnnnnnnnnnnnnnnnnnnnnnnnnnnnnnnnnnnnnnnnnnnnnnnnnn

SEQ ID NO: 13701 - DNA, 10003 bp, Oryza sativa
ttaagtttgatatactaaatcgtgtttcgaactataatctctagcctgctttttgattgcccataagggtttcatcggggtttcagccaatgagttatatggatgttggatcggtttacaaggattagatacatgttggttttagccgattgcaacaaaggtttcactgtttatctaatcttgttaatttaatgacatcggaccttgttggtatttcttaacgatattactagaaatataattcccagcaatggcgcagaaatactcctggtatatattggttacagagttcatccgcaagcgcacggatataccattgtagcgtttcacccgagagtatttcaaagatatcgtatttgtttaatcctgtgggaagattatagtagagagaaccgtactaataatttatatattacttgtaataaccatagtctaagcatgggttagtataattcatagggtagaatgacacacaagcataagactactcattctcacatttaatctatctaagctaagtgggaagaaaatagaaaagaatctattcctatacttctagtatgcatattatacatacatcttagctataagattaactagctaataccctctttccgatgccctcctggtacttcgagaagccatccctgattgtcgagttcctcactacaacccatcatgaccatacaaccggggcttaatacagaggagtaccctcctcaggaaattaacttaggactgtatacacgcacggaggaataaccgtactgagctgtcactatcagcggtccacctctcttctgcagcatataaccccaaataatgatacccaataatctagacaccacgcctaaactaccagatactactctaatatcatcgtcatgacatagagtaattgcataagcaaacactatacacgtaccattgcatctctcagataagctagcagtataatcaatataactcagatataaagtaaagttggcattgatatacttggaaagtatgtattacaatagcagaattgtataaaaaagaatattctaaataaagtacaagtcttacaaaagaagaaaggagagctactagagccatacccaaactcttccaaagacttccggactccggtttctattctattcctactacattatcttgagaatactaaattaagtttgagagaatatgagaaaactttgcttgaagtgtgtgttgaaatggagagagtgaggggtttatatagcctcccaatgacggatgtgacggttggaatggtcggaaataccctccaaccgtcattgggggctaatccacaccgtccagccgcaactctacatccaacggcgccaggatgggtttggccagacccttggttcggccgaaccatgggctgggccaaaccagcccaatttcgactggcggcctcccctcttgatatattttgtagacttgtgaattttggcccagttggtcgtgtcatttctaagttcttggcccatcgttccacaagtatgattctcgacatcgtccgattcattgatctcttgttttgatgtcgattctcctccattttatgttcattctctacaagaggttagtaatcctagtactagtggaatatttattattctaacacaaatatgcattgcaagcataactagttctcctttattttggtagtattgatggtcgaagctgattgctaacgaccgtcaacaaaacccccaagcttgaacctttgctcatcctgagtgaaggacaaaaggaaacaaagatttggttgttgatcaggagttgctactatgcagtatatctcaaatgtataggtgcaaggtatatgtactctctctcaaattaaataattctatggcacggtggcttacccttacccctgattcccacgagacactgtctcaccttgtcttgagtggttgaaagacaaaacagcaattagagcactaatcacccaatctttattcaacttttattccggaagtttttcaaaggattttgcaaaagaaatccaagttcctcaaatgattcactcggtctctccaagtgtatcaatattatttcctcactatttatgcctctttgattcctactctaaggttgatatgtggagctcggtagggatcaaacatggcatacttgtattcacatttattactaagtcaaaaactcaaacgaaaatagataactaaacatactcaagatcaagatcgtccaaagtgtgtgtgtgataaatggtggaaatgaaatgtgagaaataaagaaaacgcttctcctttgtgcttacttccttctcccaaaatccttttcttataaataaggagagggcatggctacattattttctcttttttttccaacgtcatgctcatgcttgaaagagcataactttattattttcataaccttgcctttccctccttcttttctttctctcttttttttcaaaaaggatttctttttaggagaagaaagcacataaaagcatggagaatttatttttggtggtagtatggaaatggaatggataattgctagcttctagtgtaggagtttagcatctgcatatatgtgggtgtatgatcttgatcatagagcatgagaagtatctacacaagtcacaaagatttgacaaaattcaatggaattgcaagtaaccaaaatgtatatggtttaatcaatatggaatatttttggctctggtaagaatttatatcaaatgaggaacttcataagtttatcattttgaaaaataaaacatccggaattcaagtcaaacttagacaaggactatagcaactcttatttactatctcatatcttgcaacaacttagactcagattagcaaatgcagctcatttaccttaggttcccagataattgttggctactcatatttaatttttgagagtacttacctatgaactcatatatgagaaatataaaacagagcaactatttatcatttcaacaaagagaaccaatttgtcttacctagcataataaaatttaacctatctttttggtattttctattttgcaaatttttatgttgttttcaggtttatagaatgcaattggaaaaacaaacatgcaatcggaaagggaaatatgcaatgtgatataagttaccttagtgggcggatagacatctccctccaagcttggctttcgctcagggttcttaataaggattgaatccctagaagcggaagtacgcttaaaggccatcatgctgttgctgcatgaggctgttcatgttggtgaactgagcatcagcattttgttgccattcttgcatttgcgctatgtgttcctcgaggttgtgttgggtctctcccgtctgcatatcaagggtatccattctcctggtgatttcacccaagtcccaacgagaggaactcgtgcgccattcaccgggagatggaggcataccacttgatctgggggactgattgttccagccttcccactgtatgtcatgaggcgcccgccaccggctctcactggcactttcccagctcgagatcccaatgttgtggtgtggagcttgggtgcatccccagttggctcccaacctgcctcatacatctgtacgggtgttgaggatgttgaacctttccgttcattccttgccatgttgcgtgtctccctgtatgttccacctacacgagattcttctatggtctgcaggggtatggttagttcatgatagttgtacaaatgataccccgcgttaggcaacggaatttcatttgtacaaccagggaaaaagtatatcaaagacccatctactccatgtttaaggatatgcccttgcactagataactctcatcaacacagggacgagcggttgaaatataagcaatttgatcattggtaataacccctagtccctttgctatgcgagtaatcagagaagtgcataacaggagcagtaaatcttatactttctaaccattgccttatcatacattttataggagcaattttaatcttcctaaccatggcaaacatgataatcagttcatcctctctaatatgtctaagatcacctataggaaacaaagtcatagcaatccatttgtgaataggcctaattgtaggattatggatatcattcatcctaatttcttgcaaattgaagcaccagaaatgtcttcccaaaatctgtttttctcaaacccggaaattccttcccgaagatcgattttataggaatcgtgaaaaccaagaagtgtacttaatcctttccatgaaagtgtgtattcattatggaaaaagcgaaaggaaattccatcttctatttctttcgaagtgcacagaaattgcaaagtaagcaaacgagaaccaggctcatctactacagtaaatctctgccatccaacagctttccaaatagcacgaaagttagtatccatacctatctttttagcagcgccggagagtatacccacgtgtgggcatactcccggtccttcagcatgtagtaggtttgtctttcccgatcaccgacaaggtcgaggtcggtgtcgctcaagagatgttgtggaatgtcagcatcctccatcgagacgtctacggatgaacgagcactagactcatcatgatgacttgatggagagccggatcccttcttgaacagactagacagttgcctcctcatcctgcacaaaggaacaagaacaaactaactcgacgggggttagaataacaaaagtttcacccgccggttagcttcatcaaagcaacttgtttatgcaactaaatgcttgaatttgagggaaactaacaaagcttgaatgaattttgagagcaaatcatggagagggagtgaaaatgagttgaaatgggggtggatttccttctcccggccggttggcttaaatagaatgcccacaacggtcataaccgacctgtgggacccactagccgttgcctcaaagaaagaggcacgcaaccgttggccttgctggaggccaaacccttggtgggcccaaccaaccccacattcggccgttggattccaacggtcagtgcggtcatggctcagcgaattttcgttgaaaattttattttggtttgctctggaaaattcatttgaagtaattttctcaaaattcaattctaaatgcaaattttggaattcacatatgcattgatgcaaaaatgcaaattgatggaaataaatatgtggatacataccaatttacctgttggcgaaggtcacgtcattttcggtccaacgtgcaagaccatacctcccttcagtttagttcgcggagtttccacccatctccggaggtgatggagcgggcgtcttttgctttaccttccacaccttctttggttttggtgcgggcgatggcttcctctgagctggcttctcttgtttcttggctgttctgtgggtttggcccgtatttgatccggaccatggaacattgttcggtcctcggctaaaactcaaatttttcttccttcccgttgatacggaaacggatgcttcctgttcctacatcaatgttggcatccgcggtgctaaggaatggactccccaaaatgagcggcgtctcctttttagtgtccatgtcgagcaccacgaagtcgaccgggataaagaaatcccgaatcttgatcggtacatcttccgctatcccagctaggtagcggaccgatgagtcggtcaactgcaggtgcatcggtgttggtgccaacaccatgaagttgagcttgtcgaagacgtctttgggcatgacgcttacacttgctcctaactcgtagaggacttggtcgaatttatgtgtcctaatcgagcagatgatcgtgggacaccccggatccttcttcttttccgggagcttgtggagtatgacattgttgcactgctctgtcagcttgaccacttcagttgttgggagcggccttttgttgttgagtatatccttgagataacgtgcgtatgttggcacttgcatggcatccaacaacggcacgttaatgtggatcttctgaatcacctcaagaaaatgagcgaactactcatctactgccggtttcctgcttctctgagggaatggcagcagtcgtgtgtcacaatactcctggggcacggtcttttctggctgaacttcttcatcagtcgtgcttccagatggtgcttcttgggtgatactgctggtttctacagggttaggatatggcggatcacgagtggacttcttcatgggtttctgggcagtcattcccagagtggtccatgctgtcgcagacctcacacgtgacgtgtgagtccaaggccttgatggtgccttttggccttttctcgtgatcgtccaagagtttcatgaggaggtccagtttggcagcaagcatctccggctccttgacggtgtgcatgcctcgatgacaggtctgaagtcattcctcgctctagcccatattggagaccattttctctatcaagtcgacgcctcctcgaaccgtcttagagaaaaaggctcctccagctgccgcgttcaggtggtcgcgagacgtgggagtgagtccattatagaagttttgcaggatcagctagtcatccatcccatgatgaggacagacggccatgtattcctgaagtcgttcccacgcctcaggaatggactcgtcccttgtctgctggaaacttgaaattctcccacgaagggtgttggttttgcctatcgggaagaactttgacaggaatgccattgagcatttgtcccaggtgttgatcgtggcacggttggcataaaaccactgtttcgctttcccaaggaggaaaacggaaacagtcgcagcctgatggtgtcaggactgacccccttcattgtgtgcatgctgcagatctccaggaactgttgcagatgtgtgttggcatcctccttaggcttgccacagaacgggctagcctgcgccatcgtgataaggctggacttcagatcgaaattcacgtctgccatgttgatttgcgacccagtggccacattgtcagcagagggagcagcgaattcacagagggtcttgtcagccatagtcttgaaagttcgtggcactggtatggctggtttctgtgtcggaagagttttctgcggagcgacgactcgcgacttgacgctctgaaagaaagcctctggattttccttgaagtttttcggcaagttaaaaccaatcatgcactaccctgtttccacaataaaagtgaaaaaaaccaaggttagcctgcaaaggacaatgattatacagaggtaaatatagagtaatagtagtggtaatctcttttataaatcttcccggcaacggtgccagaaatgtttattggtatttcttaacgacattactagaaatataattcccagcaatggcgcagaaatactcctggtatattatggttacagagttcatccgcaagcacacggatataccattgtaccatttcacccgagagtattccaaggatatcgtatttgtttaatctcgtgggaagattatagtagagagaatcgtactaataatttatatattacttgtaataaccatagtctaagcaatggttagtacaattcatagggtagaatgaaagacaagcataagactactcattctcatatttaaactatctaagctaagtgggaagaaaatagaaaagaatctattcctatacttatagaatacatattatgcatacatctttgctataagattaactagctaataccctctttccgatgccctcctggtacttcgagaagccacccctgactgtccagttccttacgacagcccgtcatgaccatacaaccggggctaaatacggaggaataccctccccaggaaattaacttaggactatatacaagcgcggaggaatacccgtactgagctgtcaccatcagtggcccacctctcttccgcagcatataacacaaaataatgatacccaataatctagacaccacgcctaaactactagatactactctaatgtcatcgtcataacatagagtaattgcataagcaaacactatacccgtaccattgcatctcccaaataagctagcagtaaaatcaatataagtcagatataaagtaaagttggcgctcatatacttggaaagtattacaatactagaattgtataaagaagaatattctaaataaagtacaagtcttacaaaagaagaaaggagagctgctagagccatacccgaactcttccgaagacttctagactctgttttctattctattcctactccacaagcttgagaatactaaactaagcttgagagaatatgagagaactttgcttgaagtgtgtgttgaaatggagagagtgagaggtttatatagcctcccaatgatggttgtgacggttggaatggtcggaaataccctccaaccgtcattgggggctaatccacaccatccagctgcaaccttgcatccaatggcaccatgatgggttcggccgaaccataggctgggccaaaccagcccaatttcggttggcggcctcccctcttgatatattttgtagacttgtgaattttggccgagttggtcgtgtcatttctgagttcttggcccatctttccacaagtttgattctcgacatcgcccgattcattaatcgcttgttttgatgttgattctcctctattttatgttcattctctacaagaggttagtaatcctagtactagtggaacatttattgttctaacacaaatatgcattgaaagcataactagttctcctctattttggtagtattgacggtcaaaactgattgctaacgaccgtcaacagacctccagccgatgtatgctttaacctttggatccgtgcttattctatcgtatcattattagccgattggtttctattagattatattgttgttatattacattatcatcagccgattgactttatttacatcaagtgtcagattctgcatcaaacatatagccgacagctcaaaaccctatcgctatcggctagtattggcatcgactggaattattccatcgacttgtcagtcaatcggctcattgatctgctatttgtatatcttgtcagttgtaggatcaaactgactggcatgcctgcatctcatcaacctttggacctgcactagagctaagtagatctcccaggcagttgtgttcttcaacttagttcgcgccaacatagttttggcaccatctgccgagcgcggatttctcgtcaacaagcgtgttctggtagcaacgagcaaatcagtgcatgaagtattgcggtagaattaaattaagctttctgtagacactgtttctcactaggaaatctattagggttacggataaggcataccttctaccctacgatttaccaaatataccggattggcatacctcgtatcatacgatatgtttccgtatgcgataaggaaatatacaagatattatggaaaatatcctcacaggctagagattatcagagtcctactcggagaggatagggactattctctatcgtgcagggttcgttgtctttgagttctacttagagactaaggcaactcatggtataaaaggcacaccttcgaatgggctgaggatcatcgaatcatagcaccaacacacccatcatagtttacaaagccgaatgacttaagccgaagccaccggggtatctcgtcgaacaatctcgacaaggatctcgccggtaccatcggattcatccgttccctttgtattatgtggttttccatataaatctcatataaactggattagggctactacctcacgaggggcctgaaccagtataatccttgtctcttttctactttgattttgtatcgtgtagattctcgtaccaacgtaccccaatacccaattcatccggtctacgggtaccccccgtcgatagtggcgcgccaggtagggggctttggtgatcaaggttctgccgacatg

SEQ ID NO: 13702 - DNA, 10693 bp, Oryza sativa
  unsure (1)..(10693): unsure at all n locations
actccaacaaccacgagttcaatctcggcgtgttgcaaaggaacaagacgcagacaaaaacccagatcgtttggtaggatttgtaggtttggatcctcacgaaccctcggtcctgcacggtcgggatgatcgagaatcaaactctccacgtgacatgaacatgatcaacgggagggcggcggtgaaccatctgctcgagcaaacgcggatcacacccgcactcctgcccaacatctgaacatcgttaactcgatcctaagagaaagccctttcgatacggtcttgcatcccaacggtgatcaatgggttcagcgactttgggagacaatggccaacctgaacagtgcttttgcgacagttgccaaaccaccagccccagacttgccgcatcaaggagatgatgtacatgacggagccgacaccgaagtcagtcaagaccatagcaatcacccaagtcgagatctaggtcgaaatccccgcaatgcttcacctcgtgtccctcgtcatcaaaccccaccgccacaaggtaatcacgatttacgcgatcacttagttgggcgtcagcgggaacaacgagttgacaacaatgctcaccaacgccatcctccgccgcgatgaaacaacgttgcgaatcaaggaggccaccctaacaagaaccaagaccgataggattgtcgaagtcatcatgatgatgaccgtcgagaacggcgagatcgggacgacaatggtcgaggtcaacgacgagataacgatgatcgacgatggcaggagtcgaattctccagcctcccgtcgatatcatcaacaaggacgccgatccaggtgcaacgctccatatccgagcggcccttcgtcatcatcatcttcatcgtcctcatcatcagctagaccacctagaagacagcatggacaccgaccgcgtatcgtaccgggaggaggatgcagagcattcacacccacagtacgagaagtacggtggcctgagaaattccgaccaggagcaatagagaagtatgatggaagcatagacctcaaggagttccttcatgtctattctacagttctctatgctgctggggcagacgacaacgcactggcaaattacttaccaactgcgttaaaaggatcagcccgatcatggctggttcatcttcctcctcgctcgatttcttcatgggaagacttgtggcagcagttcgtcgctaacttccagggaacgtacaaacgccatgcaatcgaggacgacctacttgccttaactcagaaccccggtgaatccttgagggactatatttggcgcttcaacgaatgccgaaatacgatcctcgaaatcatcgatgcttctgtgatacgtgcgttcaaatcaggcgtccgaggttgctacactacctaggagctggcgacatgatgaatcacctctgcacgcaagttattcgagatcgttgataggtgcgctcacacagatgatgccttaagacgaaaagataaagggaagacaggcgaggagaagaaaacaatgaacaaagaagcgccagagtctagcaaaaagagaagccgtaagagcgggaagcgcaaggcaacaaaagaggttctagaacatatacctaattaagatggacttcatcagctaattaaaagaaatataataaagtatacggcacctttgtctaatcctgatcttaattgttacttatcaatttaattagtagacctgcttcctcataacataaacaagatacagatcattcaagtcggcagctccacgtgcatagagccaacctgaattaattaacttattcttcttcttgaccacaatatcagcagcatcaaaatatgtttgctgacaccatggaaaaacaccagcagctagcccttttgatccctcgctcttgccatttttcatgactgaagtacaggaaccaacctaatattcattaaactgtcggttgtaatatttgtgtccctgcatgcgaatcagctataggtgaaatatttagggtagacatggtctcatcacacaaattgtacaaaataattgatgacacacagaattccaagccttcctattccaaaaggaaggaagaggttcccattgaagaaaacgtaccgactagcagggtacgaatttgtaacgtcccgcctcttctaggccgggcccttcctgaccggtcacccatccctaaattactccaagccaagcatgcttaactttagagttctttagaaatcggctttcgaaaaagaagttgcaacttgttatatgagtattctaataattctattaagccttagatcggaatgttacataattgccccttgataatacaacaaacatgtgactagaacaatgcctaagcctaacctataagtaaaggatactttaatttccagtacagctagagcaaaatatggacaccgttagcaaagcagcccccatccacaaaagattttcttaaagaaattatttccggactattaacacattcaaaactatgcaaaattagaatattcacatacctctctcagagagagagatagttaagaccagggttcacgattccgacgaaaaccgatcgaattccacgaaatttcgaggtttcgacgaggctgcagaagccggatttcgatgagtttcatccaaatttaaatttgaattgataaaaaagaaaaaaattaaataaaatcttataaatagtatgatattcatcaaacctattgggatataattttttttaataaattgatgtattccatatatttactaaaatttatagtaggaaagaaaagaataaagaattaaaaaaggaaaaaaaaattagtttacctctttttctagttaccaattgaaattttgatgatttcgctcagaatttcgccaaagccgaccggttttcgcgagcttaggtaaactcagggaatttgtattcaaaatttggtttatgaaatttgttcgaaatctaccggcattccaccgaatttcgcgaaaaccattgttccgccagagcccgaaacataaggccatctcggaatcgtaaaccctggttaagataaacgggataaatgggaacttaccgcgcagtggtggatggcatctgggtcaccaccggagtcgacagcgatgcgttccagctccaggactggcgccagtgtccacatcattatcccgtccaccttagcctcccgcgctgtagccttccacaagaacctttggttgcggcggccattgggagtgggaggaccgtgtgttgggactgaaccaaaacacctagaatgtgcaaagtacaattcactaaccggcaaacatatttcacacaatcaacccatcatcttgccatgaactttgaggatagtttcaactagcaaatcaacaatgcaataacaataaacacatacacacaagatatggtgatttacgtggaaaaacctcctcgatgtgaggagtaaaaaactacgggaccaacggtccactccaagcttccactataatcaacaatgggtacaattggagtcttctctagaacatctagaggcacatctcaatagcaactacaacatcaagttacacacttggcatcatcaacatcaaccatcaaagctaacaagaggtatatcaacaaacaagcagagaaatggcagattttgtcctcttcggttctcagctgagatctctcaaaccacagatgcaaattgatgaaacatggcagaaatgatggtctatgagtcccttccaagctatccaaaaaacagcttaatcggacaccgtttgacccctcaaactgacactttactaattgttgcacaatctgtaatttcagtaactcgagttgataaaccactactcaaatccggtgctctactcaaacatttctcatccaaactggccagattaaagtgctcaaagtgaggaacaaactcaccaagtttggtgccaatccaaccacgtttgagcctctaatcgctgacttgataaagatcgggtaagagccccgagctgaacaagctggacttcttcctctccctctcttgtgtttgttggttatttcttcgatcaaaggctactgctctctctccctccaatggaggctagggtttttcttcctaccacaaggataaggcaatatcaaccattgatcaaggcatgaatcaatggctcacaattattaggcatttttactgcaatgggctgagaacaaaaggtacatgtggagtgaatttagcccaacaccgtggagaggaatcagagggaggagcacaggcggttacgttgcccggagcggtgagcacggaccacggagaggttggagtggcgcggtgcggtggcccgtgaagagtatcctctgccttcacaccgtgaaggcaccagcatgcagtcaagtaatatcaaccgtccaagccaatccaacggctcatcaaggactgtgtaccatttaactcacgctcaactacatttttacttcaatggttatatgggttttgtttctttgacaaaattttgttggtgcagtaatcaagggccgtgctatcacaaaaaacgccgaggtacaaaataccattgctttcaataagcaaaaggcaaaagtacggcgtcaaagctatttttcgcacaaatttttatatgagacccaaatctggttgaatacttaggccattcccaacctaaaacactatacataatttccataaactccacatcatcaagaaactagtactaaacactactcttccaatgcaaacaccactgttccatacttaaatttaatactacttatctcacatgatatcttagatgttgtgtagaaaccatgtctcatgtaaaacatggtttccttctcttttctcatttattcacttgtcatatcattttttcattctaggtggcagcttatttaatgctatggacaccatcctagtcattgggttggaaatgaccttaggctgcgttcgggaggaggggttgtgataccctcctccccggcacgcaaaatggaacatgtattattacatgattaattaagtattagctaatttttttaaaaaaaatggattaatttgattattttaagcaactttcgtatagaaactttttgcaaaaaatgcaccgtttagcagtttgaaaagcgtacgtgcggaaaacaaggatgaggggctaggaacttgaaggaaagaacagagcttaggagaacccatcacatgacatcgcatcctagcggctagcggcttcccaccgacgagttagtgattatggttatatcgattatgagaggcttggcagattgctaattttattgatgctaacgcgatttgaaacaattgcgaacgatccaaattccaaaacaatggcacaaagcattactggctaatggctatagcagtatatacagatacattataccctgacatatccaggaccaaccattcaccgtactgatcaaaatctgatgcacagaatcatcagaaccaatggcccacaaaacaattaattatcctccacaagactaagggtaaaagggatggaaggactcctgtcctgtgatgagattatattctgcagtttattttccaagcagacggcgtgcccgagtgtttgctcccttgatcctgaagttcagttcgtcgtagtccttctctgaatctcccaaagcctttgtttgtctgaatccaatcaacagacaaaaagacatatcacatgatgatttttattggttggactgttaaagcaacaatactcatcagatttaaatataattatgcaaagtgttccagattagatattaggaagtaatttgccgcttgaatttgaaggtactttggccaaactttttactcctttttagttcgttcagcatgaagaagtgaaaatttttaaagaatggactaaacataaactggcagttagtacaaactataaaagtacgctggaattagagcacaaaaaagggattccacataacaatacgccaatctcagaaaaaacaagtgtgtattagtttttatgaactaaagtgaaaaatgtggcattcacctgtcaatctcagtgcccatgtcaaccgccatgcctttcagctcggtcaatatgttacttagatcagataggccatcatcctgctttgccttctccatctgagcaacacaacaagataatcagaatacacacacttagcaaatcaatcaccatatatgtcttagcgcattacctccactttctggagggctgaagttggctcggaatggaattggcgtgcattcgattgaggtgggtgatccgatagtcccagtttgtgcctttgttccaaatggctgcccttccgaatgaaggaatcatctgcatacaagtaattccatccttccagttagttacacagagaacataactgataagtgataccacatagtacaagctttccctgtcagcaactgttgttgcagtctactatttcaagactagagttggagattacctctagttagcataggccccctgatttctccattcttttttggcttccactttttggaaaatatacccccaagatcacccagcagcttctcgctctgaaaaggtgcgaagaattccctttagccattattaccacataatacagtaaatttggagttggcaattaatttctgaagtgtgacacgaagtttgtttcagttttcgtggacttattaaggatggaattctgaaggaaacaggccaattttggtggggacttgttacgccactatgtgatcaaacagaattaatcaggcttctgagtaatcacatagtattagttattagtttgtgttagttaccctggagagatcctggtcgatgtcgagggtcatcatgtgcgtgcgcgtgatctgctggccctgctggtgtatggtgacgaggctcttggacgcggtatccctcatctcctcggcgatgcggacgcagccctgcacccgctgagtggtctcctccgccttgtacgccgcgtagccctccagctcctgcaccgactgggcctccacgccgccggtgtcgcggaagtcgttcctgtaccggctcctcgccgccgccgacgaggcggagaagccatccccgccgccgaagagggagccccgctggtcggccggaggaggcacggaggaggccctcgccggtctctgctccctcccgccatcgtcggagtcggagtcgaaggggttgctgctccgcgacggcttcttggatgcgaagaacgatctcctcccgctcatctcgaaaactccttgggtcagattccgcagcaagcaagtttctgcgcacaaatgaaactgaattgggcaaagatcatcccccgtgccaacttgccaagaatacacacaccaaatcccgattccttataaattccagtaaccaagatcgaccttaactatcaagaaggtccagaaataactgcgcgtacctctgcggacagatcggaagaattagtagtaggcaagaagaacaaggaagagcagcacatagcaagaggatatataacagtagaaagcaagggcggatggtaaaagcgaggacttggtcgcgcgaaggcagaaccgcaatcgcgtgcgttgcctctggaccgctgaccctgtcctcctgctcctcctactcccttcctggcttcttcggcggtagagtgcggggcggggagccagggacacgcgcttctagttggaaacaggaaaaaccgtcgagattaagaaagaatataaattggcgacagcgatggggatggtggctttacgcgcagggactgctacatctctatgtgaaggcagcgaaatcttaactactccatccgttttatacgtaagactttctaacactacttaatatatccgtgctaaacgctacggtgtaattcatttaaaattttatgttagtaattttttttgttagcataaagacgtgaatataaactcaaataacaatatgaatatgatatgatatagatatcaaattaatggtttcaccatgtaaaacaagataacaattgttggtcatcttgttaacgtctacttttaagatatacatggaacaactactaaaatttgccgatggcaaaagtaaatatttagtgagacataagtgttaacacatagtcatgttatcaatccggtgcaaattgacgtatctagaacatgatggtatggagaagataatcacataatattccacctaaatagtgatgacgtgctttacaaaacaagaggaagttggtgagtaacattcggattaacaatttactatcttctaaaatatattttcgaattaattttgatcatgcgaacctacctttgctcaccagttaagaacatctttatacacgatattcttggtgctcttccctgtggggtcaacttctttctttggcttttccaaaatccttgttgttagccttgacacaccccttgacaatgcatcatatagctgaccatgtgaaaacacgggctctggaagatagatcccaacatttgggatggtttgtccttgtgatttgttaatggtcattgcgaaactaagacgtattggaaattacttccttttgaatttgaaaggaagagatatatcatcggagggagataaagggatccgtgggatgaacacccttttgctggcatgttgtccaccaacaatctcagcatcaattgcattatcttggaaagctcttaccataagtctagttccgttgcacaacccattattaggatcgaggttgcgaagaagaatcacaggacaattgatttttactatcagctcgtgtggtgggagaccatttggagtgatagagttaaggtaatccagaggatagctattgtgagggtcatcatcaacagagtcaaagctatgataaaccttggcctgcactggaaatctgtcaatcatattcgcattcagcttatccacataatcatttttagtggatagaatggcacgtgtgctcatataagatgcagagcttgcattcttttcatcatcaagcgagggaaacacatgattaatcaattaatgtactgaatcctcactatccccataagcaatcacaatttcatcaggcaagcgaacgtaatcatctctgatagtgttttcagttccatttccaattctaaggagatattccgaaaaccatggattggattgagccctcatgttacgcgacaatcgtatcttcctaatattttcccataaatacgatctctgcaatgttgcatcagttatctaggcccttgtcccacgtgtaaccacgggaagaacctgtctgaagtcaccgccaaaaacaacaaccttgcctccaaatggcaataaataacccataatgtcttgaagatacctatcaagtgtctcaacagctgacgcttcgtcattgcagcttcatcccaaataattaaggacgccatgtgaagcaattccgcggtgccactttgcttcgtgaagttgcacatgctgttgtgagcaatcttaatagggattttgaatcttgagtgtgaagtacgtcctccgggcaaaatcgacgctgctataccagacgtcgcagttgcaatagctattaatccctcggatcgcactctagcaagaagcgccttgtacataaacgttttgccagtgccacctgggccgtcgataaanaatatctggctcttcttattagttacattatcaattatctcatcaaatcctgcacgctgctcgtcattaagggatgtgtatatgtctagatggtcttggtccactagcacgttaagttcctctataatctctgtcattacgtcgttggtacgttcacctgattagtgaaaacaaaaatatgcgtcatgaaactattgatgggtggtgcgaatgtaaattaataaaaaatatgtgccagtataacaaaaaatacctatatcactgatctcgagaagaccatactccgtgatatcgttccccatggaatgaagcaaatcacgtatatctcgtagcaccatctgctctactgctgcagggttagtgttccctcggctataatcttcagacattgcagccttgtgattgtcccataatgcacggatatcggtgactcacaaaataccagtatggttgcaaataactgacgcagagcagatggcatttggaaagtggatgcctcatttaaacaatcatcatgtgacttgtccgtctccacaagccctctcttctcgcatgcctctctaaatgtagagtacgttgtacctgacattgtcctcaaatcttcaaacgaggtagcacctcgcacatggttgagaagaactctcaagttgtatctctccccttctccagggtgagcgtacacaacccgtccaacttgacctctctgcgttttccttttctgccacacattctgtccaattatccagcgatagtgttcggggaactccttgtatagcaatttccttgcttctgggtctacttgattcattttaaaatactccgtaagagttgtcctagaagaagatggtcgattgacaacatcctcaagattaccatcctcattatacgtgacatactgcatgttaggaagatgaagttggagctgcaaaacagctggatagataccgaacagtgggaaaccaagcatcctatatatagcctctagtggtgtcacatatctggcatttatgtactgttgtatctcatttatttccccagatggatcagccgagaaagatgcacaatcgtg

SEQ ID NO: 13703 - DNA, 5480 bp, Oryza sativa
gttgagcgggagcgtggggagcgggagcgcggaggcgatctcggagtggacggtgttgggcaggcggcaggcgcgctcgaagccggccctccggcgtccgcctcggccggggtccatggtggggctccggcgagcggagcggaggggaggggaggtgaaaccctagattcgaggaggggaggggtgggggatcgaattcgaattggaattcgaattgcggcggaagggcggatttgagattagggttgcgtggcctagataggcaagcatttaccactcgcctcgcctcttctagcctagcctagctgctacagtgattccagttcgcgcccgcctcccgccggcgaatcgtgccgcggaaggaggacgacaacgacgaggagacttttttgtttttttcgtgtgtaccctttgtttcgtttttaggagagagaatgaagatgttgggctactttttgaaaggaacaagtctattttatctccctcctccatctcttgcctgtgtaaatcacctttcaatcgtaaaaccgagtataatacattcctcatatttaaaaaccggtgtaaatcaacctattcggtggtttcaaaaacggtttcaacctatgtgccgctcataagacccacatgtcaatgataaatatataaaaaaaattaatctcacacggccacatgttcagtcatcctaatcttcatatgtcagccaccctaatctccttttctttttcctcgccctctttcctcgttctctttaatatctcttccatagtctcttgaatactttcaaacccaaatatgaggttgtggagggctgaaaaaaaattaaaactgatgaagaatttttttatacacataattatgtatagccctgactatgtaattagttgaatataactaaataaatactcagagagtagataaatcaaccagtcgagtggttttattaaacaattattggcaaacatggtgtcaaatatgaattaataatactcaaaatggatttaccaactccctattaacaaccaagaagaaatatcatgaacatcataaagccaaagatattggtcttaaaaagttgcacacatatgtggtttttgttaaataaaaacaatgacgcagcagttggctgattgcatttgtttaacatacgctaaacagtgcttatctttaatgtaaaaaaagttaaagtgtaaactataaagctcactgttcaccacctatttaaatcacattgtaccaactcttctaaataaaaggttgtgtaacagcaagaaaagagaattttcaaggtattggatactttccacgtgcatactgcaaagacaaatatacttgagtccctaaaaacccgtggaaggtcagtaaatgtttaatggacttcagcccaaaaaaaagcttaaagattcctaaaaaacaacacgatactgtgtatcgtcttgtccaccgcttcatcttcacaaaaattcctcttcgcgctcctattcacttgccatcgccgccaaagttagggctaagcttgtgtaggtatttcgctgatctttttttaagtactgcacttgactataatatgggtgtagttagaagttactagtaatgacggcgactccctcgctctctcatcgccgcctatctattttcctccggtggctagtgagggtagaaggggaaaaaccgggggagagagcggtttccacatgctcctcccctagccacagccgacccaacgcgactcctcgctcggtcccccagccgaggagctcgtagagccgcgtcccttgcaagaagacgcgcgcctctactgggggacggcttgggcggaaaagcgcccaagcgaacgggagctggacgccgtgagccaaagccactcgctgagctacgcattgtagatggcctaaaagagctggccccagtacaatgtcaacacttttttgtcaagattaaaggctgatgcaccatataagccaataaacatgcagaagaagcattttattcacccggtggtagtgtggcactgatgaaataataatttccgtaactaaccgaggagctcaacaatgaacaaatcctctctggaacacaaaagcctcataacaccaaaggctgttgtttaagttacaagtgttgggctacaaaattgatgatgctgtgtaagaacctgtgttctcacttctcagtctcagttatcagtcttttagtgtggttttggtacaaagccatccaccgcaaagtttcgtgtagctgctggtaatgccagtcgcatgccatcaagttctggctttgctatcacttgacagccaagacgagacctgaatacagttcacaaaattgatgccagattagaaaggacacgcatttaaattgaacaaaaactctagtgcatacaaagctaccatggtatttatacaattacaacttaccagcatgagaatatctcacttggctattttaacatgttggttgataagttactttgtctttaatttccattatgtcatgcatatagcttaagtcacggatagcggcaattagtttgtaaaggttgcacacagatacaggtggagacatatcaggatgattaaggaagcaactgcatatcgtatcctctcatatcaaatgcccccagtcctttgttttcccctccctccctcactatggccatcaactacttaaactattctaacaataccatgcatactcattggttgatacccaacattcttgtttgcacgataatcagacagcaagcaccacggaaccatgaaactggataagccaaattaataaaaccttcaagatatcttcacttacgtttctgtaagtccaaatgcaaggtcaagcatatcattttcttcatctgttggatcttctagcttattataataatttacatcctggacaaaattgaaatggctagttagtggcacttcaatctctacaatagcatgaaaaataataaaaaaaggaatggttatatagagcataccataactatgacatgacaggttgaacacgcaagtgaaccttcacatgctcctgcagtacccaaaatactagaccaagttactaactacaattaaaaatcagtcaatagtcaatacatgaaacatgtcaaataacatcaagtaatcaataatggacgccatgtctattgggtaaacataatttgctttttatagctgttcttatcagcaaaagaagttaagaattgaaagcatagtacagttgcaatgataaatcagtaaccttcaagttcgatgtcattttcatgagcagcttctaagatggacattccaacagggacactgattgtctgctctgtgccatccttgttcacaaatgttacagagatcctgtgcagcacaaagaaatttgctcattagaaaaattaatcggttgttttggacagctatttcctaggagggaaaaactgaaggagaagcccctttaaagacaacaaagacattgaagaaactcacattacaacgacatgggatacatcactaccttgtccaatacaaatattgctaggtattcaaatttcatgctataccagaaaaaggaaaagaaaggggagaggaaatatacttacttctccttgctctgactgccatcgtcacgatcactactagttgttgctgtggagaataagatgttcttctgaaaagttacagaccagtgctcattacatacaaggacatttgcaaatggtaaatcatctcttctggtagtacagaacataatcccaagataaagatggtggtggagaatgtgcagatagataaaatcttttgtctctcagtttcagaatgcacaattcatattggtcatttcagaaaatccatgtcatatctagaaaacatttatgattgctctttttgtagggattgtcagtaacagctatacaaatttcagaatgcaaacatcataaagggtatataagatacagttgacttggccaagttaagctctcggtgaaaacacatacaaagggtatgcaaaattttcgtccaaactcaccactaggcatcacaacaacaagatacagattggactaaccgttgggacaaaacgtcggctgagttgacctcgataatagctggttgtactgcttgccaaattccctactgcacaagagggagaacaataaaaagccaatggtatagcaccaagatttactcaacaatagtggctcagcctaaaccggccatagaatggatagtggaagcatgcatatcgttcatacaaatcgatcgctctctcctctttaatcattcgtgataatgtatagattcgtcatggtttggaagtatttctcagctgcttccagaggattaaccaataaaaaacaagagagacacgaaaagggtgcgtaccagctctgttctcgcgcagaagccgcgccccgagctgcgagatcctggacaacatcgccgcagccgacttcactacccaacacccccactcccgaaccctaacagcaacaatccaagagcgtacacgaatcagcgagaaccgcgtgggggccaacaaagcaaccgaacatccggggggagcagaaggcggagagagaggagacgaaccttccggtggccggtggccggcgccgccgctttcctcccttccacgacggcgggggaagaggagaaggagaagtcgggtgtcgccgccgtggcagaggttaaccgtggagtttggaagcaactcgtgggccgtgattttgtgggccttgaggcccattagtgcagagattagatgggcccattgaggcccatcaaagccacacggtataagagcctcaggagaaaccctcccctaaatttctctccccctcctcctccgccgccacgcagagggggacgccgccgccctccgccgccgcctcacgacgtaggtaacgtcgcttctctcccctccctctacctgctcatgctcgtgtgtatgcttagttgattctgatgagttacgggttaatcgggtacatggtcgttttcagttgattctgtcattagttagtcacgaaatatcgtttttgttctggggacatcttttttctgttctgcggtctgttccttgtgttgattgccatccattcaagcgggtaaatcagatttgatggtttggtggataaaaggtagtatgtgattgttcagcacggtttagcagcgggctagctgctgctaagatttaacatcgatatggaagtttgagaatcggtggactctaatacttgtgcgtgcttccgttgctgccaagccatattgcttattgtctgaatgctcgctcttaaccatttcatgtgctcatatgagcaatctgatttttgtatcaaatatgttatccctccttttttttttacaatagcagatagtgtttatgtgtgttaattgtgaggtcaatttttttttacaatagcagatagtgtttacgtgtgttaattgtgagatcaacttgtcattacatgtatgtacatgtcactggtt

SEQ ID NO: 13704 - DNA, 16545 bp, Oryza sativa
gtctggttacattgggtaactggtcccttgaagtgttttacggcctttatccgccgcatgtgctaataaacacttttaagttgcacaaataaactgtgggttccattttgtcttatatttttagatttactggatattgcttgggaatgtaagttgcagagtgttgtagtaaatgatataatgggtttgttgttctgtgcaatttactctactgtttccaaaggaaggggttcatatacatgttcccaattatcttatttctaaattctcggtattggatcctgttatcctgtattgatttcatatgcactgttgtttgtatgacagaaatagtcatctcagctagtgaaaatggtgcaatacaatttcaagcgtatcactgttgttcctcctgggaaggacttcattgacatcatcttgtcccgcacccagaggcaaacaccaactgttgtccacaaggatatgctatctcccgcattcgtcagttttatatgcgaaaggttaagtatacccagtcaaacttctatgagaagctgtccactgtcatcgatgacttcccaaggttggatggcatccatcctttctaaggtgatttttttcatggttcggtcaacaaagatcactacaaacttgccttgggccaaatcaacacagccagaaatatcattgcaaagatagctaaggactatttgaggctgctcaaatatggagactcgctgtaccggtgcaagtgtctcaaggtggctgcattaggtcgtatgtgtactgtcattaagcggatcagtcctagtttggcatacctggagcagatcaggcagcacatggcgaggcttccatctatagacccaaacacccgtactttattgatttgtggctatccaaatgttgggaagagctctttcatgaacaagatcacaagagcagatgtggatgtccaaccctatgctttcacaacaaagtccctgtttgttggtcatgctgattacaagtatttgcggtaccaagtgattgacactccagggatccttgatcggccttttgaggacaggaacatcatagaaatgtgcagtatcactgctcttgcccacttgagggctgctgtgctattcttcctggacatctctgggtcttgtgggtacagtattgctcagcaggctgcactcttccacagtatcaagtccttgttcatgaacaagcctctagtcattgtgtgcaacaagacagatttgcagcctcttgaaaatctgtctgaggaggacatgaagctggtaatggagatgaaggcagaggctatgaagaccataggccatggtggagaagctaatgaagagggtgttttgttgactatgagtactttgactgaaaatggtgtgatggctgtcaaaaatgctgcatgtgagaggcttcttgatcagagggtggagatcaagatgaaatcaaagaagatcaatgactgcctaaatagatttcatgttgcatgccaaagcctcgtgataacaaggagaggcctccttgcatccctcaggctgttctggatgctcgagcaagtgctgatgctgcaaaggaaaagaagaagctggaaaggaaactggagaaggacctagagaatgagaatggaggtgctggggtctattctgcgagtctcaagaagcattacttattggccgatgatgaatggaaggaagacattctgcctgagatattggatgggcataatgttgctgattttctggatccagatatattgcagaggtgtgaagagttggagagagaggagggtcttcgcctcgaagaggaagctgcacaggaagctttccagattgatggccatgaactaactgaagagcagcgtgaaatcttgggtcagattagaaagaagaaggcattgctcatccaggagcatagaatgaagaagagaactgcagaaagtcgtcctattgttcctagaaagtttgacaaagacaggacattcacaactgatagaatgggtcgccaactttcatccatgggttttgatcctagtgcagctatggaccgagcccgcagccggtctagaggtcgcaagcgtgagaggtcactgagcagagctgccagtgatggtgatgatatggatatagatggccagcagtccagcaagaaattgcgcgcgttgtcgaggtccaggtctaggtcgaaatcaagaccacctgaggaggttgttccaggagaaggattcaaggactctgctcagaagaagaaggcaattaagaaagctaaggattctgtgaggaacaggaacaaggaggctcgtcgcggagaggcggaccgtgtcattccaactttgaaaccaaagcatctgttctctggaaaaagttctataggcaagacgagcaggcgataagtgattcagcacagctgctggtcatcactggtttcaggtaggtggatgtggagcactacttataaacacataatttgtgacatgaactcaattatttctgggcttataactcatgttctacttgctcattttgtaggaagtgcagcatcattgcagcatggtgtgggaaattaggcgaaggaaggcctgattatccaatctgctggacttgttgtgctctgtttattcatactgtctgatggattgctgtgtatcccgtctcatcctctgccgagacataattttgttagcttatgttgtagctttacgctacattaatatggtttcgctagtattagttcgttacatggtactatgaaatactactcctgtaatggtgactttgttattatacttgaattccagtcctattcgttataattaattctttataataagatatcacatgattatgttttgacgaaaggaaaatatgtttcaaatcgttaaaacacgtttcatatgtgataacgatatgttttaatatatgttctcactgtatttcacaaattttttaaatgtttcatcatgtactactagggcccgttcgaatccaattaaaagggtggatggaattttgaattaaagtggcacgtttttcaaactgctaaacggtgtgttttgtgcgaaaactttctatatgaaagttgttctaaaatatcagattaatctattttttaagtttgtaataactacgtgaaacacttaatctttatcttcatcttcaggagattcaaacaccacctagaacatttgatcgcctgatattattttagaaaaatcgagcactgatattattttagaaaatcggacgctcgatttgtagagggttcacagcaatagatgtaatgttctgaaccaaattggataactgtatatagcccgttatcattcgcagaaataactaggactgcagatgagaaaagaaaaacaattactacttacaacgccgaccgaggtgaataggactgatgaatattactccctccattccaaaatactataaggcataatcacccataacccaaaaaccaagaaaataattattatcatcttgtagtttggatcatcctaataaatataatgtatgcatccaataaaattagagaacatgagagtgatgtatttaaaaaagtaataatttaatggagaagaggtcatatttaatagcctatatgcatgtatgccttatattatggaacatctaacaaaatgattgtaatggagggagtaataagaaagaaacatctgatccaagtccaagtgcaagtacagtatttggagcccatgatcgggcgggcatatacaaagaaagcccaaaactaccttagtttagctgctgggccgagtgctattgggccggacgaacacgcagacgcaacggagatatgtatctggagtcgaagcgaggccaacacgtagtggcgacggtgggaagctatggtggcgtggacgctacgacctgcggcggcgggcagggccatccggcgagccgcgtaccactccgacggcgcccctcctccccgcaagctccggggcccccgcttcagctctttcaataggaacaaccatgaggtgtgtgtgtgtgtatccatctcccttgataataacctagttcgttcttaggtttcgatctagagtttcccctcccaaattgaatagaaatatatccttttttttaagcctactgcctctgtgctaatacctgtttcatcatcgcgtttggttgttccccaactaggttaaaaaaagatggatttatttttgcttttcttatttcgaaattatgcccgtaatcccatatgttgagtatttaataaactactaaagatatatatgctcccgcgaaaaacacacacacaaattcttcaactaactagattcaggtttttcagattatgctgcctgtaccagtacgactgttatctgtttattgtgaggggaggagatggtattattccgtaatatgacagatcattctgcagttgtagatgatgcattattatgttcactaatgctcttgtgcttaaccatctcaacactttgctctagaattttgactgttagcactgttaaatttcattatgccgcataagagtgcaatccccctaagatgacaggtcattgtgcacacttgtttgtattgattattgaatgagttcgtatacgtatcattgcgtttcataatttcatagggttttagctgttatgatgttgctcatttgctgtagcatcttgacactacgcactagaattactcttgctgttaccatcgattaattaaagcttgtcttttgttcaagccttcatctctaatgttttagttttataacttcttttttagttttcccttccttttttattttaatttatttgtttggcaaaaccctccatgctctgaaaataatcctgtgttgttcagtattactcttgtctcccctgctagcttgaggggaaagaaagagagtgacatttttctgttcttacaaaactgtacctgttctcccgtatacttggggtttaactactctcaattcccaaacatttggttgaagcaccaatgccaaacctcactaaaagttatattcagtttttttttatcatgctgtactgttaaattatatgccaattgaagtgcactcctcttgatgaaaagtaggcacagccaagaaaaatggtgcttgctttccttcaactatgtcccttagagttcacattccccaggatgatataacatggatgagtttgtacaattaagtttgtttgggtcatgttccctaagtttgggttgcagaactcgtagggaatcgagtaatgcttctttgcttatgtagcatttgaatatcatactttataattttcaattctgaacagtgtgcttttagctgattaaaagcttggctcttgtaccagccttcacatccaatgttttttattcatctaacttcaactccttaccatagagattgtattaagaaccattaacaccagaaagaaaggcttggttgggcacagtgcacttgtgtaaaaggatatagattgccatcattcatattttgttttaattgaacagtgacatagagcgtgtggaattttaaggagaaactgaagttaaatatctgagtctttttgtacaagtctgatagtggatgtggattacaacagtacgcatgttgatatgcagatcgatgcgttgcttgaggaagtcaagaatacaccggttaacatgatcaccgatgacctaatgatccgaaccgtgcggcagtatgtaattctgtgaattgcagcttgtgtttttttggttctctatctggctgaccatcctatttactactgctcttccttgtctgcatgtgtagttcttttctggctcgtcaggagattctgtatcaaaatgttctgcgatcatgggtggttgtggcagcggtactcacagggtatagctgggggtacaacaaatttgctgaaagttctactgtcggatctgaaccaccaaaagaacatgaggggaagtagaagacttgacgattgtttttgctctttacggaagactgagtgtttgggataaaatgcagtgaattgtgcctcagaaactcgcttgtaaattggtcaatttctgttaactgactatcctgtaagacagggcttgggcgaccaatcttgctccgccttttacaatctccagctggtttggggtgtttcatgctctagataggctgctgctggtcgataatcaacggatgctctttctttttatagttaactcacaaggcagcttggtattacaactaaacaagtatatactgacagtgagaagaattaatttaaaaaattcagtaccagtaatgagtaaaataagcaaatttaaggcactacactaaaataaccaaagttataagtgtagcatacaactagctagtaagacagatacagtatgatgatatacaataatccatccatcttcagtggttgctctagcttgcttaatttgtattttaatgtatgacgccgttgactttttgtcaacgtttgaccatttgttttattcaaaaattttgtgcaaatatgaaaatatttatgtcatgcttaaagaacatttgatgatgaatcaagtcacaataaaataaatgataattacataaattttttgaataagacaaatagtcaaacgttgtataaaaagtcaacggcgtcatacattaaaatataaatatggaggtagtaacatttattataggttaattaatgtttggcatcatatgctccaaatcaggaggagtaacctgtaaagagggggagggccgctgtgattggcatgtatccatgcagaattggagatacgccgaatgcgctagctgctcgcctgctccttcaaaatataacttgatggtgatgataactcgtaaaattaaaaaaccaacttaaaaatcaactctaatatgaatgacgtgtcaaaatcccgaaaaaaaaaatctttaatttatataatagtaaagataaagacgcgcgggcacacagatatatatatacacacacatatacatatacgcttctgttgcaaggagtagatatttaggtacaactatgtgctagtaaaatcgaagcactgcaaaattatactccctccatttcttttagtttgaagttggtcatacatttggaagcaggtgtagtatttgaaatttggtagcaaattaaagataaactaaatcaccagtacacgaatagctcacatagagcattcttggaggatggaacaaaaaaaaaacaaatatcttccaggtcactagacacgttaaatacaaggggatcaccacatgcttacaacacacgtactgtaatttaattagctggagtacataatactccctccgttcaggttataatatgttttgattttagtcaaagtcaaactgttttaagtttgaccaaatttgtagaaaaaagtagtgacattttaatctaagacaaatttattataaaaatatatattcaattattgatttgatgaaactattttagtattataaatattactatatttgtctatgaacttagtcaaacttgaaacagtttaactttgatcaaagttaaaacaacttatgacctaaaacggagggagtaatggttacaaacacaatgcaagtcgatcatcacaaaatatgtgtcaggggcaattgcgcaacggaccatattctaaggactaacgtccagttctatttcggctcgtcaggagatgcttgttcaaaacgttctccgttcacgttcatggtttaactgctatcagagttttcagacattctgctattagctctgaaccaccaacagaacatcaggcttttatatatatatataattagctctgaatgtagtgaagatgagcatgtgacataatcgaacatcagcatttttttatatatatataattagctctgaatgtagtgaagatgagcatgtgacatgatctctcctgtgtatccgtcactcttgcgtttactatatatggttatgtttgtcaacgccaggttgtggaggcacttgttcaagacagaaacttcaatcaggttttagattgccaactgagagaatcaaccacttcctttatgacattctgatgaccatcattcaggattcaggagggaattaaaaaaaagtgacaagcatttcagagaactcgcaacagcagctaagttacatgatataaaagggaggtcccaatcaacaacgatttaaatcatagacggtccaaggttaccacagcttgttagaggcatttgattacagaatcatttccagtccatttggaattgagtactattactcttctagtcgtccaagcttcttccttagttcctgccgctcctagtgttcgtctgttgtatcttccttagttcctgccgcttcaggtgttcgtctgttgttccctttgataagggtagcgaccccagcaccgaaaaggtagccagacattgcaaatgcagcaaccatccacaaatgccttatgttgtgtgtgccaatcttcttcctgcgctcaaggatcaagctgcagtacatggatcaaaaggaaaagatcgattagggtgcatgtgcagacagattacattggcgacaaaaacgcttgtagcagcatcacagctagaaaagtacatatatatacctctcaccgctttctctaaccagatcatgttgtgacagaacggctgatgcttgttccgccttcccatacactacttgaaactgcatagcaacatgttaaattccactggaatatgcattgtaaaatttggcttatgatgacaggcaactcccaaaacaacagcagtatatgtcatttaatgatctagtatatatcatttaatgattctttttagtgcagacacttggatcaagtgctgttcttgacagtactccctccatccacaaaagttacacctatttcacatttaagtttttccaaataagttgtttctatttgtagtctgtatgcattcaagatttaagtgaagagataaattaaatgttttattagaacccaaggagtcatctaaatactcattggttccatgcttgcattcactccttgattttgtaacatccaaggtgatctaatttctccttggtcttggtgtcaaaagtaatatgtgtaacttttgtggatggagggagtaattgtgaaactgtggatgacccttaatttgttgacgggtcctgatatgaagatgcttggtttagattactctttgaatgattaccatcatttgtaatgctggtgacaccaagtaggcatgtagatggcccaaaccaaactggcccaacccaatccaaactaggcagtccaacacaatgcaatccagtccccccacagaaactgaactcacaaagagatttctctagcgcggcggtggtggtgacagcacacagcagctttgttggcgctagctgctagcagaggcaaccctgacttgactgcaaatgcaacatccttagcacaggaggtggcaatggcatggtaactttcggttacctggtatccgcagccacattaactatgcctagattattaattgggtgatcttctctaatacctcaatggacattcaaacaatttgattttcttaaaaaaaaataaagattttggtgagcttggtgatcttctccattacctggtgaagttctcctcacaaaaagaagaggctttttaacttatgagcttcattcactactagtagtatactagtataaagttccagaccaaataaaattccacgttgtgcgaagatccgaaattttcatatctaagcatatgcagccctctaattccaaattttcatatctaagcacatgcagccctgtaattccaaatgtaagcaggtaatggatgaaattctgtttctaatcaagaagctcacttgtgtgtgcagtggtccttatccatcagacttgatgtccaacgaaatactccgtataacaaactaatggttgccattgattaattgaatgtttgctgtcaggaaagaaaaccttattaccatttgcaattggttagatcaaccattacgagataaggcacagtgccgtcagtctcgagctttctttgccttttctctgttctaatccactaaaaaatattacttgactgagatgttgttttccttttggaaaattgcaactccagcggtccgtgcaaatacaatccatctgcttggatcgtcaaaatcataatatgtgccaataatcatgatttgtttcacatagaagcgatatcagcaagggtaattgtaatactagctatcatttgctttgtgcctgctagctagtttgattagaaatagaattcaggataatacgtgctctcatttggaattaggggcggcttgcatgtgcctagattgaaaaaaataggcaaaaagattcttttctttttctcccatgtctctatcgacgatagactatcgttcaagctggtggagggggattgaaacactatcgaatttaaactagatcgaatggtaggaaggagctagggctataaatgatataattatagaagagcgaaaaagggtagtagtagcaaggatcgagtacgcacccactcaacaccgtagccgccggccatctgggaaccatggcgcgcgctcctcgtcagcttctctctcaagggaacgccataaatccctcgatctcgacctcgatgtcgcctgctagagttagggttagccagattcgtttttgtttgggttgcgttcgacttgggtcggccttagtctccgatttagtccagccgagattctcgaaggccagtgataataaataaataaagactaagttcactttgactcccttgacaccagtgacccaatctaattcgtatgactgcaataccggatatcttcacacacacacccaattattaaaactgatgcaattttactctcttaggctgtgttcgggagccgacacgcaaaacaaagcagcgtttagcgcatgattaattaagttttagctattttttttaaaaatggattaatatggttttttaagcaacttttgtataaaaactttttttttaaaaaaacacaccatttagcagtttgaaaagcatgcgtgtggaaaacgagaagagggagttgggaacggctgggaatgaacgcatccttagtggttttggagggcggtttcactgacgtggcgtctacgtggcagtgttgacctgatctatggcgttgatgtagcgcttatgtgggacccatttttcattaaaaattttttgtggtgcacactaatatgtggagcccacatgtcatccgttgcatattagattagagagaatttattatataccactgagtttgttcgagtttaacaatttgccattgacattgtctctttctataatataccaacgactttatcagttgttttacaatacaccattggattgggccttcttttcaaaaatacccaaaatacacttagagacatacaagattaacaattggtttatttcattagaagtttcaaaaaatatataattttttttgtgtggccttgccgccttgttacaaaatatggaagtttgtatacatgttttaaattttttctggtatatttagtttttagaaaaaaaatatttttatgtggtatatgagagaaatttgcttatacaagagataatagcataaaaatatcttatatagtgtatgaaagatgatttatattaataatggcaaatagtttgccagactggcatgccacataggcaaaaatgacaaatactccctccgtcctaaaatataagaaccaggactggatgggatatttcctagtactacgaatctgcacaggctgcctaacttctctttgtaaagaggataaagataaataatggtcatctcaaattcaataacattttgtagtgatatggaacgaatagaatggaaataaaactatggtgtcagtacaaagaggctgctaaaatgattacggtgtcaacataaagaggctgctaaaacagaattcattacagagggcattaggatgatcttgggaaaggagaaattgcccaatctgaatcaatggtccaagtattcaacccactaaactatgaaaaaaatagaactgagtattcaatccactaaagtatgaaaagcagttcgaacagctccatagtggcttggccatgtggactatgacaagtgatagtgaaatggtgatggattcgataaaaaaaaattcagtaagtcatacagcatgaaaaagaagtgtgttaatgtatagtattcctgggctcactgattagtgaggaaagggctcggcttgagtaaaatgagctaacatgtgagccacgtaagcaataccaccaacaactgttggatagactttttattccatattataattcaatggttcaagcagggcatagcatggcaagaatcttctaagaataagtttgcattttgtgtcttgtcattcttcataaattaatcttatataagtgcaccccccaaaaaaagtatgtatcatgttgttatttttcacccagccacttgtaacatgtttgtagttcaatgtaacttgaatagaaagctaagaaaattgtgcaagaaaatcacatgaatccttaggggcaacttcaaagaggaatttagaaataagattttattcacaaggccgtgtgcaagtgattggtgtgcatcttatagtgctcccatggcatgcataggtcgatttcacctttctggagggtacagagaaaataaagttatactacaagttactccgtacaagtttagttatagggcatatattttgtttcgccagtacaatgctttgatcaactattactctgtgtagttggtaatatattataatatttgtgtacaaaattataagtagaagaaagtatttatgaatacaaaactaaaaatacattaatattgtttctcgaaaattatatttaatatatatagtaaaaaaatgatgaaagcattatcgtaacaaaataaaagatgccccacaatttgtataaataagttggagaaggatcgagcagtgcttacaagccaacaacaaatataggcagtagcactaagtattttaatgatggggggaaaatagaaccagtgtatctctcttaaaaatatactatatgtttggggtgggaaagaagaagaaaacgtagcgtattaacgcatgtcgctagagcatgtggtatatcatatcagaaatttacaggatcagtagagctcctagtgatgtacagctcctatacagtcgcatatccatggcagcgtagcgttggaccggatcggaggcacctaccaaaccaaaccaaaccaaatcaaatcaaatcaaaataataatataataataaaagagtaaaagaaagaaaaaagcagcgttaatagaagaagagagtagagcagacacgtactgcgattttgcgttgacggacgacggcatgagattatctgcgcgcgccacaaaaggcgaaaaaggtactgcatgtcctctgctcctccctcctctgcgatgcgagggggagggtggtaaaaagtctggcaaaacaaaacaaaacaaaaacgaagaaagaaagaagagaaaatctgtgcgcctccctccctcaaatcagaaactctcgtcgctcctgctcctgtactgagctcctgtactgacagactgacagacacgacgagattcctctcctcccctccccttctcttccttccgtcatcgatctgtcgcacggaggagggatcaggcgacgaccataaaaaaacccacaccgatccgatgagagagagagagttgggaggccagatccgatctccccattagtaacttatccctggaaagaagaagagagggaggggcacgcgaaattccatccctgcccctctcccttatctgactcactccttcccttcgctcgctattcactgactcattagggccggctgtgttttcccaactaatctcttttttttccatcatcacgttttttataaacttctaaacggtattttctttcataatatatatatatatatatatataaattatttagaaaattcatattgatctattttttaaataaaatatagctaatacctaattaattaaatgctaattgatagctttgttttacatgcactgtaaatttaatttcggaaccgcaatgaacaaacacagcctagttaaggctgccttcgcacatctaggagttaatagttcctagaggtgcgaggtgtgtcctagatagatatccgatcgaacatccaataatcatccatgtcagcaggaactctcaacctatgaaatgaaggggaaaaaaagaaacaggagggaaaatatatatatggtcactggatgctgctacttttatacactagaagaaagaaaaggagggtgaatatgtataccagacataaggaggaggagttggttctcctagcgagcgttgacggactggcatgagtcatctagttatctgcgccacaaaaggctgcagcagccagcgaaaaggaattgcctctgctgctgctcctgaatcgcgtgaaatcatgggggtcgcccgctccgctcgtttcgtccgtcttatcgctccccctcctgtactgacagacacgacgagattcctctcctctcctctgctccccttctcttccttccgtcatcgatccgccgcagggaggagggatcaggcgacgaccaccaaaaacccacaccgatccgatgagagagagagagagagagagttgggaggccagatccgatctccccattagtaacttatccctggaaagaagaagagagggaggggcatgcgaaattccatccctgcccctctcccttatctgactcactccttcccttccctattcacggatcgtcgtatctatatttatatagaatataaaaaatatatatgggcttctttttttcgccctacttttttttccatccgtttttttcgtcgcctccttttttttcgccgtttttatccatattctttttttcgtcgcctttttccgttttctttgtccgctttttttcgctatttttaagtcgcaattttttcaataatctttatatcattccctgtctaataatatgaggatttttgttaaaaatttgttccaatgaattatctaatctcattcccagaattctttgttccctactccggatcgtcgtttctttttcttggacacattttggctctctatcgtggcacttaacgcgcaggaagagatatggtgaagtgcaaaacaaatttttccagtggagattttatatggcccgcctttttagtttttgaaaaccaattttacccaatctcttggtgaaaggaaaattttaacaccataaattctgtttaggatttccataataaaaaatttgggaataaaattttaagttgctgttagtgatgcttattcgggtttatttagatgtccgtcttcttatcgtcgggccgtatctagcgccgccgccacatcgatatgcctcccccatgcgttccctcctcctattaattgcaaaaggccaaaaatcaattcactactactcccctgtcattttcccatgagtaccaactcaaccatttgtatattcaccaatctaaaaaaatattgcccaagtctatcaaatatatttatagggtgtgtgtgcgcttcatagagatggctatatgcgcttcatagatattatgagtcgaatagagtagcacatacagaaaaaaaatgaatgaggggtagaccgtagacgtgtactcggtagcatcatgaaaaacctagcagatataacgttgcatagtaaagtaaactatgaaaaaaaaaacacctaattgcagtagtatactctgatgtgcagagcttaattgggtgggctgtcacgtctctaccacctgcctcgtatgcaacatactaatatcctccaatatatgtttgataggagtagttgcgtactttttactttttagcataattttgagcatagttttttttttcttttttaccgagggtgtagtaagcccaacatgatgcatatgactcatgtaaaatttctgttctttttgtttaatgtataacccatgtaagtttagattaatctatgggacacccgaaagctccgctacaaataagctcgcaacagccgtcgttagtatacgagccgtgatttagtataatggttttttctctagtaatatacccgtgtttgtaacgggtcagacttatgcaagtaaggattgactgagtgtagattagaataaatcacaagccaggttcgtataattggggattaaataagtggatggattgaggagaaaacacgaggtatacttatataattaggacttgaattggctggtaggtggattaagaaagtattgaacaacctcaatagatggatggtaagaaggtgacatatggagtagagaaaatcataggggtagcattttcaatgttatgattcaaatatggagcaattgacaagttggtggtaacttggcagaagaaacaataaatatcaagtaagtcattcctacgtcccttaatataaaaagttttaaagttggacacggttattaagaaaataggtagaagtgaatggtgaagggttgt

SEQ ID NO: 13705 - DNA, 4334 bp, Oryza sativa
taaggattgactgagtgttagattagaataaatcacaagccaggttcgtataattggggattaaataagtggatggattgaggagaaaacacgagctagacttatataattaggacttgaattggctggtaggtggattgagaaagtattgaacaacctcaatagatggatggtgagaaggtgacagatggagtagagaaaatcataggggtagcattttcaatgttatgattcaaatatggagcaattgacaagttggtggtaacttggcagaagaaacaataaatatcaagtaagtcattcctacgtcccttaatataagaagttttagagttggacacggttattaagaaaataggtagaagtgaatggtgaagggttgttattggttgggaagagaatgttggtggataagttattatattttgagacaaattctaagggctaaaagttgtcatattttgggacggaggaagtaatagctagctctttcaatttgaaacaagtgaaataaagttttagttcaaaacggcttcttcacaaggtcaatgctaataaataacgagtattcccaccgttccgtaaaattataatataaggctatcaatctgaacgtaaccttagcctctaaaagttttctatttttttaggctatctatatatttatcgataaattttattatagaaaattttcagttgcaaataaagtacgatatgagtgtaatcactgcacaatcatatatgatataacaaattaaagataaacaaaatcactggctcacgaatagctcatgtagagggaaaagaacccaaaaatgcgtgagctataaaatatatgtactagcaaaatcgggaacggtcagcagtggtagaaatagaagggcaccaccacatcaaataattaaccaatcaaccaactcacatgcttgcaccaagcagaatactttagttacaataaccaacacatgcatacaccataaacagtatttagctacattatagtcagaatcaaaagccatcacgaagggttgtgtcaggtgcaggctgtagacccccgattttggaaatcgaaaatcttctatgtttatccgtaccaatctctggatcagtagttggtacacacatacatagttggatcacaacatatcacgaatgaatttaggctaaaagagttaaatacttacattagggccaggtaggccaacaactatcagagaacaacagcagaagacaaaataatataagggcctggttaacatgccacaggcagtcgactggggaacgagacctagaacaagaccgcactccgatcatcttgtgggatacgcaagcgtaccgacaatggcttctctttaacactctcctaaaaaatatataaatagcaagggtgagtaccaaccgtactcagcaagccaccacaacaacaatgcatatgatagagggtattcaaggaatgctttcaggttcttttgcataaagctgcgttttgcaaatattttcacaagcctaagacctatcatagactgatcatattttaattccagtgttcacattaaacaacgacggttctgtccaccatccattgtgatcccaaggatagcttcccgccattgagtcgtcatggttttctgaggacgtccaccttccctcctctcaggaagtggctccatcagcataaaaatcaccatgcaatatcccatcccacacaagttaagaatttagagtctagccaagtgtaatacatgtcccagtgctcattaaccgcgagcacggctattcgaatagatttggtttgctcacactgcagtggatgtacactttacccacactccgcgactgcccaacacatgagcctcgtcccaacacatgagacgcgtcacggcaaagcttttcgataacctcgcattggcagtacccgctccatgaacttaaatcctcatgcattctaggcgtccatgtttctagcagtgagaggagttctggcgctcccgggaaagagaagtctcacacgcatattaaattatggttcaagttaagttctctctctcacacactcatggcagtcctaccaatggcgacaccgatgtagggcacgcttctcggccctacctcaacggctgtcccatcgtagcgcacctgcctcactcaggggtgaaccatctatgcagggatactgcctccgctcggctatctaatccgctaggtctatatcccttcgagaagtacggttgtacgggggtcgtttcatgcttaacttcatggctcggtccttaattgactggggacggtactagccttttccagataccacccaaatcctccatccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtacgatgttcatcattgcatgcaattttatttgtaaacaaaacaatttcgcaattgggatcaacatgttcaaggaatagtgatgacttgccttgctcaggatagtccttattcttgatataattcttgatcaaccttcacctcctgaaagttgctgacgttgcctcacaactttccgatccacaaagtctataatacgctagaaaaaccaatattcaagcaacattcaaatatgcacaaacaaaatatattggttgaggttgaacctaaggttgctcatattattcgcgcttgctaatgggttccaacatgctaagggctaaagtttcttaatctttctgttatcatggtggtctatttaggagctagccaatgtagtatgaatgagatacgtatctggctaatttggggtttagtctagctaatggctatggaaggattatggctacacatgcatctatctaaataaaatggtcgtatactagaggttctgttgtcggatggatttaggatcaatcaaataattacagtgaatcatttgtattatttattttattgatggaagctttactttaattatgaacatattttacttgtcacaataaattataaaaggttaataattatccatgcttcgtatgttagagttgtttaggttaatcatattatggttacagattatcccatcacataattttacaatgaataatcctaatttacagttaaactataattataattatatgaggtcaagatttataactagtatttatctaatatacatgtttgtcatacactctctcttaatttcatatatgcaacacgcaaattaatactataccgtaccactataatgggatgtatagtttatgtgtaagcaacaatatcttattattggatcatatatttgagtagtttctttttactgtaagctatacaatacatgttgattttaagatggctctatttggttaactaatggatatcaaccgactatatatatatatattctacttcacatgacattgaatcaactaatttttttaagtggtccaaatacaactagctctgtgattactctcctaaacaagttaaagattcatctatgtgtgtttatagtttagttagaaaatatgaggctaaactttatgtaaataatttataagtcatagaattaattatatttggacataggctagtaaatggcactaatattttcctttacacccattaatttgaaggattgattataactaatttatttggttgctacagtgacaagacatattaaagataattatgctactgtacaatatccattttttttatttattggcacactatttaggttaactattatctaatcatttgatattaattaatttataattataaatatattttattgaatagtgaattatatatcattggaaagcttatgaatttagatgaatttaggttcaagtttcactcaaatccgagttaaaatgaataagttatgctagtgtaaagattcaaatttgaattaattctaataattgtgaaatggtactgttcctaattcatttatttttaatacaaccttatccacaggctatagtgactgacaggtggggtcttcctattttcttttattttattttatttttctttctaaaggaatcatatgggcaaatgacaggtgggcccgactcctttgactagggtcaaaccggccattaaacccggtagggcc

SEQ ID NO: 13706 - DNA, 2583 bp, Oryza sativa
acgcgcacggcgcggaggggtgcggggcgcgaggtggcgcggcatggggcacgacgcgggggcgacggcggcagcgcgcgcggaggggaggggctcgagacgacgcgacagacgacggcgatgcgatggagtgtggcgcggcgacaggacggcgcgcggcgcggtagtggagtcgacgggacggcgatggcgcgcggcgggatggagacggcgcggcaacggcaacggcgcggcgctcgaggcgagcggtgatgtgacggcgacacgcgacgacgtgacggcgacggcggcggcacgtgcggaggagcggggctcggcgcacggcgatgggacgggcgcgcagcggggcaggggcgcggggcgcacggccagctagggccccgtggtgggagaggaggggggagggctaggggaccacatcgaacacctatgccgtaatgaacagtgacttttcctatttatcccgattttagtccatttcttgtgtaaatttgattctataaatcctagattttgtataaatgaagtttacccaatatttgtgtcattccaaccaatggatttattctagattaatattactcatattttatttatataatttatttgaatttttaattagggttaattcttattattattatatatttgtcaaagttttcctatttttcttcttttagggttttggttgatttataaattcagaaaagttgcaaattaaatttgtatttactcctaagcatttgggtgaccgtattaagtgttcaaatgtgaatttgcccaaaatttaatattgtccaatatttaaggtttattaaagattctataattttctaatgagaccgttattaacacaatagcactttagttcaatttatttatatgttagtttatatggaggggtttaatatattaaatttcaatccctaaatgcaattaggaacttggtgtaatatcgatctacatatagaattaaatactcccataattctattatatatatattatatatacagagagctcagtttatttgaataatcatcatttcatgtgtactcatattatggcacccacctacattattcaaatattttaatatttgataaaataggttaataataacttttcttttatttgattttaatatcttgtgcataattatttgtaggattaaatatattctcgtaaatcatttctattgcttaaatgtagttcttttctttactttcttggtgatcatttatggtttggcaagcaataggaatcataacaaccagcatgatgcaaaagttttaaaaagttcgaaattttagtgatttttattatcaggaattttcagggtgttacacaggccctcctccatctaacattacagctaattaaacttcaagcattagtaccaaactttgcacgcttacgccgcgcatctctccagccagcactgcatgccccaactacaccggatgcaacaaacaccgcaactacgttacatccaaacactagattatctcgaaatacacccctgggcatcccgcagaaagtcaacaacctgtgcgaatgatatacacaacacatatatatgaagctgcccctgaaaccaaggtggaaaacaatgacaaacataaacttgcaagcaaccacataccggctgagcacatttctatcttcattctccaccctttttaccttctcgacatcttcaatcatttccctcttcaccttcgccttcaattcatcaatttctctgacgatgttggtccttctgacctgattaggattcacaggtttgagcacaaatcaagacaaaaatgatcaattactccctcatggtatcagaggacggtaagtcaccagcattgttagtgctgagttgttactgacaagcattcataggcctcaacgtcgccggctgatttagagaagaaaatgaaacacacaagcatacggcggactgaggttacaagttagaaatatgagagaaattcacatactcttttagaacctatatagattcagcggtaacacttaaaaaacaacattttttaattagtaactgatgaaaatgagcctgtaatcacagtatgaaaattaactatgaacattcagcaagtgtgttcttaacatatatcagaaagccgactgctttctaactccagaactgttttatgtgcccatgctcctaatacatggtattactgttacattcatgcggtcattttctaatcttttagagaaaaacagaatctcttctaatataacaaataccagccaacttgcacatacaagacgatttaagttggtcttagggagttagggaagaggagcccagtagcccaccacctctccaatctcatcttaatcttatatatgttttaccttcagtatccaaaccaagaggccagataaaggctatatttatgtgcaacgcataaggaaactctaagacatatagacagaaaccaaaaagaagagttttttttgaatcaatttctaaataggattagagatggagtaacataagtgaaattctctacagttatctactgctgactgttagaggggacaaaattaggtactgggatt

SEQ ID NO: 13707 - DNA, 11720 bp, Oryza sativa
aattcctgcagcccttctttattattgtttttctttcgttctttcctctctcttggaaatcgcttttgtattttatcggtgggctgggttgggctgggctgggctttttctttctcatcccttcccggattcggatttatcccctttttttttgttggaagtaaaggtgggagaagagcgagaaaaaaaaaaaaaaaacttgtggaaccctaaccctaaccaggacggacaggaggagtagatccgttcgatccccatgtcgttcgccgctacaaggatgatggcggcagcccggcgcgccttccactccaaggccgcggaagacgtacgtaccctactccgtctccttccttccttccttccttgcttcttcttgccttagcttgctttttgattatttgattgattaattgatgatcgctaggtgcgtagacatctcgatgccatggaaaaggccaaccttgaaaggttgccacagctcttggatcccatcatccggcagcgagccgctcgagatgtccaccgcaatacccacaggatcaagatctatgctaatccttgcatagggaggtacttaatccatccattatctatcacatatatatgcgtcagcactcatgtccttttttttatatatatgatgaatcaatcaatgcgatgagctaattaatttattatccatcttaatttgcattgcaggccaccgcccgaagggcacatttggtatgatgtcgcctgggcaaaaaatcttggtctagttttttttgtcacctcattttttgggatgtacgatgttctattcgaggagactcaacagtctgaccaccatatgtcctcctcgttgccaatgccaccctcctaaattattctgtgtaaaatcatcgctgccgaccgattttagattatgaaataataatctccatgtcctgtggtcttactctatgaggaccttcttaattctagccttgtggtcttataatctattagtacctccttaatttaagccttgtggaagcacctacttaatttaagccttgtgggcttgatgtatcagcacctacttaatttaagcttttgtgggcttgatgtatcagcacctacttaatttaagccttgtgtgcttgatgatttaaagtaagtacatccttaaacttaaattaagccttgtcgttgtcgtcttgatgcaacattacctccttaatttaagccttgctgtcctaatgtttttactacctcctcaatttcatttgtaggccagtgtcacaacttaagagtaactttccgtggtaacagtaccactatatgtttttctcaactttaattactgcgtgcacccaaagatcccaaacacaacttgctcactttttttttcatgctgccttttgattatctgtttacaatagggttgttcggctgccctggctgctgctaccataaaatttcaatactagatactgtattggctggctgcaaagcggccatatatagctttaccgaacatcccttatgttgctaagattacagaaacatttgtggtttagacgcttctttgttcactattaccggtacttaattgacggttttatgaaacctattctcaaacatcttcctagcaaggtgacatcatgtttcatcttttcttttcatgggttagttagttacctgtggcgttgtttcagtaaatggtaaactcttttggtaattcttgaagtgatttgtatttgaatggtttcttcgaactgtttgtgatttggcatgttctgcaatcagttgacattgttgttatttataatttgctttcccttgttctttcatgattttgtgctgaaatattatcaaggttgggatagttgtttccgcttgggttatgatgatacttgagcttggatttggcatatatattatattactactctcttacaatgaaccagaggggagtgcttgggttccaatactgcagagctgctagggtgcatgtaggcagtgttgcccttttgcctataagatgggcttggtagccaagcgcctagtcgctcttgtttgctgccaagctgcatgtttggtgttatttctgttaagtgatgcataattgcgatgagcaggtacttttgttcatactgcaatttccatcagcagaaatttcagtgctattagttatggattacctgttgtttgtcttttttgttcagtttattgatttctggttaaattaaacttgtgctgctgtttcaatgtcggtatgtttgttgatgagacgagtcagatagtgtgatactgagctgagttactagcaacatttgtacatcggagtcgaagcgatgtaatatatttgtaacacttcaaaattttatgaataaattgtgtgtttggaactttggaccgattgtttcagtcttttagttactgctttcggcttgtgccacttttgaccgcaccaactattgttggtttcatttcatcttagtgtatagccgagatcatttgtgatgtagcatgcgtatgctatttccttagcacaggaggtggcaatggcataatgacttgcttccttgacaccaacaacagtgccaacaaggaccaggattaagacattcaaccaatttgattgatgtcaaaagttaaatattttggtgatctactctgttaacatatctagtgatgggtgttttgttgttctgtgaaatcgagccaagatacataagcaaatattatccatacatattgctgcatcacaaaacattcgcctaggaaaaatatgtttcttttgacatgagttttcactaatgcaggcatgcatatatgtaatttatctagaccaaatataataattcaagtgttgaaatatgattttttaacatcacatttagaaaaactttatttcgtgagatgagtgctgctcaacttttagatgggactaaaagattggatgtttggacattaattataaatattaaacgtagactattaataaaacctattctataaccctggactaatttgcgagacgaatctattgagcctaattaatccatgattagcctatgtgatgctacagtaaacatgcgctaattatggattaattaggtttttaaaaaaattgtcatgtgaattagctcttatttatatgtaattagttttataagtagtctatgtttaatactccaaattcatccgatatgacagggactaaagtttagtccctggatccaaacaccaccacctaaataggttcttgctgtgtaacctatccactcgggtacttgcatgtgcgcgtatgtttatatgagtgtatgcatttatattgtattttttttaaaaaatttgattttgttttttctaaaaaaacttttttaaacacgaatgcgcttggcccgatagtaacctgaagaagagaaaggaaaaataaaaaaaaatggaacccttacaaattgggcgtccgatttatttgtcaaaattgagcgctgtttcgttagttagaaaaaaaaatgttacacctagtagatggagaatgttttaatttatactgaaacacgttatggaacatggaatttcaccctaaggaaacaccaacaaatctatatcaatcaaaaaccccctgttagcacaacatttcaatccaacacaagggcacccatccaccactcttcccggcgagcatctcgctctcgctgccggcacggctcgcgactcgtcgccgccgccgcccgacgcggggcgccccaaaggccgcacggccgccgctccgtccagcgccgcggcgtggcgcgggcggtagtacgacgacgcgctcatcccgggagcggcagcggtggcgaacctccttgcggcagcgcgtcctgtcgtcgtcgcgccgagctccggcctcctactcggccagcggccggcggcggcggctacggctacggaggaggagaaggagagcgagcgaggcgccccattttttcggcttccatcggccgcacttttgacagcattttcgaaagaaatccccaattgaagaagaattggagaggagaggcggcggcggcggcgatggctggcggcgacagggagagggatgtcgaggaggagacgaggaaccagatgatgcagaacctcttcggcgaccagtcggaggacgaagaggatgacgacgaggccgtcgaggtcgtcgacgaggacgaccacccgcatccgcagcagcagcagctgcttcgccaccaggtggtggacgacgacgacgacgaagacgacgtccgtagcgaaggccatgcccgctccggctaccactcggtaaaaatctcaaatctcccctcccctgcttcctgtccccccgtcctggggctagggcttaggtttgttcggctggaataaatctcgccattgggatactgcagtttgatgaaccagtacatttctgcttcgctgatccccaatcatctgttcgaaaattctgaaaggaacatcttgataataagctttgctagtagaatattgtacttttttggaccaaaactattgtaattttaggtgacgtgatatggagcattgcctcttgaacaccactggcatttcagaattccatcattttgtttcctcacactttgcgcgcaagtctgtcagtctcaagtgtaaatcctctgtgtgtaatgctagtttttttcagtgcccagctgtagcaagtgatttggagacatactggacctatcacggtgtaaaaatcgaaccgtcattccttgctgatcttgccacagagtttagctctcgtaggctcttcttgtgccccagttcttcattgatgcattctgtatacttccgctgcagctatctgatgtgatgcttgcttattgatttgcttgtacaggaagaagtggaaggtgaggctgataatggaggggaaggtgaagcggaaggagaaggtgaaagtgaggggcaagttgggatggaagaagaaagcgaagctgaagctcatcaagctgatcttgatcaaggagaaagtgatggggaaaaggtccagagctccccagaaagagaatttagtgaccgggtgatgcaaaatgatgcagcaggcatggatagtgaagacggaggctatcagcagtggccagtagctagcggaagaagaggagttgttgcctctgaatctgaagggtctgaagatgactattatgctggccgaggtcatgaagatgaggaacctcatcaaacaaggaaaacaccaaggttaagggaaaacaatcagaatcctatctattgtccgtgcattatatgctttctagatctgacattacgacgtactccctccgtacttgtaaaggaagtcgtttaggacaccgacacggtctccaaaacacaactttgacttatttctataaaaatatttattaaaaagtggtatatgtatacttttatgaaagtatttttcaagacaaatttattcatataatttttacatttttaaactcaacaacttgagagttattcaggatttatattcccaaggtttgacttaaacattgttctaaacgacttcctttacgagtacggagggagtaacaatctatccacttcttcattaactgtttcttagtattttgctagtgactcaatatgcactctttgcctatgtatatcctccctacctttgtagtaagtagtaactcgtaagaaccataatcttatgcagctcgccagttgaggaggagagagatcatgaagttgtccgtgatgtatttggtgaaagcgatgaagatggacctgctccatatcgtgatcaacatgaaattgatgaagattcccatgtgagatttttatgctcaagttacctaccattctaggcttaaagtaggaatatctttcgtcgggcttaaagaaaaccagcaaagattttcacggaaattctaaacagagccatttttttatacattctgcactgagcaagtacagtatgctaacgatgacttggtggcatgttgtttaaactgaatatcagcaaaagtattcatgtaattcaatatgtagagaattttgtgttttatcttcttttaaattcagagttaccatatgatgcttaactatgtaacaaatttactaatgcaggtagcatctttgctaattatgtatttatctaaaaatctaatctttctccctattcatttcttgtatgtaccctgcatgaatatagatctgtgctccagtcagtattgatcaactttcacacctaacttttttctggatgcaataggtactcaaaatttcctcctttcttttttagagatcacctatggaagatgaaggtcactatgagaaggatttgcagcctgaggatgtagtagctgatgaagatatgagatatgaatcagatgaaaatcgtgaattgaaaccaaaagagaaaccagttggtccaccgttgaacctggtggttccacttaagcagccgccagctcaaccggacagagtgagttgactacccctttcgaaccatatatctttcagtctttgaccatacagcactgttatcttttctgacaagatgattatatattggcagacatcagttatctttgatggatatttattgcgttgctgtatatacaccagatttttatttgtcattctttgtatctgttactgtttaattgctgatattttgtgcttgttcgtaaatgttgttgtgcagaactgcacaattgactggtgcagtacaatgtcagaaataaagaacctgtgctgctatgaactccatgcttgtacttattatgtgacgttggccctttagtagttgaaatttcttttttatgtcatggtattattgaagagaactttgctgtcatgttataggcttgactaggaatattaatgattggtgcttaaatattttgtgcttttgcagctattcatagatttttttgttactgactgatttcttaacttgtagatgaatgtgatcaaggtatcaaacattatggggattgacccgaagccttttgatcctaaaacatatgtggaggaggatgtatttgttacagatgaatctgggactaaaaaaaggatacgactggaggacaatattgtgcggtggagaaccgttaagaatgctaatggcactacatctgtaagtggaatgtttttcaagtagcattttgaaatcctttagcattacagactcagttatgctatgtcgccatcttctaagtttccctccctgaagatgctctgggcagcttcttaactttcttacaataatcagggttgtgaactagcctttagtgatgcttgcaccgagtcttctctcatagccaacttgcccaactgttattatgtattccctgcaaaagaatatatatgttattatacataccataagatgcttggtctgtttcattttcttcctccttttttttggtcattgcccttttaagtagtttgtgacaggtggtcggtgcactatgtggctatgcatatgataaatgagcattgttgcagtgtgaaagtaatgcgcgcattgtaaaatggaaagatggaacgatgcagctgctgattggtaatgaagttcttgatatatctgtacatgaagcacatcatgatcagtcccatctgtttctgaggaatgggaaggtaaagtacttcttatctgcaattcaacaatgttcgctaccacctctgttcattcatgctcttaccgcataggtctcactaacctgatataattttgaattgtaatgcagggagtccttcaatcacaaggaaggctcttacggaaaatgagattcatgccatcttccttgtcttcgaaatcacatcgtttattaactgctcttgttgattctcagaataagaaaactgttaagatgcaaaaatggatcgaatctaaggatcctgagaaagtgaagcaggaaaaagaaagggtaaccaaaaactccatttcttaattcattggatgtatatgcaacactgaatgacatgtgtatgacttacttttgtcccaatgctgcttctgatatggttcctatgtcaaaaacaacatgatttgtgttgtgttatactcactttccatttttttctataggggatagccattgggcttgacgtaacatgaacatttatattttttcccttatttctttagattataggagttggatgcatgtaatacttaatagagtagaataatcagcaagatagtcagaatgcaaacttcaaattaagtaaatataatttggtatctgaccatgagagatttgagcagatactgaatttgtaccagataactgacaaacaagtgaatatgagcataactggtaagctagtaccattaaggaaatgctactaaagtactaactaatgttgcaagctacaataatggtcttcttcatggaaatatgagcttcaaatttgattattcttgggcgcatagctagtcaggatcactatataaaataattgagaggacagttgatgcttttagagcaggataatcagcaagcaaatttagagcatgacaatcagcaagcaaattgtttttcttggatcacaaacatgtgataacatttttagctatagttggtaaattgacgattctccagtgtctaaaaacattacatgcaaatcttggcatgttgattgtaaatctcttgaatggtaaagagcaagattttcatcatatttatcctaaaaataaagatgtaatcattatgaaatcatttgaatgagttccacaatcttgttgctttctctgttttttttcttccttttatgatgagaggatgagttctaagatgtaagaaatttatgtcgtcattccaacaaatatcaatgtgatatcaggtcccattttccaacaatactgcaatttgtattcagcaaattctcttgtttgtgtgttttcatgtttttctccaatgcataagcaagcattaattagctcaatttctgtggcagttcaacacgcgttctagatcctgtgagtttcagctttgatttgagagtctaaaagttattgtaacatgatttgttcttactgctacgctgcatagcatttattgtggcttgctccagtgaacttttcacaaaaagtaaatcacatagggttaagtttccttttgtgaaggcgcaataaccaaatagttgacatgccgatttagtaaatgcatttaatcctgttccatgctttgctgtatttcctttctgttctaaacttgttatatatgcattttgaatgaagtttgtcccttttcaatatgcaggccttgggccaaaatattcgagcccattcaattcttcaacgcaaaaaagaaaaggttagccgcaagtacacacagcctgccaggcaaagaaggcagctttctcctggatttttggaagatgcattagatgaggtgggtttcttgtcatttctcttatttcttccgcttaaggtcattgatacaatcagttattgttgttcatacagttctagtattagtaataaatgatatttagtccagacgcatcctattaaatctcactagtaaatgccatttgaatgatcgccagtctttccaatttagctgtgcggccacttttggctgcaatataatgctggtaaagtgcaagaccctccacacctttttcttttctcgaacacgcaggagatctgtgtaggggcggtgcggcacaggggagtttagaaaaaatcccactccctaaacaccgtcatgtcttacaaaagaaccaaacaaaccgaatgacctagttaagtcgcaagggctatcgacctagcaaacaggtttcgaagctttgaaactccaggcaagcaccaaagtgcaccttcatttgctactgattggatcaccgctgccacatacagagttgcacactgccacaaacagttgttcctatgcttccaaatttccctccacatcttattaacactgcccactccttatttgattttagcaagtgatttaagttcaatttcactttccgacctaaagctgttgcatggtaaaaactctgttcagtgaaaactgaaatcctcttcagtcctacatgttatttacgcgatgatatccaaaattttcttgtctggttaattttatttccttttttgaaaccatgtaggctgctatcgtatgcccatggcacgtacacataaattgtttatctgtaatttcataggggcaatatggacttgtttaagcttactgtaaatggctcagatacatagaatcattatgttggcagtttgtttgtgtgagatttttttctatgcttagctggtttactcaactgtgagtgtaccttactgaatggttacatattcagattctgggtagatggttaattttattctgctgttgtagctcacatgatgtttttccttagagttagatacacgtgttcaatagctgtttttgtaggagtaaaatgtgctgtgatgatttgcaacttgtccttttggtgcattctggcaggagattggattcgacgtgacaattaataagactttagtactggttatgcccaataatttattcaatttcatttttggcaggacgaggaacctgaccatcaatatggttctcgccgaatgccagcacgtagtcgttttgaggatgaactggaggctgaagccctagctgagaggcgcatagttagtgcaaagaaggtgagcaactcatcagcatgtaacccttgttatttttaaccaatgtattgctgtttatacataatctgtattgtttgcacattttcagtcaagtatgggcagaaacattcctcgcaaaccatcatttcctgctcgtccgcctagacgacaggcaaatgaatattctgagagtgaaagggaggagtcagagtatgaaactgaaggagaggatattgagcactcaccaacccaggggagggaagatgagcttgatgaagaagatgaatatgaggaagatgtggaagaagaagcagccatgtcagatgaagaaattgaggtaagaccaatgtcatggcctcaaaactcttggttttctttttcacaagttagcaatgtgattatgtgaatatatgatacggatgaacattgtcgtaaggttcaaattttgcaagtcaggttttttcttggatatgcccaataaagacattaaggaattaaatacttttgcagcatatgtgaggacaagattttcaagaatcttgacagtaaccactaggaatatgaccaattttgatagtattttagtttacattgctgacattttgtagtttatgctcagtagttctgcaacagagtaattaacaggtcagcaggcagacttgctgctttgtttatgttgaagtgaaacaataggaaacagaaaaaatgtactcagttcatgtttgactacttctgcacactagttagcatataatagctgaaaggaatctacgattggttttttgttgtagtaatatagcaaacttgaaagaaaaacatgatgaggctagctgtatataaatcgaaactgaaagaggagcctctgctgcaggaaccaaaacggaggagagaatctgggggtggcagtgccagccaaaggcgcaaggagatcgactcggacgatgattctccaccaagaaaacagcaggcagttcatcgtcggaaggcggtcgtttttgacagtgatgacgaatgatgatgaagaaagagctggtttgcaaacaccaatgttggcatggcaccatattatttgcttgaggattattggttagtaataaccaaaaaagaaaaaaaa

SEQ ID NO: 13708 - DNA, 3939 bp, Oryza sativa
cctgcagccccaagaatgtggtagttgaagggcacaatgtactggaattatcctttttctttctctgtaagaacagtttcgtttctcctttttgaaaaatatagaaaagaacagttagtatcttgggagcagaaaaactctaagaatgaggcgtagaagagcccatggtaggccccatgatacaaggaacatgttggaggcccaaacaaaagtaagcccatcaaggtccagtgcggcccattatctatgtcctcgtcgatgccccacctataaaaggagattcattcgtaaaccctagagcttcgcttctccgcagccgccgccgccgccgccgcgttccaccacctaccacccccaccggagaagaagaagaaaaaggagaggaagatggtgtcgggttcggggctgtgcacgcggcgggtggtggtggacgcgcggcaccacatgctggggcggctggcgtcgctggtggcgaaggagctcctgaacgggcagcgggtggtggtggtgcggtgcgaggagatgtgcatctccggcgggctcgtccggcagaagatgaagtacctccggttcctccgcaagcggatgaacaccaagccctcccatggccccatccacttccgcgccccctcccgcatcttctggcgcaccgtccgcggcatgatcccccacaagaccccccgcggcgaggccgccctcgccaacctcaaggccttcgacggcgtcccccctccctacgaccgcaccaagcgcatggtcgtccccgacgccctcaagtacgctcgcttcgaaccctttcctctcctctcctctccttttcttttcctccatgaactaatccatggcttctagggttcttcgcctccagcccggccacaagtactgcctcctcggccagctctccaaggaggtcggctggaactaccacgacaccatcagggtacatttcctttctgtattcatattcacgctgcttttcgttttagcttgaatgcatatgctgctgtaatgcttttagttttaggttgaatgggacgcagattcagtgacattcccccgtgacattctcggtgacattgagtcactgatatgtgggacccacatgtgtttggacccacatgtcagtgactcaatgtcacgggggaatgtcaccgaatcacaatccggttgaatgcatatgatgtacacatgtgcccccttttacttttcggatgaatggatatgctaaatacatgtaggagtactattgaactgaacgtgttaggatgaatgcaatgctgaatacatgtgttggactgttaagaatagttcatcttggaatgttatggtattatgtgatcacttttgtgaatattgggcccttgtagctatttgattgtacaactgtacggtggtaacgcgttgaactcaaactcaacatgctctggatttgaatatgtaggtttttgctgagctacttttatgctgtacacctctctagcttttgttttacaccatagcctcaactgtctgagattagttgatgactctgatgatgcacgaaatcttaagtatcctatttatttatttgcacaaagatgatggaattcccataaacctgtgattacttatgctatggctgtgaatttgcaaatgcatctttttttttcttgtttgcatccccttttcaattgttacacagcatgtttttttttctaatccatgttgagttaaatagcatatttggcatgattggtaaaatgaagaaaaaatacatgtattctcactgatttttcagaatgatgtttacaaccagctacttctgaccaactgtgccatttctcacaacaaaatattctgtttgatacatttatctgctttgtttctgagtttgtgctattatttcaaccatgtcctgcatttctaggctgttatcatctcaattctggttgggctttttatgtttccctttagttcttatacatgaaagcacactgatcaccttgtctattgcacctgcaggaattggaggagaagagaaaggagaaggctaaggttgcatacgagaggaggaagcaattaacaaggcttcgtgtcaaggctgagaaagctgctgaggagaagctgggttctcagatagatattttggccccaatcaaatattgattggcctgattgtcatcaattttcttttcgcctttataatatttctgcttatcggtaccatgagaagtgaaatgatatgtctgtcgaaacatgataattttgttccaattgaatactagagagttatattggcttgatctgattttccctcttgaattttcaaccttgaactctcctaactggacaaatgacccctctggtttgttctgggttattttgatcctacttaacgagggagtaatttggcctgtgatttttaccctgtggttcggaactaattttctcattctttgcaatgatgtctgttaatattatgctcggctaggttccttctactacgttttatcccctagccctagcaccttcgcttgctcatttcttcctttctattcaccaattgtaccgtgtaattagctctgttgtgtatttttttaaaattgtttgtgcagaacaccagattatagactgtataatatagatagaatcaatactcctcctgaatattttaatgtcagacactttatgcctgaatattttaatgtcagacactttatgccaatgttagtattaattttctggagtaatggtattggaggtcataggaagtgtgtagtgtcgcacagatgcgcacatacttcagcggaaatatataaacccattctgataatcaacttcactcactaaacgttcaaaagaaagtgctcaaagaaagagtgaaactaaaattaagggttcgaatgcatacgcaccagcatcaaattaaacatagcattgttctagtgatgatcgactgaagctgcataataaaggggatcccagtccacaacgatttaagcatggaaagaaggtacttgaattttgagtacataataatattattattataataactgggctttgtggatacatatatggtgcattataaaacaagctaggggtacaccttcctattccatggcgtattacttaacttgggtcaactgatagatacactaaggtcctgtttagttatacggctgaaaagttttggcgtgtcacataggatatacggacacatgtttaaagtattaaacatagataataacaaaacaaattacagatgaatttattatgcataattaattcgtcattagtaaatatttattgtagcaccacattgtcaaatcatacagcaattaggcttaaaagatttgtctcacattttatacgcaatctgtgtaattagtttttttttgtctatatttaatactcaatgcatctgtccaaacattcgatgcaacaggatgaaaagtttttacgtggaacccgtgtctcttttcccgatgcttcaaccacgcaagcacattttatcttttgaaccaagccgtcgccttccatccttgcatatttggcaccagctgtgctcccaaacatgtactaccaacaaaacccgggacattcaactctataacatgtgggcccttatgtttctatgatatgtgggttcagtgataaataatttatcaccacttgtaagagtggcaaatagttaattattccgcaaaagccactccagcagcgacccacacattccttaggttgcaggcgccgatcttcttctgacggtcaagaattaggctacaatgcacatcagaagggagggaaaacaaggaggaatgcgatgttatcattacattacaatgatcaattgctgtggagataaactacatactacaataagaactaccgagtcattctagataattaagaagtacctctcggtgctttctctcaccaaatctcctttaacccagt

SEQ ID NO: 13709 - DNA, 14675 bp, Oryza sativa
ggatctttgcgtcagggatcacgctgctgtcttcttggcacatgcgcgatctctccgtcttcaggcattcgatgccggagcatatcatcttcaccagctgctgcccgctgctcatcactggatcccttgctgctactccagtgatgagtgtggtttccttctcaaacttgtcaaggagaagctcgttcaccgcctcgaacattagcttccggtgcgctctcttgggatcatctggctttgtggtgctcctgctctgatggatcccctcaggtttggatgtccacccagattttcgttgctcaagaacaaagaacaggtcagggttgatggggtagcctgatgtgtggagctgcatttgtgacagccctgaaccaaggtctttcatcagaagccctgacgccagtagaatctcggatacgtagcgatggtctgggcttggcgtctcgcacaagaaggcaatgtgatcgacaggaggtgcctcatccttgtttacgctcaattgctggagcttcttaaggaggctggctatgtttgcgagcttgctgttcttgggttgtgtggggagctctgtggacttcttttcagaaggcttgcaggactcttctgatggtgatgggtgatgctcatcatctgcaaatttcaagaaattaggtttcagtctttggaacacaatatcaataccactggtaacaatttcagtaaccagtccaccatgttaggttcatgcgttttctacttctctttttcagataatggaatgataatatcccagcagatgcatctaaagatgcataaagacaaaaactaaagcattcttgaactgatattcattccgcatccgtgtcaaatatagtacattaaatgctgcggcccttgtaattctccttgttctgttgtcaaaacaacatgtcgtgcagcaactaatcgctggtctgaaggcagattctttagcactccatactgatattgcaacattaatgaaattaagaatgtgcctaatgctactgcagaaaaaacgacaagcactctatcattgaaactctactgttcacattacttgggggttgcatacttgcattacgacatatcactttatctagcaagccatgtggataaattgtaaaggaactatgcatacaggagatcttttgattggtagtggtaggtgcaatcatagtacaccacagtaggatttttgtcaactctcagttatgttctttccctccttgaggaaatttcaaaaccctataactatggtgcataatgcacacaccattctatatgagaggaacactattggtagcaggagatctctatttgcttactatgtgcacgtgaacctcaacccactgccagcgttactacttgtcgaaaattaatatgaagaaacctaattatcgagtcatgtaaacatcagcagacatgagtcatgtaaacctttacacaagaagttccataaccaaccaactctggaaaactaagacatcaaagcaggaagtaattcaaaggacactccggaaaacctattcgagttcccattttcttttgaaaagtactaatactccactttatatgatcgatgaaccaagtagtatgaagcagcagatcttaccaacattagatgaatttgtggtcttgctggtatggaaaaattcctcctgatcaaacgaagagtccaatacagagactggactaggccgctcagtaatagttgctgcaggatccatagatggcaggtccttgtttgcatcataagaggttttctgaatttaagtttaaaaaaggtcataattagacaagagttatggtatgtttgtacgatttcaaatttccagcttgaacccaactagagttggacagatttcattttacagaagaactatgaccaaatattgtagctcttcctaaaatatatgtttttgctgttacaaaggtgaatatttttttagataataggaaggtgaaaattaggaagaataatactgtgtttttacattaataacatcatctatgaatatggatgaaagagccaactggaggaaggaaaattgtttaccactttttgaggattccttcctgatggtgtttgagtgccatgctgagatctcaaaatgttaacttctgcagatctgtctgtacttgtcacttctacatccagctctgatgcaacacttatgctaccatctgaccttgcggacatatcattgccttcctggttcaggctccttgtccttctacttacaccattttgatggaaatcttcaccttgtgcttgagcaggttttcttctaaatttacttctgggtgatactgaatccaaatggctcctttccacagattgcctttgattcttgcttgaatcgggagagggaattggcggtctggccctccgctctgaatcaggttttttctgttgtactctagggctagtggaatttttatgctttagcaagcttccattattttctctttgcatctgctgtctcctagctgagttctcagtcatcagctgtgaagtagacttctgtttcctgctaatttcttcattccttccatttgctctcttgtcaaaagaagcaaggtgttgaggtgtaggtgcccttgaactagatttggtatgttgctccacagcttccctagtgaccttctttgagcttttccttttatcagcactattggctgttctcagctgcggtagctctgataaaccgcctaatggaccaacagcggaatcctcggttacatcacttaacaggtctgcagattttgcaggcttcatgattacaatgggtgatttgaagcttctttctgtagtgctatcttcttccgttgtaaatgatggggttccttcaggtgcctgtttggtgttgctggtgctattcagtctcaggtttacatcagtcacatctccgttatcatggtctccatcatatatcttcggcatcgatggttcctcacgtttcttgttctgcaacaaccctttcgcttgcatcgagtccaggatctgcttgagtgccctgagatccttgttcgattgctgaaaatcaaggtccttgagccgtttctctatctcactgtaaactgatgcagcatgttgctcttttccatgagctccctttgatcccttcggcaattttctaggtagcacaatcttctcctgctgtttccaaggtgcagtttccacagggaacttagagttaggaacattcttgattgttgcatctagattcctctgctgcctaggagtagcctcattttgggaagaaaggctcaaaggcctcagcatggtgggttcttcactcctctctgtaactgatttggatacctgtgaagatatcgcagtattgtccttatgctctggcaagtcttccaaccccatgagtttcgcaacaacgctagggagacgtttacaggcattgtgttcttgctgggtctccaagggtggactgtaatctttactgatgctgcttctcctgtcttcatcagtcatgcttggctttggccttacgtcgatttcgcggttcctaagagggctttcctttatgtctagtgacaatcttggcacctccctaagttttgacgctgattcccttccttcacacgagaagcgaggagcatcatatgatagccttggttgctggactgattcagatggattcctgagcttggctaaaactcggagggattcgtcaatgtccatggttcctttgtttttctcttggatagcactgttaggaggctcattcaagattctaggcggatctccacaattgaataggtgatctttttctgcctctttggtgaaagttctgattgaaaaatcacgagtatctctatatattgaatcctttacgagatttcttataccaagagttgggtagctaggttgggctgagagcttggcaagggcatcatcaaggtagtaatccactccacagtcactgtcagaagagctcttgagcttcggtgagcttttgaatggcttctccggaaatagcattcgatcagtggaggataggtcttgctgtcctgatctgtttccatcaagggaggacgacgaagaacaagacgacgatgaataagatccttgcgacaactccactgttaatggtgctctttgattatcgatccagcttttactcatgttcttgtcctgaatgcagattgcagccagtcaaacagattgtagaagacaataaacaatgcatccatgcctattgaatgtaagaagaaatattgaaacttacaagaacaatctgagatgaatatcttgttcgctcttccccaacacttggactgcttgacagtgcatgggctgtttcagagaattgaaatattagaagggatcttccgattaaaaaaacatcttcaaatggctacaaattaaatgaaacaaagaaaaaacaaatatgtcaatgtcgtagttcatccaaacagccacatttctcggaaagaaccttcttgtaatttaataattagtgctgtcaacatttgtgagatagatttattatccaaaaccaggctcttaataatctgtctacagggtgtaatggctctctttctctctctctcttttgtcggctgctgcgaccaactcccagctatttagcactagtacagatttttttaaaaaaatcttagtagctgctaaagattccagagaaaaacttccatctcactctcacaaaaactaaatgcacctgtaaaatccggcacctggcccaaaattggggaaaaagctagatctcactaattgtcatcaacacctagcaattcaatgcaggatgaaggaacaccaggagcatgcatagcacccatccatacaaccctgacatgaagattttggaagcttctgagaccaagcaacttcactcatctttcacaccaattatgggtttataagccttcaattacacatatcaaacaccaaagaccaagtcttttatgcacacacaagtcaaatcaagactgatagtctactgattgtacagagaaatgcaaacaattaaaaaaatctcgatgtagcagaatgaacagaaaaggaaggtaaaaaaaaaattgcatctttgaaccgagcaatagcactaggagaagtgggggaagcaaagcaagcacctgggggaagaaggcgattgtgggaatggtgggcggcgaggggataccggcggtcgaacgcctgcaggatcccggtgacgcaccccgcctgctgccggtgaagctccggccgcctctcctccccgagcatctgcaagtacttggccggcatctcagcaaccaccaccgcctcaagaggaggagaaatcccaagaaattccaggaatgcagggaggtggagccaccaaccagtggcgcccttgctaccagctcaagcacaccaacaagaacatctcagcaaatcttctctgaatgaatgaaccagcccagagggaggggatcttgtgactgtgtgagcatcaggaacatcaatggcctcactggagaacaagtgtgagtgcaagaagctgctgcacaagcaccaagaacggccttcctcctcctccacctattcttcctcttcttgttgctgctcctgtgtgagactagtgtgacatggagtaactagcagacgacaaggaaggaaggaaggaagacttgtgatgtgaagctcagaaaaatgggtgagaaaggagaggagactttgaggccaggcagtgtacaggtttgcaagatgtcaccaccatatgagggaggaggactttgctccctttttctaatgcaatttagcataatgtgagtacattaactgccctgctgcacaagaaagacactggaaatgctgtattagcaggctaagtatgtatcaagcgcatcatcatcatcaggctaggaagggagatgttaagggtgggggcagaggggtgcttttgttctcttctcagcaccccatgtgctgttccaaggtctttcttggccctacccaccatcagagttggatggtgcctgtttgtgcacaacagcacaagctgcacaccacatcagcatctctttgtcattttggcattcaggcaagcaaaaggcctctgaagagttagttgtgctcaggtaaaagaaattctcctattgttcctaactggttggtgagatgatctcacagggtggccttacttacaaagattagctgtgtcattagtgtgcaaatgatctgttgtctgtacatgtaaaaccgcactgcacttttagtcaaggaggcattaatgtgagggagggaggaggagtgcaagggccaactaacaaacagtgcattgacggtgttcatccgtgagctcaagaccagatgcaattcttggctttgaagcatgtattggtgctttgccatgctgtgctgcaagactgctgcaaccatgcacagacctagagctacaggagtgatctcctctctgtacaccattttttcaacaagatgttaaggcatagggacatatggattatatggattcatggctaaatgaaatgactaagtaacccccatataatggtacaagaaatgtgactattagcctttcagttaggccactgttttaactgttgaatgttgatgacgaaaatggcttttattccacatttttagtgtttacctaacagaagaaactgctaataagcatgaacaacaatccaagaagcatttgctagaactttgcactggttttcatttttcagtggaagcgagaagccaaagaggatgtatgtatttgtcagttacctactccaatgtggatcttgtagctaattacaaatattggtgcctttttatgcttaaaatatttattagatcttgatgagaactaaatttgcctgatgggtgaaaggaacatgacacattgtgactcagtgatgagtatatttgacagtgtctccgactagggtgaaagaggcagaccaactcaaatgagtgatcattcatactagtatttctctgtcaggactactacaatctttcagtcgtctaaaatcattgatgaacagtgggtggaatgagatacctcatccatcttcatcaatcatatagaggacccctttagctaccaactaaatttgataacaagcgtgatatgatacgcaatgcaaaattactgctagtaattaatgtgcagttattgtacaaagaaaaggatttgcaagaagaacacacctcttctccttgcaccaaacacatgactgtcctgatcagacaccctcatgcgccaacctgcaatttgtttagatacctgtaacagctggtacagtcaggcaaacgtgattgtgaaagagccattactggctctggtaagcatgataaaataatgattaagaaattccctcagcagtaggcaagatctgatgtttgtctccatctttactttccagtggttttctatctttcctggcaggaatcatgatgtggcattcatttgattctatcacataaagttaaaaggcactcgctcaccctgtctggtagattattattctccaagtagtacatttcagtgtggactcctgcttcacttctactaaaatgtgatcttttgcttaatcaccacggcttgacaatgactaccaaacaggtgtaggttaatgtgggaaggtaataactaatcagatagggtaagaactttgcagaatgcctagagataagaatatatactagtatcatacaagtgaagatcattagtaattaggtttttggacaagaactgcagatgcaccaagcaacaccacatggggggaaaatgtaggtgtgcagtggcaaatagcaatagcaattagtagcaaaattatcaaggacaggacacaaggtgcccccctcaataatcaccaagcatgttcaatcaaacaaacaaaagacctgtctgcaaccagctaggctggcacatgatgaagcacagttctttctctctgcatcagaagcttcccccacccacatctacatccacatgcaccagcacccatgtgatccctaacaagaccagatcagtgttgttcatggtaggtcaggactcctcaaacagcttgattgattccttcgacacgctaatgctaattaacgaacaggcaagcagtgatcaattcttctagtattgtgaggccagtcaaaattgcagtatggtccaagcatatcatacctgtagttttttcataatcaatactgtatgtatataaatcaccagtgcacatgggagccatcgcattgaccagctagatcatcactaaattaatcaacatttagccaagatgcatcgagattgcagcaataccgttaaggacaggagagatggacactttgacatcctttggctcgtttagttatttggtgaaatcaagatgatagtagtatgcaatttaatagtctcacgaatttctttatatctgtgggtggtttcacttctcgatgcatcaaactatgcatttggccgtttgcaacggcatgtcttctccctcctttgcttggacgttgggtcatctataagatgcatatgacaaaacaaaaattaatctactatgctaagtattaaactaatcgtgctcttgctagccaagagaacagaaaaggcaatcacaaaagggaaaaagaaaaggcaaggttcacgcatgctgcatgagacgatgtgtacaattaacctcctgagcaaggaagaacacagagatatacagggcacctgcaaatctacaagagctttgtgcccttatcactgaaagtgatatgcttattgctacctctccagagaaagctgcatcacagtcttcatggtggtgtggtgtggtccatcatctcttgatgttgccattttcacaagtcatgcataaccatgagcagagcagcaattgaattggtgtgtttgataaatgcatttcatttcacagcatgcaggtccagtctgactgactggtatagtactatactgtagtatagtatgccagtatggccagatgtgtgtagacatatgccattgttggatgtaccactactagtacagtagtacaagaattcagcaaaatctagcaaagatgacaaaaggtctcccgagctagcaagtcatgcgtgtggcatttgcatcttgtctccttgtcaattgccatttatgaatatctcattgatgtgggtagtgaagtagtatccttgtaaacaatggatatgattttactgttttaccattggaatggcatctaggattattttccaagtaactcaagcaagaatagaacttcacacatgaatgacactaccaaagaaaagcaggaaatatcccacacttcagtgaaccatcagcaaactaattggtgtagaatagatatactgggagtttaactgagcttcctgaaccaaaggcgagatattcagagtaagaaaaaaataaaaaaaaaacatgaaaattctatagtcttaaaaattaaatttatacctatcaaagaagttcaactaagcacaaccaaatctgcacaaggcataacctaagtcaagattacaaataaatgggactaaatacaggttacttacttcatttgccctcattcatcacactcgctgacaagtggcaaagactattgatattgtcagaatagtcaggcaattgaagattttaggctgaatcaggtgggagctttttctccaggatggcaggatgtgctgctgccagtacagcggctgtgaccacacacacagacacactgcaccttgagcaagcacctcgtgactctgcaacctgcacttaacattaagcatacagactcatcaggcgcctcctgctgcattcattcatcactagtacaaagacaagcaatctacatgtaaacttacataccttcctgtcttcaattatgggttcttgctccatccatccaaggccaaacagctgcaagcatgtatcatgtatctgaggagttaaacatgcactatcaaacagtgtagataatgatttaggaagcatgaacagagacatgttttgatcctggagcgatgagttggcctgatggtccatacagcatcttggcgataattggtatccatgttttcaatgtctcacagaaagatatcaggttttgcatgaacctgcaaatcctgaggcacaattcctgctaatcaaatcgataaaaattaccatcatcacgatcaataggttcagaggttatcctttttgtcctgcacaaaaggtcactctcgaatattgctgaaaaggcctaccacagttggacgtttcagagcaacgtacaacttctttggacaaaccaatcacattcaaaatgataatattttgttctgttcctggccagaattgaggttaccagagagttcaatgattgttacaagattacagcactttgtgcaagggagaaaggttacagcttgaaacattcttacaagttacaacaaatagttcaccaaaattttccaatgggaactaacaattacaaccctgttacccttgatgccgggaaactaaatgattcagtgtacgtgcgactgaaatacaggcaaacaggtattacgttcttccatctcatcactagttcagaacaggaagggaccaaaacaacaagctatcaaaactgggcaattgccccattgtctaaggctctacggaactagtacaaaagtagctacaggtaggtgtgtcaagcgagcaaacagaaccaggggtcaaaaacttcatgcccatgcaaatgctcaatgcttagcagactgaaccaaacggggccatcaggcaaagggcttctccagtttatcaagtattttcacatagaaattccaatgtcgatcactctttgtaatggaaggttgaccgaatgggtgctcctgtacatagcgctgaacatcatctgcagtagcaaggttctccagatacacccgaagatctccacctggtcctgctcatggaaaattggcatcaacactaaccattttggagcaccaattataagaaataaatacttaaatagatcttgaaataatggagcatacccaatgaatcatctttcttgttaagatagctgtaggggtgaggaaaaatggcagtgtgtggctgcaaaatacatatatcaggagaagaataatgcgtgcgaattacaacaacttgatcttatcacaacagatataaattgcataggaacaggggtgaagtcagtaccggattgcccaaaaccttgtaaggggaatcatccacaagtaatgtatttgaaggtgaaaactcttcttgctcccatggaagatcaggatcctctttattccacagtttctttagctccttcagtactaatggtttgtttttgttttcaagagttttaaacccagtaccagtgcatttcgacatgtcctggcaaattatagtgtgtgcattaggacctgacttgcaaccaaagctacagaaaaagaaaagaaacaagagtactaaaacaaaaaaaaaatacagtagcataaaatttggagtttttcaacaaccacttggccttctttcaattactagctaggcagaaaccatgaatttagttgtaggctgtagcaactatgcatacttttctgcaacttacccaacagaataatagggactgtttcatatccttcttcataatgatatttacaaccgaatccacatttgctctgcagaataagaatgttgtcattaacaccatgcaagaaactctagcaaaaacaagagatgtaggggagaggaattagtacttcaatctcgatgaccatatccctagctcaaagttctcgaagcaaaatctcagaaaatcatcacagtagggtcttgtgaagactggcacacaaacgataagccattgcaaattagtatattgtatttgatatgttggtcctttatttacagagaacactagtatgtgtacaaatataattgtgtatcaagtattaaataagcaaccttacctaattttccccgaacctttgcatgtgacaggtgagcattgtggtggtcctgattgatatccgcaagcaaaccattaatatctagaataagaagttttttccttcgaaatcttatcaatgatcctcttggtgagtagatgtgccgaaaattctctttgtgtgcctgagctatatttgatctatcgctccttgcactttggcaatcggataagacagcttgaacttcacattcaccatccatcactccaaccgaagcagtctcacccaaatccatcctttgcaccgagggtgcctcaggaacacttgtttgatttctcttcatctttttgtttgatttcttgcattcagagcctagagaaatatttccatcagctgtcatcaccaatccaacctcgtcagcaacaggttgcgaaggattcttgcatttagagccaggagtattattcatgtcagctgttgccaccgagacaacctcaccagcaccaggtagcaaagaaggattctgcacattgctccttctattggcattttccttctttctcctccgcctatctctattctttctcctttttctttctatagaactctcatgcaacgagctgcagagctgggagttattatccttattccctttctttcctgccaccaaatcttcagcactgtttacctcaggacattttggttcttgcccatctctgggaatcgcaacaacatcagcatcttgtaatgcaccttccccacccctgcaaccacctccagattcattggccaaatctgtgtccatcacaacagcactggcatcagatacagcagaaggggattgcttcttttgtttttttgactttgatttcttcccttttggtgccgccccctccactgcagaagcctcaaagaaaatactgataagaatgattaattttttagacgcaatttgaactaagactacattcagaattcatgaggacatggtcagcaagttggtgaaatgcaattagaatcaaggcatcagggtgctgtgtagatgcaacatttttcttttgaaaaaaatgtgtgcagatggtatatcagttcatgaaagaactctgaactcacaaaggctcgttaaatcaatggcatcagaggcaagaaatcaagaattggactctcaaatagccgcttaaccctaggtggccatcagcaaaagccctgggcacgcgcacagctgttgcaacctacagcaaggggggaacggtccatacctgaagcagaggcgccaggagcctcctgctcatccacctccttatccccctccggaaccgcaagcgtggagatggcaccgccacgccgctgtttcaatgtcttgctctttcccggcgttcgatccatttctggtgttggatcatgcccactactcgcaacaacatcatcagctcgtaatgcgccttccccactcgtgcaaccatttccaggttcattagacaaatctgtatccgtcacaacagcactggcatcggatacagcagaaggagattcctgctgcttatgcttcttccgtttcttgtcctttgatttcgtcccctttcgtgtcccctttcgtgtcccctccactgcagaaaattcaaagcaaatacgagaagcatgattaattctttctcaacgcaattaaaaccaataccttactcagaatttcaacatgtggagttgacgaaatgcaatttgaactatggaatcaggacgttatgcaaatgcagtatttttcttttgaaagaaatctgtacaatgcagtatcagttgaagaattgtactttcaaaggctcgtcgaatcaatggcatcagagggaagaaatcaagaattgggccctcaaatggccatgcatcgataagccctaatcctaggtgtcaaggccctagacttaggcaaaacccctaggcatgagcacagcttttacgacctacagcgaggaggatatggtccgaacctgaagagaagcagcaggagcctcccgctcgtccatctcctctgcctccggcgctgctgctgtggacgtggtggcatcgcattgccgtttcgacgccttgctcttccccagcgttcgatccacatccggtgttagatcattgccacttctggaactcgcaacatcagcatctcgtaatacaccttccccatgcgtgcaaccgtttccagattcattggccaaatctgtatccgtcacgacagcactggcatcggatacagcagatggggaaccctgctgcttatgcttctttcgtttcttgtcctttgatttcttccccttttgcgtcccctccactgcagaagtgtcaaagcaaatactgataagcacgattactgcttgctcaatgcaattcgaacaaatatccctattgagagtgtcattagggtgtgatgcgcaagtaggcgaaatgcaattagaattatggcatcagggcaatgtggaaatgaagtacttttttataggtgcaaatgcaatatcagttcaagaattgagctcgcaaagggttcatggaatcaatggcatgacaggaaagagatcaagaactgcgctctcaaatggatgcgcgtggttaaacctaggctgtaacaataggcaaaagccccaggcatactcacagccatagcaacctacagcgaggatgagatggtccgtacctgaagcagatgcagcaggagcctcccgcttgtccaccttctctgcctctagcgccggcgctgtggaggtggtggcaccttccccgctcgtgcaaccatttccagattcatcaggcaaat

SEQ ID NO: 13710 - DNA, 24185 bp, Oryza sativa
  unsure (1)..(24185): unsure at all n locations
ttcctgcagcccagaaggataaagataggatgaaaattcttaatcctagtactcgatagattttaacagtgtatatatacggaatttttttaatttgtgaaagtcacattccataaaacattttttagaaaaaaaaaagaaagcttggtgaatgtctttttaataagccaacaatgaataagtttttatggaactttaagggaattaaaatattttttataaattatttgtagagtaattgttacagtctaaatgcgctctatgttaaatacatagtatccgcgccgcctccaatttagccatactttaatgcatattggttagcttattttgcataaatggttgatcagccaaagcatttggctatccgatgaggccctgtaaatatacgtagtgcagagtaggcaaagagtttaatgttggttgtttcatagccattcgagttcaaggacaccccggtcagatcttcacgctaactttccaatcgctggttcttcctgcttgcgactatgttgcttttgcttccccggttctgatcgcttgcgcgcacgagagatcggaacaagcaaggcctctggaaccacaccttcgcctgagatctgcaccgggtaggcgggtgatcaggtttttggggagtgcttccgcacgactggtcctcttcctctgttgttcgccgtccgttcgtttgcatcaccatgactgctggagatggcacaaacggacctacagctggcacaccgatcgacaacaccaacggaggcagttctgcatcacaatccagcggagggactttcacagggtataactttctaccgctatctttgtttgtgttccttatgttagtcgcaataatattgcgttctctccgtgaagatgatgcttattctattctaagcatgctcctggttatgtttaattttatcactagatcatcttacattgttcataccaatatgctattgccgatatatgtctgtatttccaacagtatccgcgctgcctctaattcagctatactttaatgcatattggttagcttattttgcataaatggttgagcagccaaagcatttggctatccgatgaggccctataaatatacgtagtgcagagtaggcaaagagattaatgttagttgtttcatagccattcgagttcgaggatacacggagagtcgatcatgtcagcttcagagaagagcagcaagaagcaaaaaatgctgagaaaagaaaaacaaatgaaatggacataaaaagcagaactgatgcagaaaatgctgagaaatggcaacagaagaaaaaaagaacgccgttgccggggatcgaacccggatcacccgcgtgacaggcgggaatactcaccactatactacaacgaccttgcttgctttctttttatgtttctttttaaagatgttaaaagtgtccaactaaattaggtacagcatgggggaaaagccgctaccatctttaatatgtgaggattacattttataaaactatcattaaactaaaaatttaaagtatcatatcacaaaattgtagatttactgataaagctatcaaaaactacatatcttaactctattgctttttaaaagttacaaaatctgcaattttgtgataaaattgataaatttgtagttttatgatgagatgcctcaaatctatagttttataaaaatatggtgctaaatttgtagtttttttaattaatacacatccttatatatatatatatatatatatatatatatatatatatatatatatatatatatatatatatatatatatatatatataaaatctttcacaacgaggtcagcctacctagcacaattcgatgatcaagaagctgacgcagtggtcaaaacaaatttagaagacctgggctccatcaaaatacaaaatgtttacatggttacttaattatgaaaaataggatcgggatatctgaccgactataacgaagagagtagctgaaaaatattacttctctcagctttgccatcgcttcaagaactgcccagcatcacaagaaaatatatggcaagcagtggcgccaaaactgcacaatgatcaagttaacactaaccattacgccaatgataccttgcttgagcaatgacagatgcacagtgcacacgccaggacagcaggggaaagtcaaaagcattgtgaggatgacaccaatcctggtggcttgggaaatttgaagcgaatgcaacaggataatcttcagcaagaaacaaatagaggcgtctgaaattgctggcggaataacagaagaaattatcactagggctatgtgtgacaatattggattgaggtggtgtttgggtccagggactaaactttagtccatgtcatatcggatgaatttggagtattaaacatagactaaatataaaactaattacataaataagagctaattcgcgtgacaaattttttaagcctaattaatctataattagcacatgtttaatgtagcatcacataagctaatcatggattaattaggttcaatagattcgtctcgcgaattagtccaagattatggatgggttttattaataatctacgtttaatatttataattagtgtccaaacatccgatgtgatagggacttgacctaaacttttaagtccctatcattccaattccattcgtgatacgtgcgagcgaactcattcctctgtgatagcaaagcaagcagagtactccagatttactttcactttactctttttctttaattctgttggaaaggaaaaaaaaagacttattccatataaactgtgtaagttagaagcatgtcgatcgtggatcgctagatcaaatgcacactatatatatatactgctgctaccattcattcagcaattaacaaattattgcagcagcaagtcaagtgtgtactgcatccacgacacatatgcattatcgatcgtagcacaggtgcgacatttcaatcactcaacctctaattattccttcctattgagtagctttgctatatagctcgcataactctcttaaagatatattcattcgtttcttgcatattttctaaatagctaatgtacaaaaagtttaagaaaaaaataacaagataaattaatgtataacatatcagcttcataaacataaaaattcaacttcggcttttactgttgcaaataaattaagctgatgtagctcgtatgtgtatatttatagtcatatttaatttgtttgttttgtgcaaattatataaattaaatttaaatttgtatgtttgtgtgataatatatcacatattaatctatctcatcaagtttttatagtttcttttataagtatttagacgacacgaaaaaaatatagtagtttcctgcgtatgtatgttgttgggaataaatcccatgttagttaattaaggggagttaaaccaacttaaatataaaaggagtccctcacctcttgccttttttttaacaaattagtccttttcagcgctaaaaatattggcgctaagctctaatccgagatggcatgaattcgctgagttatcgtagctcagcaccaaataacttggcgctgaggtcccgacgagttaaattaatgcggagggatttctagcaatgtccgactgatagcacaatggttgtagagttctactctaatctaggattaagcagggtttgattcccatctgtcctattttttttctttttagttttcctttttcttctctctctcactctttattaatatgttttttttttatttttgttctctcgttttatttttctatctttatttttctttttttttctcgtaatactatcttcaaaatatattttttttgaatttagaaaaaaaaatattaaagtggcatattatatagcaaatgagaacttaaactgaaattccaaatcaaattcaaaataaaacaaattatagaaatttgaaaagaataagagtaagtagtcaagagaacaaaacttattttgtaaaacatattaattctaaaagaatgctaggaggaagagaaaacatattaattctaaaagaatgctaggaggaagagaaaaggaaaaaacccaaaaatacaaaagaaaataggagaggagggataccaggattccaacctagcaccctagggctcacagcctaagccatcaaccacctgctataacggttttgcttccatatgttgcctgcgcaactatttaaatcgtcgcgatttatttggcgctgagctatgatgactcagcaaattcgtgccaccttggattagagcttagcgccaataaagttggcgctgacacgttatatctcagcgccaaggtctatggcgctaagtccacggcctatttttttgttgaagtttttttctgggactagtttcgaaataagtttttgaaaataatcaatttgttaaaaaaaaggcacctcttgagctagtttttttaaggtgtagtaaggcttcctccagattttttttggggcaaacatatgtatgtgcacaacaatcaataatgccaataattaatgcaggtgtgttcttccgttcttctcttgtttaccatataagggcatgtacaaaggtagagtcagatataagctctagttatctagagactagcatcctacaacagttataaataaaatggtctctaatcattaatgtatccaaatacgttttcttacttttctttcctttctttcaccaccatgcaacaaaatttgctctaataaattctaagagtcgactctgagccgttgtcatgaataacaaccatactcctttctctttcatccatgtcatcaaatttacttgcatggtaatagagagaccactaataaacaccgttgtacatgccctaagagtatatactcccatccataatcatgaattcatgatatctgtcttagttaatttaatttaatttatgttgggtggacgtggatgcgcatgatgagcgctataggcagctgagcacaagatcgatcgatcgatcgaaataattaaaaggaaggaagggatctagtggccggtggatgggtttcaatccgccggtgccgcagaaggacagcgagtgggagatccgggtggctgtgctgctcagcctcctccttcaggtcatcctcatcttcgtggggcccatgcgcaagcgcacctcccaccctgtcccgtgcttcgccatctgggcatgctacctcctcgccgactgggtcgccgacctcgccctcggcctcctcctcaacaacctcggcaacatcggcagcagcagcagccacctctctgccggtgccggcggcggcccgcccatcttcgccttctggacgccgttcctcctgctccacctgggcggccccgacaccatgaccgcctactccgtcgacgacaacgagctctggcgccgccacctcattggcttgctcttcgagctcttctccgccttggtcgtcttctcctgctccatcaggagcaaccccatgatcccggccaccgccctcatcttcgtcgtcggcgtcatcaagtacggcgagcgcacctactcgctctactccggcagtgtggacggtgtcatcgccaaaatcttccgggcccctgatcctggccctaactacgccaagctcatgaccgtgtttggcggcaagcggaatggcggccttctcgtcgagatcaccattgccaacggcgaggccagcaaggccaaggaggtgttgcagcagggcagtgaggttcggctggtggagacgaccaaaagcctggaggcaatagcgtacgagttcttcaccatgttccgggtgctgtacgtcgacatcaacctcagctacaaggagaggaggatcagccaggcctacttcctggaccgccgcgacatgacggcggacaaggcgttcgaggtgatggagatagagctcaactacctctacgacatggtgtacaccaaggcgcccgtgtcccacagctcggcaggctgcgtcctccgcttcatctgcaccacctgcctcgtcgtcgccatcgtcctcttcgtgctcctggacaagaccggcatcctccccgtggaccgtggcatcacctacgcgctgctgctcggcgggctggcgctcgacgtggccgccatcctcatgctcctctgctccaaccggatgatcgtcttcctcgaagccaagcacatggcgtggctttcccgggtggccagggccgtgcggctgcagccaaggcggtggtcggagcggacctcgcagctgaacttcatctgctactgcctaggcaagcccaaggagcaggagggtcgccgccgccagtgctgcaggcggaagacgatcccgccgagtgtgatgcggttcctcatctgggtcgccaacaaggtgggcgtcagggagaccttggacgacttcttctttatccagcgcaagccggtgacgatggtgagcgtcatcgggaggcggggacgatggtgcaactgcaaggagggngatgagagggcgccgacgaccatcgatgcccttgcgtatgtcttcgttggtctccagagggaggccataaaattcagggactccgaggactactacttgaagaagctgcgcggctaccgcggcgaggggaccctattggatgacgagggcctcttccgaaacatcaagatggagctgaccaaggcaacacgagaggagctcaaccttaggcttacggaggaggagagctcgagctcaacaaccaagaagaaggaggccgaggagattacacatgacgtcctgcagctggccgacaagaagaagaaggagatagacgacttggtgaaggagaagctggatggcgtcctgcggaacagcatcgggagggagttcgacgagtcgctgctgctatggcacatcgccactgacctatgctgtcaccgagagcgggaagggcctcggatgctcgacaccatcggcttgatgtccatcagcgagaccctgtcggagtacatgctctacctcctcgtcaggcaaccggagatgctgtcggccaccgccggcatcggcctactccgctaccgggacacgtgcgccgaggcgcgccgcttcttcaagtcggcggaggcgtgggaccccaaccacgacgacgcccgccggatgctgctttccgtcaacacgtccaagaagccggccgatgtgaagggcgaccggagcaagtcggtgctgttcgacgcctgcatcctggccaaggtgctccgggagctggacgacgacaccatgtggagggtggtggccggagtgtggagggagatgctgacttacgcggccggcaagtgccaggggagcacacacgtgcgccagctcagccgtggcggcgagctcatcaccatggcatggttcctcatggcgcacatggggataggcgacgtgtatcggatcggcgagctggccggtgactccaaggccaagctcatcatccatgatcaatagctagctagccatactcaatagctcatcgacgtccaatcttcaccaagaaataatatagacacgtacctcaaattgctagcagaataagagcataaattattaattactagggcaatgtgcggagcaaaagatttagcgagaatattgagctgattaagactattggtactatgcatagtacgtgttttccttaagtgtaaatattgctgcctgcccctacttaatatagcaccagcaattgttgtcttggattcaaaaaaaaagtatatgtagttttgtgaaagattgaataaagtatgagtagtttgtgaaatttactcataaattcactagggctatgtgtgtggagcgaaagatttagcgagaatataatattggattgattgagacagttggccgcgctatccaagcatagtgcagctcaccttggtattatagtgttttccttgagtttctgcctacaagccttgcttgcactttaatttgtaatatattgctgcccctatttaatatagcaccagcaattgttagcttggattaaaaatatatatatatatatatatgtagttttgtgaaagattgattaaagtatatatatatatatatatatatatatatatatatatatatatatgtagtttgtgaaatttactcatatataattaagttattaaattatttgtgtttttctatgtttaaatggagcttgttaattagtttataaagtgatgtatgacaccaaaatatatgtggtcaaatgtttgtctattttgttttcaaaaatattttgatggcgtgcatgaaaacagagccctagctcaagcctctgaaaaggggtggcacaacattttgtagcgaacacgattgaatagcatctgtgtggtgtactcaactatgtaggccaaaaaagaaagacatctcaaacaaaaagtgaaaaaaaagactgaagcaaccaaaaggtacttcctccgtttcaggttaattatgagatgttttaactttggtcaacgtcaaactgcttcaagttttactatagacaatttaagtaatatttacattaccaaattacttttattaaattagtaattaaatatattttttataataaatttatcttaagtcaaaaagattactatttttttttctataaacttggttaaatttgaagcagtttgacttctttgaccaaagtcaaaaatatcttatattataacctgaaacggtgggagtacttacgtaggcctctctgtgatgtgagtgtgatatgcaaattagcctacgtacgtgcgacatgcataacatacacgcattgcatttgcatgcatgctacatagctatcgcttgcatttcactccacgaatgagtatatttcctgtgcaaaagagtacttgaagttataccttacgaatgggtaacaaagacaattactgagtcacatatcaatgcacaagcaaacaatatcaaatttaattaacatagagagaaaaaacataataaatcattctttttcaaaacatagtacaagtattaattatgcactcctatacacttacgcacacccactaatataatataaacatacacgtacaccatacacctccgaagaccttcgatatatctgagatagataaaatcatcaacacaagtgtcgacgtttgatgtcgcgattccggtatttacatagtatggggatcgttggtactaggatatacgcgggactgaggtaaaagagacggaggcgaggatttttatacatgttcgggccactgaattgtcgggtaataaccctacatcctgttggccgaagccggtcgttgctcttattcaccataatcacacaagtacaatatttagggtagcctatctaactattgtcgacatagcggtctgaaggtctgactcgtagtcgacaacagggtagtcttcctcctcgagttcgtgcccgacgagatcagagatagtgctttcatctctcctgacagtatccggagacaccgtaggggactagccgtgcctatctctgaagtcgatatccggcgtcttgtcttggcgtatgtaggcttgtattggcttatggctttgtggcatctatgttgtccgtagattgtggtgggtgttgattgtattggttctccccctctcctcctaggggccttgtatttatacccatagatgtcctcttgtccaagtagaactagggaaaccaatatggatacaatccgagtagtccttgtcgttttcatgtataactctggttgtctttccttatccggaactcatcctatatccgcagtttgtttccatataggacatggtatgtggtgggtcctgccgagatttagtcaactactattaggtatgtggtatccataaccctgacagtagcccccgacttcaatgcaaatgaacaaattcatattctcaaccgcagaccttggagtaactgttatcgagctcacgtgaccgttctcggtgagttcagagataacgttagacttcctttattagcctcgtgcgggcacctaaagggtttgtctgagtcaaatctccgtcgtcaaccaaaaaagtatagagcatacgactaagtctcccatcttgctgtaatcgagaatttagattgaagtcaagaaattttatctcggcgggtacaccatctcttcattccgtaatccttgtcgagatccactaaccgttctcgagtgatcgagaaggcgcagaatctgcgacggagccttgtcaacatttgttgtactcgccttagtcgatcttggtgtagaaccatagagacatgaagtcttcaacaatgtcgaatagaattttcctgaaatcaatactcagaaaaaaatattagatagaaatagcccccgagcgaatgctcaaagggtgacatgttataatatgtatgaaaaattgaaaatgaattaaacttacagaccaatgttttgtatatgagcgtcttctcttttaccgacttcgatcagtcagtttgttgagtcatacactctccttagcccctagccttgtcgtcggagaatcgttctcggaggataaggctcttagaccttcgacctgcctcggttgaataagcactgatcctaacccccagccgtgaagttggaaagtccatttccaattacacggcttggttaatacgcatggcgagaactcttacacgaccagatcttacatggtctttcgtctctacaggatccgacaaggccttatccgctctgggcgtccccagccgaagttcccttaggttcctcaaaggccttgtcaggacggcgtaaagggacatgaggatatgtttcaactataggtgccgtcgtggtaagggatctctgggtaaaacacttggcgatattgtgtaccagataccaactttgttgaggtacaggtagtgggagaatcgctgcacctctggtcaaggactaggtagtagtcataactcgatcacttgaagtagaaatagtgggagattgctacggtttactggttcgagaaccaacgcgtagaattatctctcgagcaccaacggaagtcacggtgtgagggattgctacgggtttgctggttcgaggaccagcgcgtagaattatctctctagcaccaacggaagtcgcggtgtgagggattgctacaggtttgctggttcgaggaccagcgcgtagaattatctctcgagcaccaacggaagtcgcggtgtgagggattgctacgggtttgctggttcgaggaccagcgcgtagaattatctctcgagcaccaacggaagtcgcggtgtgagagattgctacgggtttgctggttcgagaaccagcgcgtagaattatctctcgagcaccaatggaagtcgcggtgtgagagattgctacgggtttacgggtttactggttcgaggaccagcacgtagaattatccctctagcaccaatggaagtcgcggtgtgagagattgctacgggtttgctggttcgaggaccagcgcgtagaattatctttctagcaccaatggaagtcgcggtgtgagagattgctacgggtttgctggtttggggaccagcgcgtagaattatctctcgagcaccaatggaagttgctagagttggtttattacatgtgtatctcatgtggccagcatgactcacatacccaactcgtagcatatccggatgtccgtccgcgatcatgtcgggtgatcaagccgacatcgttcgcgagcaattatcctttaacagccttttcccgagtagtccagccatggccggtgctatgagataggttgtcggtcttcgttggtaggttgggagcgacgactatgcatttgtcaagaacgttctcgacaatacggtgtactcgaccacatcctactcgagtgctcaattgttcctgaaaaatattgtctagaaggcaagacatatagcagataatatcgagtatgtactcaaaaaactgcatggatcttctagtactatctggatgtaacgagcagatgtaaatatcaggcattatatagaccggaaacaagcatgatttatacagaagaaaatagagcgagcccccagtgttagaccgtagtcgatttaacatcggggacactcgcgcaacagatattgtataaaaaaacatgctctaggtaaacataacagattatagatctgacaattctgtatgatctgaataggtacgataaattgcatataaaatattgcgtacctttgtagatacataccggatgtatctacgaaattagtagattaatttaaaaaaacaatctaccaattaccttgtagcgtactcgttcgacatcacatgatctgacatcttttggtacgccgcgtatcttgaggctcggtcgatctcgagagatcgagttgttgatgacgatggttccgatctcgtcgagagacatccccacggcgaagttgtcgagtagcttattgtcggagaatccatcttttgaacccatcttgtcaaaatcctgaagcaccaaaatccccctacctggcacgccactgtcgacgtttgatgtcgcaattccggtatttgcatagtatggggatcgttggtactaggatatacgcgagactgaggtaaaagagacggaggcgaggatttttatacatgttcgggccactgaattgtcaggtaataaccctatatcctgttggccgaagccggtcgttgctcttattcaccataatcacacaagtacaatatttgaggtagcctatctaactgttgtcgacatggcggtctgaaggtctgactcgtagtcgacaacagggtagtcttcctcctcgagttcgtgcccgacgagatcagagatagtgctttcgtctctcctgacagtatccgaagacaccataggagactagccgtgcctatctctgaagtcgatatccagcgtcttgtcttggcgtatgtaggcttgtattggcttacggctttgtggcatctatgttgtccgtagattggggtgggtgttgattgtattggggcttccccttttcttcctaggggccttgtatttatacccataaatgtcctcttgtccaagtagaagtagggaaaccaatatggatacaatccgagtagtctttgtcgttttcatgtagaactctggttgtctttctttatccggaactcatcctatatccgcaggttgtttccgtataggacatggtacgtggtgggtcctgccgagatttagtcaactactattaggtatgtggtatccataactctgacaacaagtatctcatagtcgacagatccaagtctaccacttacaaaataattagccgtaaatatgatcacacctataaatccaatatttagatcacatccgtacaacaaataaggatgcattctcaaaggctcgaattctaattaaaaaaaattgaaggtagaggcgtccctacattttttaagaataaattgcaagcgtgttggggattgaacatggaatgaaaccgcacacaaattccaattccattcgtggccaggctcgacggcaacggcccacgggatctagagttggcgacccacctcttcgtcgacctccgtccaccctcccgccggcgatggaggatggacacgacaatggcttcgtggagctcgattttcatttctttttcaaaatctggatccgatttctattttttttaatccaaaaaatgttttcactggcggttgtctttatcttgccgcggttatcttagcatgcctcctgttaaactcgattttcgctagcagctagctggccgctagtaaaaaaacattattttcactggcctttggtcattggcggtgccgttggccgctagtgaaaatccattttagccgtcagcgaaaatgattttttagtattgggtgagaaaatatctgtttgggtgtgagcatgagctcaccgatttttaaaatattgtgtcacgtaagattaaaaccactttgattgaaaagggggtaattcgtctggtttgaagagtttaatttaaggtgtaacatgtttggtatttgtattgaaaggggtattttaggctgttgtttgcttaagacaagtatcatcatgttgtttgcttactagatgtttatcttttgaggaggacatgtgcatggctgtcgatccaacgatcatcaaattcaaaagtcataagcatgatggtttcaaagggtcttgtcaacatggatcaacctttaagagcactcatagtggctagaccatctgacagctgctgcatgccctttaccgagcagggaatccatccaacttcgattctcatgtgctccttgccttttgctgctagctactccctccgtccaatatatctctagtcgtaggttgctatattctgggacggagggagtatctatctctctcatccgtcctaagaggatatcacagatagatcgatgagcattcaagtttacaacggataagtctgttatccaaagtacatactctccccgtctaaaaaaaagacaaaccctgagtttccgtgtccaacgtttgaccgtccgttttatttgaaaaaattatgaaaaaaaattaaaaagacaagtcacgcataaaatattaatcatattttatcatgtaacaacaatgaaaatactaattataaaaaatttcatataagacggacagtcaaatgttggacacggaaacctatgatttatctttttttttaacggagggagtatatatgctgttttgatctgttcgcgatgaaaatactacttatgatgctgaaagaattacatgtttccctagtcatgtttgttgtcctggtcgtgatataaaagacaagtaagagaaaaaaaagttccttacatacgtaaccatgcattgatacatgtcattggatttcttctatattaattcctaagaaggaagaagataagggagggtgaaagaaagaagatgaacttgatggggtgggtctcatgtatagatggtaaaaaaaaatgaaaaacgtgacggcgatgatatgggtttaattttgcaaattttgatatttatctgaatagttatatttgcaatgatacggatcaaattaaccaattaacaaaaggagagaaaaggtcgtccaaaacctccgttaaaatagtccgacaacaccaccaccattaactaaaggagagggcaaagtcgtccataaccttcgctacaatagtccaacaataggtattgtcaacaaccgtatagagcatttcaactacaagtattatagaactagagtgagttctgaagatgttacaaaattgctatgttttgacttcttttttcagcccttgattaaagctaatttttttttacagttatacttccatatgcaaaatccgattaagcaccctttgatcaatgttgcttaggtatgaccatacttactacttccatatccaaaatatatgatataccgttcgactttattaaaggacgataatcctaccatatgaattttatgttttgcaaactaaatattgatgaataatgttttaaaattttgacataataaagtcaacaacaccatatatttgaatacggaggaagtatttacaatgtcatatactcctatttatgaacgatgacagtatttttactacaaaaggagtgacatataacatattttcctctgtttcaattgacaagctggtgtgcaagttgcatagtgggagccaaaatatattcgcgtgtcccctgtgtgtagagatatggcatgaataatgagcgaaaggaatgtatatatagttggtggtacggtgtacgtaggtagggatcgatcgtgtccattgctggaatataatctcattatcaatcaactcgaggttcttcttcttcttttttttttacacatctcgatcccgattctgcggtgagctatatatattttttcacttgcgtggattacaaattattattcttccttcttcaattatccacggtccatgcgtgcgtacgtatacggccataattatgtactcccttcgtattttaatgtacgacgccgttgactattttaacaaacgtttgacctttcgttttattaaaaaaaaattatgtaattatatttattttattgtgacttgatttatcatgaaatgttctttacgcatgacataagtatttttatatttatataaaatttttgaataagacgagtggtcaaacgttggttaaaaagtcaacggcgtcatatattaaaatatggagggagtatcagctaagtacatataattaattaattagtacgtatatttgtacctatgtgtttgacttattagactggcttggtagagtatagtgcgcaagtttggcgaggaaattttcctggttattaattaggggaaccaaacctattcccttggccctaattggacctactagctagcaaacatatccgcgtacaaattaaatatccgagagaatggtttttttttctctctctcccgatatgtcagtgtcaagagaagagttatagacgtacaaagcatctaattaatttcccgataaatgttaaggggaaattaacaaaagccgcaccattgatcttgagcagtgttgtctttatcaagagagatacacacaagtacgtcaagctagcaaagatacctaattgagaaatgccatacggccataccgtaccattgatcctgagagttctgtcttcatccctaaatatttgacaccattagtttttttaaacatgtttgaccattcgtcttattccaaaacttttgtgaatatatattattaaaaacttgagtagtgtagtatatttaataataaattaaatgataggaaagaaaattaataattacttaaattttttaaataagatgaatgattaaatatgtttaaaaatttcaacgacgttaaatatttagagacggagggagtacgcagcgaagatcttgaatagtcctaattaactagtcactttcattgcagaattaacggaagggaaaggatatgcggaactgcagacagagaattttacacaaaacacctttttctgaaattgtatcgatagagatgctcatatacacgtgcaagcactataattatctgtcaatgtatacccgctagcttatcctaaatatacacctttaaaaatcttattcgtccaacatattttgagatcgatggaattattacaaattgccttggcttgtacttgaagtgattaggtaaactttttgtccaaaacaacaacaataattagagaactagctagtacacccatccaaaaggagagcgacactattattgcccatgaacacaaaatgaatatatggacgatgtcattttccaaagttgtgagttttttccatggcatatattgaagcgatgtcccatcgtctcgtggtggtattttaatttcaagctcgatgagatatattattggattaatgcgattattacatccacttttttctcctaaaaagggcaaatctttttgaaagatttaaagcaaacatatatattgaagttgattaatttcgtacagctagtctagctaagcatctgctatatatcattttgtcctaacaagcgaataactgaagagatgtgctagtgcactatacatatgatgtccttttctattctgtacaagattctgtttctaccttgggctttctctaaaaagccggatcaaagaaatgatatactccaagggtattgctagctctgtattgagagattatattgctcatgtaaatatatcctcgtgttgtttttctctttttcttacagctatttttctgccttgtaactccaatgattggatctaaggccttgtttagttaggaaaaattttagagtttcgttgtcacatcggatatacggatacacatttaaagtattaaatatagtctaataacaaaataaattacagattccgtcaggaaactactagacgaatgtattaagcctaattaatatgtcattagcaaatatttactgtaacaccacattgtcaaatcatggcgcaattaattttagaagatttgtctcgcaatttacatgcaaatttatgtaagtgggttttttcctacatttaataccctatacatgtgtccaaacattcgatacgtcagcgtgaattttttttaactaaacagggcctaataaaaaacagaaaaaaaaagggaggaaaaaaaaacaaaaccgttgcatcaagagtgaagagccctatagtgctagttgtggatggagtcgacagagtacactagcggtagttggctttgttggctccatttactacaactagtcttccaataggccaatgtatatatgcagacaaaagaagctgtggtgggccggctagctactcatcatcatagacaacacatccataaataagctacagtagtgcgttatggtctccacctgtgactgatttgagaaagatgctacaaacaacaataataatttcaattaagttaggagtagctagcaaacccgtgcattattattaattcatgcatgtccaagtccaaccatggagtagaaccaagggaaatgtggtgacacgtttcactacttttggcaaataattatatttctagcatgaactagcactagcggtatatatgtatgtagctgtcatgcattgccatgaaaaatacatgcatatttatatggaggactactatacaaataagtatatcatatttccaaagagaatctatatggatcggcccaataaaggatagaagaaatccaggcccacacacagctagagcctagcatgcaatggccaatcgctgtcttttcctcctcctcgttgcccatcagattcccaagaattttcagattgtcctgttctatattttcccaaataagtttaagaaagatcgctccagacatgcagcaacaaatggagttatgaagtggttggattgggagaatagcactctagaaatacttatatttacaggataattttcaaatgctagaaatgcttacatagtttcaacttattgcacttatgtaatggaatctttacatatttcagttaaaaataaaaagaagctacaaaagctaactgctctcctttcaccagcttgaccatttagctgctccgactgtcccatacctgcacagtcctacgtcatcttgctcctagttttttccccttattatgctaacttacagcttttaattatctactctggttggttagcaataacctctttctaaatggaacttagcaataacattgtgcacgatgagcctcattttctttttgaaaaaagaagaagagagaattaactaccgtgcaccgtaatatcggatctatatatcctgctctagctcttattgttagcttagtgatgctacacatctatcgtccttaattgtttttttttctccatttcgttcactctaactccctaaggagtgggtatatatgtatggtgatggtggctagaagggctcaagggctgagaatggcggtaaatgtgacctgacgactatgccaatatacttcaatttagggctttctttgaaataaacactactgaaaaactgatctttcctgggtcgacccaaatataatctttagtcctggtttatcccctgtcagtagcctgtcaggagccgaggatcgggactaaagatcactactttagtgatcttgattatctttagtccaattgaatgcatggtatataatccctctcccttaccctctccaccacaaccggtcccctcacacttatcctctcctccacaaccggcctctcctctcctcagatcgatcccttcctcctcccctcccctatcctccgcccccctcctccccttcctcctcccatccccggctttctccccctccacccctcccatccggtgccagtagccggcggggccgcgcccgtggtgagtggcgagaggtggcaggtggcagccgctaccaacatcctttctctttttcttttgttttttttttacaatttgtgatttacttagatgtatagttttgtgattcgttgtatggatctgagatatataatctgtgatgtatttgatttgtgtgtaatttttttaagatttgtgatgtatttgatttgtgtgtataagtaacttaagatttgtgatgtgaatgttttgggatgttactttgatttgggatttggggtttgatttggggatatgcatcccactcgatttgggagaaaatacagggattaaactcctaaagaaacaatgaaaaaaaaaagaaaaaagagacttactgggactgtcgctaccctctttttagtcccggttggtactaaagatacattctctctagtcgcggcaaccgggattaaagatggatctttagtcccggttatttcaaccaggactaaagatgagcatctttagtcccggattcctagtcccggttgaaaaatcgggactaaaggggttaccaactgggactataaacggtttctccaccagtaaaaggaaattcataggaaattttgagggatcaaattctttgaaaaaaaattcctatagtatcctttggaacaaaggaacatgattgcaaaattcctatggattacttccctacacccacattccatagaaaatttaacatgagctgcatacagcatacctcatgttttattttcctataagtccccactgtaaattctatcttcctctctcttctctctctctcctccacaaagaatttcctgtaaaattcctgtgttacaattcccatgcaccatccaaagacatcacttatatttttaccctgttttaaaatcctagagcattgcgtagcatgtgacaaactatttttacattttaaaaatcatgtgttccaaaggagctagcacttatattttcctttgatggacggatatggctattgtaggcttctaaaatatattactactccctctattcatgattatatgcttgttttaatttaaataaacattaagactaaacttttaccattaacttctcctacaatatatttatagtatctacaaaattataaaactaatattgtacgaaattaccttaattaggtatgaatctaatggcacaaatcatatatatatatacaataatgcgcacttgaaatgctaaacagtgtatttttttctaaaactttctatatcaaagctattcttttaaatcaaataaaatcaattctttcaagtatatagtagttaatacttaattaataatgtgctaattatctatagtgttttccgagctggtgagtagctaaaccaatcagctccatagaactcacctaaatatacttacatgttacttcctctcttttatactattataagtcattttgacttttttctagttgattttttttaggtttgactaaatttaaagaaaaaaatagcaacatttccagcaccaaattagtttcactaaatatagcattgaatatattttaataatgtgttttttgaaaaatattgctatatttttctataaaaagtttgactagaaaaaaaatcaaaacgacttataataagaaatagagggagtaactagctaattattggtcaaaatctttcaagtatggctttctagaatcaaaatatatacaattccttccgtcctataatattgcaacatacgatcggataggacacattctagttcttcgaatctggacatttgattttatgttgctacattgtgggaccgagagagtgtgtacgcggtaaaagtgaacggagagagtatctcttgtgccgttaacgttgtgcgatattttttaagcatcactagcaagctactgaagtcctgaagctagctactctctagctgctaatggcagtagcaatatatagctggttagacatcactagcaagcgtcatgtcgcctcttgacagctttattttatcaattgacagctttattttctttgcttgatctcatcatattattgatgaaataaactaattaatgctattaatttcgtctttcaagtcaacatcaaaattaagaatccttcggaaagatcaccacacgggaaaagccatgcagtgcacattttgctctccgtccatataaaccaatagtatctacatatccttggaaatttctatagaataaaactaaacatgttgacttttcacttatttttcaacaataatatatttccccttccactatggtcgtcgcttgtacgtgactataataggtcctgttagaaacgctagaaatgttgagaagcaaatgatgaatagccaactggtgagaatctagaaaagtgtgtttttacttataactttatagagtagaaaaaatgcccgtgcattgcaacagtaaaaatatttttttatcctatacattatactcccttggttttggaccaaatgcttccttggttttggactgaacgctcattccttcttcattttcagctctagtcatagcccagtccgctgcctccctctgctcaacctacctctctttggctcagcgcgcccacaagtagagctgtaagcccaactcgaatagtcccgtgcctgtaccatgacggagcctatcctctcatcaaatccgataatccagtcgagctcgcatagtcctgtgcccgtaccatggcggagcctatccttccatcaattctgataatccgatcgagctagtcctgtgcccgtaccatgacggagccgatcctctccattcaaagggaatatgatgagagagtagtggggaatcggtttttgcaatcaattagaggaggaaacgcatggagagacaaatcgacgtggcggtggcgctagggttcagcccgacgaaaaaaccacgaaaaaaatagagacaaaagaaagaaacccgaaaaccggtgaaagaaaaaaaagagggaacagtgaaaagaaaagaaaaaaaaggaaaacggtgaaaaataaaataaaacggaaaaagatgggaaaaaagaaaaacaggcgaaaattataggtggaagcatatgtattttttattaggtatagatttctagattctatagcttttgatccttgtaatctagatgaaaagcttacgggcctctttgatttagaggataaacataggaattttggagaattttaatcctatataaaaaaattatataaatacatttgaaacaaaagattgaatcctatcatatcctatcctattaaagtcctatggaatgaacaattctacagagattttggcggaaatttagcaagagcttcaacctcttggaaattttcctttgagtctatctctcttatccgattcgtactttttcctatggtttaatcaaatggttatttctaagatttcctgtgttttacaatcctctgttatgcacgaactccaagaagttatgtgttataaggttcacatcctctgttagtagttgactgtactattaaactataccattaatagcatagccaactattaacttcacatcatctatcaaaaactctctaaaagacagggccacatactcagggggtgtttagatccaggggtgtaaagttttggcgtgtcatatcggatattatatagggtgtcgcatggggtgtttgacactaataaaaaaactaattacagaatccgtcagtaaaccgcgagacaaatttattaagcctaattaatcagtcattagcaaaggtttactgtagtaccacattgtcaaatcatgtagcaattaggcttaaaagatttgtctcgcaaattagtcgcaatctgtgcaattagttattttttagcctatgtttaatacctcatgcatgtgttcgatatgacggggtgtaaaattttgggtgggatctaaacatggcctcattaaaaccaaccattgacaaggtctagtgtggatgtaaagtgtgtaaactagagtgctctgtatgtaaagatgactaattttatactccctccgttccaaaataagtgcagttttagcattgttcatgtccaacgtttgactgtttgtcttatttgaaatttttttataattactacttttattgttattagatgataaaacatgaatagtactttatgtgtgactaattttttttaatatttttcataattttttcaaataagacgggtggtcaaaacaatgaacacggatatctatggctgaacttattttgagacggaggtagtacaattattgtattgggtatatatatcatttgtgcaactactagtatacatacgtagtactccctccgtcccatagtgttgcaaccta

SEQ ID NO: 13711 - DNA, 24176 bp, Oryza sativa
agtcctatatatgtagcccatgctctcggggagagagagagacacagatagagagagagagagagagaggggccaattggtgttgcgatcgaggctaggtcaggtcatgacgcaatgcaaatgttatatggaatggatcagagtgatagaggagagagctgtcgagctgggattgcagcatctccagcgccaggagcaccagttgccgtaaacaacaccacacagtttttcccaccaaatataaaagatctttcttggcacagtgcgttcaacagttgcaagcaataatattattggctaattagtactgacttttattaatattcgcctattatacaattgataccacctccgatccattcctaaatatactgaccaatgtcatatgaaaaaagaatagagagagtagtaattaatgaactatatcagtgaacattgacagacaaaaataaaatcatactagccatactgtgcaaaaagcaccatatataatttgaaaacgaccggtatagtttacactcatatatactactccatccgtttcagtttataatgcattttgactttagtcaaagttaaactgttttaagtttaactaagtttgtagacaaatataataatatttataatactaaattaattagagtcatcaaattaacaattgaatatattttcataataaatttatcttggattgaaaagtcaaaacgtaatttgactttgaccaaagtcaaaacgtcttattataatggagtaactttgtaaatcacacttgagtgtattgcgtgatttcttaggatgctacgctatctcacaagcgacttacgtactataaattaatgcagtgaacatacttagagagttgaattttaccacgatttaatttcgatggactaattaaagaaaatctcaaggtttcgaaaacgacatggtacgtcgtgcgcgtatatgtaactatggaccatgtattcatatgcacgaattggtacaaaagggtgcacaaattctgcaataactgttggaaatgtatatatattcatacatatgtgtgtacactgctctctccatctctaaaataccttatactccctccatttcatattgtaagactttctagcattgtttatatttatatagatgttaatgaatttagacacacacacacacacacacacatatatatatatatatatatatatatatatatatatatattcattaacatatatatgaatgtggccaatgctaaaaattcttacattgtgaaacggatgaagtagtatttagctggtctcagatatattagtatggttgtgaaaagacgaatatgcacttcattaagattatatgcttctattatactacatgtttagctagacttttggcatgcccaagctctaacaaatgatttttgcacctaaatcgatttcaattaggtgggcgagagtggggtttaaccaatagagataaaataaggacaataaaaacagctagtggaccacatatctccacacgtctcttaaaaaaagatttattttacaactgaatttgaagataaggtattttgtaattgagaaagtaaataccaatatactccctccggttatttatatttatatttagcgttagaaaagttaaacttagttttcccatctttaaatatatatagtgaatggatcgtatcgtaaaaaaaaagacaaccggattatagttaaataattggccatgtattgatatggtgcaaattaacaaaatttcgcagtaatgattggccatgtattcatgtgtacatttatcaatatatcaataaaaaagacaagaggataataatagtaataataaagaaatggagaaaaggagtcgaggggttgggagttcgaccgtacgaggaggtagcatagcagcagaatcgaccccaagctttccttctcacgtaacatgccgttattatattatatatattaaaataattaatccaattattttttaccagattaatattaatgtaatccgtgtgtcagcaggcttgagaggctgcaggtgggccccatgattccgggaccaatcacagctcgacagcatactgacacccgtccccaaaagcaaagaggcctctctctctctctctcgccgatccctctcctcctcctcttcttcttcttccactagctagttcgtcttcctccttcagctagcttgtagcagctaaggttaggtcggatcgagatcgggatcggccgccggcgagcggcgagcggcgaggatggggcgggggaaggtgcagctgaagcggatagagaacaagatcaacaggcaggtgacgttctccaagaggaggaatggattgctgaagaaggcgcacgagatctccgtcctctgcgacgccgaggtcgccgccatcgtcttctcccccaagggcaagctctacgagtacgccactgactccaggtacacctatagcctgatcgattccttgccatttctggagcacctgagcccgcctgagatggatgaactcaataattctcctagctttttgccgtttctggccggccgcttccatggatttcagctgctgctctctgaatttgccatgtttggtttgtgcatctggttgcatgtgtgctacagctgatgattttatgcttcactagtgctgcaacacatgcaacacagtccaatccaagctagctcagctactccaggaggaggagtcagctgcatgcctcctcatttcgggaaatcatctctctctctttctattttttccctttcctttcttgtttcccctttttctttcctgctagcttgcttctctctctacaccctgcataccctttttgggattgatggccggttttaattaatttcccctcctttctttagttaattactaccctactactaattcatctcctcccgatcctctcaatttctcatcatatggagtactactaaaatatatatatgtagtacgcacttggtgtggccggtctttgttaacatcatgtgcttgcttaaattcaaggggattatatatataagaggatctactactaagtgtactttgtgattacatcagctatctatgtagctgatgatcttgctttggtcttttgctgatccattgagctagtgctaattctcatcacccttccatttgatgtactgcaaatagttttttattcattcgcttcttctccctcttccccatgtgatttgattgctagctccttcctgacttttatttgggttgatttcgtcacatcttcctctcaaattaatctcatgcgcgtgcctttgttctccacctgtcaagaaattaattaaagaatatatcacacgaattacgaggagtccaccaccagtgtcatgcactcctccctattgttcacagtcacagctgatgcatgcaaaacatcttctgtttctcaagtaattaattcccctcttcttgtgaggcttggcttaaaattactcaaacagctgtttttcttgcttatgcatcatcttcctcagataccaaaacgttggagatggacagatctggcctttcctcttcccttctctctcatcctcttctatgtttctgcctcttcttatgatgaatctttatttggtattattcacgttaagcatctctttaaagagccctagatcaaatttgatctatctcttttggtttaacttcatggccagttgcttgtgtgttttggtctagaacgaccacgtacgcgagatatttccttttctgctcagctgattaattaataatgatgggataattcactaattattctggagttagatcaagagatgtacttaaacatcctgtgacacgatgacttcaaaaaataatcttgctctctgtaaaatcacataatagctagccatcgcgcgtgtttcagaaaaataatttatcttgcttgctagcttttgctcaaaatgcgtttctgacgtctaggtaaagaggacttttacggtcgtctgtgttgtactggaacagtgccctgcacactccccagcgtcaagatcagtctaaggcgcttcatttctagctcagaaatcttcacttatttgatcttaattatagatcttcctgagatagatctaagggtgttccagtaaaacagaagaagtcaagttcttcaggatcctcgtgatataattaaactgtagtctcacaatcttactgatcatcaaggagtctgtaaacacctatacgtacggctataggattatggggaggttggtctaaaataaaggtgttaaattacttgcaattatcaagatgtgcaaatcatcacccagtaattcaatggtgctattatatatagtctgttttgaacagttccactggttttgttagggtccttgctgatggctgtttaacggtgctgttatatataatcttgattattttttttgctaaattttcctaagcaacccacttcaaattttggaatgggtgaattcttatgttcacaccctcatatcacatgtgtcatgaggagcttttttttcgtcacacagtcccatacaacgtccctgttttcttgaagataagataattcatgcatgcacttgaatataaccgagtgttttcatgtgcatgctttttatttggctgtgtcgagtgtttagacagcaaaagagctcttgtgcatacaaatgccgatatctatatattagtagtcttaatccacatttcagctttaattgcttggaatagtttggtaggcattcctagcttcagaccatttaaatatacttcctaaacgttgtcatgagaatgctgaatgcaaagtatttacatatatagtggactaatttcagattctgctcatgatggttttccctgcaggatggacaaaatccttgaacgttatgagcgctattcatatgctgaaaaggctcttatttcagctgaatccgagagtgaggtaaaacacagtaggttgtatgatatataacttttacatgaagggaatattattgttccttttctattgcattagcatttcaatcatatcatttccttgtggccttttaaatcacatgttaacaaagcagtttttctgaattctatcgttctacttgccaaaactagatgttggtaaccttctgttttatactttttaacttcaaacctcgtgtcttttgcactctggcatatttcttaaaatttctacttattgggatatcatgcaggagagtcctcattcccttcatttaatcccctcaaattttatttattatggtcatacaattaatgggccacatgcatggaagtcgatcgccagcttgcgatcagcatcctatcattaatgttatgatctatactaattcttctgtaaataaattaaaattgcactagtttttaactaaatgctactattctatttttttatccatactccgtttgagtggtttcttttgtgtttcatgaagcaatataatatgcttaagaaaacatagaaacatgcacaatacaataatagcgctggtagaatccggttggagaccaaatgtttcgatattctaagtgcatatttatatatactaagtaaaactgtaatcataaacatgcatatggactgtgatcgatgaaatgtttcttcattttttttttcaagataactcttccccagttgacaacatgcactgcatccagaagtactcatggtatttgttttcagtactgtttgatgagtaaaactttggtaagtgttaaaaaatgatgataagtgcaaatatttgttcctttaccacttccaccttcttggagtaaagaaaaaaatgtgtgtggtttggcaaagttgttgcatatatcacggcattagtgtgcggataatgcgaataaatgcatcaataagcactaggagtaagttaattagttctctaccttaattgaaaagttcatgtacatttaaaaaaattaaacatgcctctttttatcatttgttgaatttctacatttatcaagacagcaaaggagttctcatctactaataaattaatttaaggagctataactcccttaattttatcaaatattcacatacacggttgcatttgaggattttctatatactccactaaatgaggatgcatttaggttctttataatattttatttccatcgtttcatcatctgtttatgtttacagtaatttagtaatagttctctaattttgacagtaatggttggctcacagaaaacatcaaccaaccatatatattggtttatactgacaaagagtttttttttgtacagggaaattggtgccatgaatacaggaaacttaaggcaaagattgagaccatacaaaaatgtcacaagtaatcgatatatatatccaatttctataataatgttaaataaatttcgaactaattgcactaattattatttttaaaccaatttaaaagagaacttccggtattgactgctgaagatgacgtgaaactaacttatgtatcttgtgtagacacctcatgggagaggatctagaatccctgaatctcaaagaactccaacagctagagcagcagctggagagttcattgaagcacataatatcaagaaaggtagtatttttttggatagtggaatctttttatttgaactcccgacctctacacaccaaatgtacagaaaaaaaggagcaaattattaaaagaaacgtagtaatatatttagcatgttctgtttcaaactggactgaattgaaataattcatgcatgcgcatgcctgagttacataaatatatatccaaatgtcttgttgtcactgctactttgaaacaaatgttcttttttttttcctttttgagaaaatatatgagtaaatattttcagcacattctggaggaacaattaccaaatataaactttttagcacattctggagtacaattaccaaatatgacggactaactagaacaatatgtttgtgtttgcagagccaccttatgcttgagtccatttccgagctgcagaaaaaggtgaccaattgaactgcactactgtgtatgcatgtatatatgaatcgtgcatgcaaaccgttgttagctagtagttagttatagtttactcttggttagtctcaactgatagtgcagttttcttgcatgagtgcaggagaggtcactgcaggaggagaacaaggctctgcagaaggaagtaagttgtcgaaaatatagtatttactgctgcttatattaattaattcattctgcttgactagccaatggaggcactaaacataattaattcatgcgcattggttttgatcaattgatttatcttgttgacaattttccaatctatccatgggtttaattactagttttgtcaatggaggcattagagataattaattcatatgcgcactcgaaagtttgaaattgctgtagtttacttgttgggtggatcatatcgccaataattttttcccccacagttgaccgcaaatgagaagtaattttctttgccttctagacttgacggctatttttttagcgtgttggcaattgaacatatgaccttgggttaaaaccacacatcttttatcattgcgctatcaaatacatctcgataaatttgtcccttactagcggtttatgtggtttccttggtggtcggtttgtgcctcttagaaaaaaatcgtgatgtttgtagtgtgcgcatgcagctggtggagaggcagaagaatgtgaggggccagcagcaagtagggcagtgggaccaaacccaggtccaggcccaggcccaagcccaaccccaagcccagacaagctcctcctcctcctccatgctgagggatcagcaggcacttcttccaccacaaaatatctggtacgtatatgtctgcattcatgtctcatcagttgctattcagttataaattaatctgttactgcactaattaagatcgatcacacccttgttaagttctaagtctctaattaattaactgcatgtatataattatgcacatctgtgcatagtagctacccgccggtgatgatgggcgagagaaatgatgcggcggcggcggcggcggtggcggcgcagggccaggtgcaactccgcatcggaggtcttccgccatggatgctgagccacctcaatgcttaagatgatcatcgtcgtcgtcgtcggccaaacagctgccgtatgcaccgtgaatcatgggagcaaccttgaatgaattgaagtcattggtatcgatcctagcgataatatatatgattctcctaaaatgaaattgatctcaaaaaaacaaacctagcgattaagctattcttatatatgtgtttgcctgctgccccctaccctacaggctacatatgatttgcaagaaattaattatgagcaaggatcaggatgtgtctttgtgtaatcatcagcacgtacctagtgcttcctactgatatatatgcatgcaattgtgtgcatataaatatatttgcatgccatgctcccgtgatggttaattaatttatgattgtgtttatacgctaattaactgcagatgcaaactaatcaatcgaattatatatcttttgtgattggatatatggcaggggattacatttggtggtttctcaattaattcattattatggaaatttaagagttcaagataatttatatgataataggtgtatatagataatcgttagtatttattagtgactacaaatgaatagatatgtactactggttaattagaactgcaagttatgcatgtatatatattgtctccatatatttattaattaacacgactcattatgaaagagaagaactattccatggtaattgtaccatcaggtatgtgctaaaaattgtttctcttttgatgggatcgagatattcacattgaaacataaatgagtgaactgatcatccttctctttctagctgattgaacttttcattgaattgtctagtccacagcagaacatcacgttgaaatatataagtgaattatatgttttcttgggttacatgtaattaatacgcacacacatcgtactcacacccacatatacaccctccaaatatacttaaaagtgacgaaggccagcgacatttaatttacaggacttcattggagggagcttctagctgttacagtttctcgcagaatcagaagctccccaaatagtctagcttttggtttagattctaataagttgtagtggtagaattcagaaaatgaactagaagccaaaagctggcaaacctagttttttcaaattctcagaagctggctaccaatcagttacttttcaaaatcttaagctcctccaaacaagctctaaaattacgttgaaagtgttgcttgtcgtaatagtgctgagggtagatgggctgtacaccccgaaaaagttttgcgcaaaacaaaacatactgtataaatgaaacaatttatattcgacaaaggaaacctagctattcaagggaataaatctataccgtacgagccaatttgataatctgttggtaaatgtcactactatatctaatttatcttgccatttaagtcaaagttccatcgttgctaggattctagcagatgaagtcgtgtatccagaatactaccatcacattaccagtgttattcgaaattgtctattcttttttgcttgaccaccgtaaacttttacaccaaattggttaacatattaaaaaaaattattgtaaacggtgcaaccatgcatatgacaccatgtcatacgaagggaaagaaaatactgctacacatacttaaaaaattcttacataattattagatggagattacaaatatctagatttacttatagcatgccacatttaataaaaaaaatgtacttacatccttttccgaggaaaaaataatcacgatatgctttggtatgtggtagtgagaaaatcagcattgatattgccggactaaactgcaaatcaaagaaaatctttaatgttgttacagccccaattttcatttatttatatgcttatctaaatcatgtatatagcaaacaaaaagttatctgtgagtaaaatttttatatgcgtgtctttaatggttcaaaagcaaatactgtaaataaactacgataaaaaatttaaaattagatttaaaaattaaattttaacctataaatataagcataagccaaactacgaggacgggcttcctgtgtcgctctcacacaaaagaaccagggtttcgacagaaaagagaaaaagaaaggaaataatgggattggatggatgggtgtggtgtcttgtaatgccactgggccgacatgattgagaaggccagccaataagatttagggcccattaacaaaaatgatctggtgtaccagggtttgccacgtccacattgctccatctctggacagttccacacacatacacacacactctctctttctgtctgattgcctttgccttttctttcatctgcagccatttgtgtccctcggataataatcattcacttgctttgtgcaaccttttgcccctttttctacttcctcttgaagactgtgcaaccttttttgttcagataaagctgcaatttgaacaccacacatctgtcccccattttagtgtaaattaagtaattacttttgaaggttttggtgtaagttaaatactactttcgcaggttttcgtgtactagagcttaaggtgctttggggcaaatcttaaatactactgcattgcatctgtctcatattacttatcgttttgacttttttcttacaacgtttgaattagttattttatttaaaaaattagtataaatataaaaaataataagtcaaacttaaaaaacttttgataataaaacaagtcacaaacaaaataaataataattccaaatttttttaataagataaataattaaacattataaataaaaacttaaagcgagtacggaggtagtacatcactaactttatattttggaatagaagaaacatgtaacacaaaaatttcacattagtggagtaatttttacatgctactatatcagtttagtatagtactcctaacaagtcctactcctacctagtaaaaaaaaaaggcaaaataggttatacatataattttagacaaagaaaatgttatacaggcttcaatttggacaactactaatttcaattgagtaatttacatcagtaaatgtacagtaggactaactcttggaggagtatttccaagaaagaaagaaagaaaaatggcggtgaaatgaaatgtctaacgcagggaaggcggcgggtccggagtaggctgggcggcggcgaggtcggcgggggagagggtgccggagtgatcggcgtcgaggttgtcgaactcgtcgaggaactccgatatgtcctcctggctgatcttgccgagctccttgagcttgtacagcacgaagtcggcggccccgacgcggtggtcgccgtcgaggtccgccgcctccaggtccatgttggtggtccggcgccgcagcacccacctcgccagctccctctgccgccgctccgtgtacagctccgccgcgtacaggaagaagagcgccaccaccaccgtgctcaccgtgatccacgccaccgcgaacgcgcgccccccctccgacgagaagctccggtcgccgtaccccagcgtcgtcaccgtcgcgcacacgcagtagaacgcgtccaccgcccgcatcccctccaccttccacagcaccaccgtccctgacgccaccgccgccaccagcagcagccccgccgtgtagagcttgtacctcaccttgttcatctccatggcgcgcaccatcgtgtgcgagtgcagcgcgcggaagaggagcgcctcctgcttctcgacgaggtagtcggcggccttgctgaggaaggtgccgacgacggcgacgccggcgaagacgaaggcgcaggcgaggagcttggcggcgtcgctggcggggacgaggtcgccgtagccgacggtggtcatggtgacgacgcagaagtagagggcgtcgagggcgcgggtggtgcgggtgccggacatgtggtccatggcgaggtagaaggcaatggtgccgaggaggaggtacgcgacgaggaggaggccgacgagccggaagctggggcggccgccgccggtgaagagcgtcttgggaggcgcgtcggccgccgaggagttgtccttgtccgtgggcggaggctcggaggagggcgccgtcctgcatcgccggaaccttcttgccgctccttccggcggcggcttctggtcgccgccgtcgtgaagcagcggttgttggtcgagggccgccattgatttggtgataattgaggtggaatttgagctaagattcagaggtgcagcgatcgatcgatcatcgatgtgtgtgaaatagaaattgggaacagaaacaaaggagatagaggtgtgtctgtgttggattggtttcagcatcagacagcaggcaggaagttaatggatggggtggtaattaatttaatcagtcactaagagcaattttaataatataccccactgtttagccctcacattttagcctcaaattagccctcaagaatccaaacagatgggctaattttgagctaatgtgaattagcccccctcaaaacattagcccctcccagggatgctaatggggctaattttatatggggaccatcaaaaagctaggccaatatttagcctaccaattcatgactaaacattagctcttaaaattagccctgggctaatcttccaaatatggcatcaatctaataactcattcatataatagttagctgtagaaatacactacatcattaatacataatctacccatctttctcacatggtttattagagctcgtgctgcagctggctacagatctgtagcccgcttttattctctctctcctccacacaagcaaaaatctgacatggcaacttgtatagcccgcttatgtcaactctctctaagagcaagtttaatagtatagtcaacctgtatagctccaaatcatctataatcaatctaatagtcagttcatacaataattacctttaaacatatactacacaattaatacatggtcccacttgtcatacacacatatatcttggagttcatgctgtagccggctacaaatttatagccccgctgatcttctcccttatcttttatcttctcgaaataagtttatagctggcttatagtctgctatggtgtagtactgctctaagtaggtgattactccgcagcatccggattggataggttttgcttaggtgtgataaatgaatgggtgtgacgtgtctgttgtgatgccgatgccggcggggaggtggctggttgctgtgtcggtacggacctattcttttcttcacatgtgcgaatatattggttactgctccagctgtgaaggcaaagctgagttgtaaacagctacccggttcattttcgttaagcacatttttcgatccaaatgctacacggtgtgtctcgtaaaatatatatataaaaatttctttaaaaattaaacaaatatattttgtaaataaaaaaatgcttactaattgattagtcgtgcaactaattatctatatcatttatgtgtgcctgattagcttagctaataaaccttaccaaacacagtataaatgatactctcttttaggagtacataggatacatttttcttttctaaaaaattctaaataaaatataaaaataaaaatttccaaatttaaattccttggaaaaaaaataacacgagtaaattttatactcctaaattaatcccttttatttaattatgcatgccacctatatgatcaggggtggaccgggcctcaagccactgggccatgaccctgatgcctcctggactgcaagcccactgtgctgagtatgcaacttcttaccatgcaaacctcgagaacttcaaaccagaactcgatgcagttgatgggagcatggattctaatttagctatggcgaataacaattcagcgtcgttatctttgaatactttttagtcagaaatcatcataagcaattcttttacttgtaagtaataagtcaatgaaagcctttattcattggatatacgtgttacatgtactatatatgaatcaaggccatgcatatccatgatccatatggagagctcgatcgagccaccaattaattaattaacggtatttagaaacataactaaatcagttaattaatccaataaagggattaataacaatgtcgacaacgttatttattcattaattaactaattcttctgtatgcgatcgagctgcagccatagacgtcgacgtatttcttcttctttttcgtcgtcgtcaagctaggagcagcttgtccttcttcttcctaggcagagacgacagggtaggacggcgccatggcgacaccgcacgcgccctggctgccgacgtccttctccagcttcatgtatccgccgtccccccaggttgttccccacgagttcttgatgatccagtagccgccgccgccgctcccgtccgcctccgcgccgtaccccaccaccgccaccgcgtggtccagcttcgtcccgcagctgtccgccgtgaacaccccgctgccgtagtgccggaacatggcgccgctcccctcgatggccaccgacaccggctggctcgccacggcggcggccagcgacccctcgtcgttggggttcacgcgctggtagccgctgatggtggcggcgacgcccgacgccgacgacgaggcgtcgaactggcacgccccctgcgcgccctggtaggcgtaggccgcctcggtggtgacgccgccgctgttggccatgtactggaacgcattgtcgaggctaccgccggtgcagccgccgttgtcggcgcagtcgagcagctgctgctccgacagggacaccagctcgccggtggtgatctggtggatgccctccacggcggccaccgtcgagaaggcccagcagcaccgcaggatcgttggttcttgacgccggtgacggcgccttgctgccgccagtcaacctcggccggctgctggtcatcctccgacgagaggcgggtggtggcgttagctgcggcgtacatggtattggccgggttgtagccggtgtacatggcggcgaactcggcgtcggtgaggtcggtgaagcggttggtggcgaggcggtagcgcttgttgccggcggcgttggagcggtcgatgaggtccacgttggccttgaacacccggaaccggcgagccttctcggcggcgtccttgtacgtgcgcccgtgctccgccatccacttgtcgtgcctcgcctccatcgtgccggcgcggctggccatagtcaccttcgccattgtcgacaggccgccggcgacgacgagcagcagcgaggctgccatgacctgcagcttactactagtacgagccatatgatgattaatcaacgacttaattagttacctagtgtaactaattaatgtagctagctagcttattactcgaagctattagaggtgtgtgtgctgtgcgcggtgtggtttggtttggttttggaggaggggctagggtttatatagattgcatgatcgatcaagtacgtacactacacatgcatgggagtaagctgaaaacatcacctgtaatcctgcattatttatgttttctcaagtcctccccctgccacattaatgtagaaacttaccaggtttgatcaattccatagcagatcattaactagctagtaatttcaaccaaagtaattgagctaactcatctagctagctggcataatggagtggagtatatcttacgatgtgcctcgaactagatgatctcgcgcgcagtcctgaatgtggatggtggactttctagattataattccattaattccgagccgtcccctccccgcccgagcggatcatttcctgcctaatcaatttgaccggaaaattaatgtaagctcatatatgtttcaactttgaccactaacttattaataacttttagattatatatatatatatatatatacactcgtgctccatggagtatgggctctaatagaatccaccgtatacgtgctttgagatccgtgctacataaaccggagtattatacatcttaacgggttaaacccaattagatctttccatcagcaataggcatgcatgatttgcatgcatgcatgtactgacgtgattgagtttccatttatacgttcactcctattgtttccatataaactttcatgcacatactttccatttgaaatattaatatgattgcgtgataattgattatcgaaatttaaaatgactttccatatttgaaatattaacattatcacgctaatatttatttccaaaaatctgagattgcactaaatcgaatccactaatttttgatttttttttgcttatttccatcaatacgagtagacatgtcatttcattctaatacacactccactttgggctccacgctgttacaccgccgcacgtcggcgaacttcttcatcgccgagtcgttgtgctaccagacgtgcctgagcatcttcgtcgtgggctgctgattgttcgtgagagtcttggacgtacgcagccggttatccacaatcttcgtcgccaatcagttgcgccgccgaacatccacgagcttcttctttgcgcccgctcgtcgttcgcgacaatcgcagcagtcgcttgttgttcgcgactccatcccaagctcgctcctcgccccacgacgtaattttcggcttccagttcctccgcttgaatcttatcagcgaaccacgttcaggtatgtgctccatccatccatcttttctggtttatgtttcatgtggctgaggcactactcaatatattcaatgttttattccaatatattcatgcatcatgatcagtacctattgttatttttcaacgtccagtgtaatcatttcccattgtttgttttttataggagacatatgcagatatcctcgctgatgtcaagattggagttgatcctcccaagttgctcgttcgtcatgatagggatcaatttgaagatcaggcaaaaccagcgaccctgaaagcgtgcgtggattgcaacccatctgacaacaaataataatctatgttgctcctttgtattaagaatcatatattgtaataatcacctcgtggcacctactccctccgtcccaaaaaaatgcaaaccgtgggttcccgtgccaacgtttgactgtccgtcttatatgaaatttttttataattagtatttttattattgttagatgataaaacatgattaatactttatgcatgatttatctttttaattttttccataattttttcaaataagacagatggtcaaatgttaggcacggaaaccagggtttgtctttttttgggacggaggaagtagctttgaacaatgttaattttactttagttgctggacaatttttcttattgtattattccaatcgaaatagtataactgtttgcccaaatttcgtgtctgttatccataaattagctaaactttcatatttgtattctgggtcatattccgggtcatagtatacctaagttttagatcgcatacccagatttctgtacacacatagggtatgtacgtatatttgggtctgtattttaatcttgttcccattaactgaatacccggtatatttggggacatacttatatttgggtctatattttaaacttgttttcctaaactgagtacccggcatatttggttatatacgtctgtttgtgtctatattttcaacttctcccaaactgaaaacttggtatatttgggtatatattttcaactcttgcgtatatacacgtcgtacgtcatataagtatagctaattttacttcgaatacccaaattttttatcataaacttaatacataataacatgaaaatttgatcatggtctgtgatttttttcccttacatacacaatctttgagtatatgcccatgacacatgtttgtactcataaccttatataacaaaccacaatttttgcataaaccgaataaacaatacacatgtcttttgttttaaattttaaatagaactatttggatagatgtcatattgaattttaaacccaaccttttggcaaatagaaaatgcgagaaattcaatatgacaaccatatatgaagatacatttttcatgccgtgcgaatttatttcaggcccattaagaactaatatccgcgttcatacctaatatttgggtatatttggttccagtaatcaaaaatcaagtgtgtatattctatgtataaatatggaaatatagccatagtgcatattttgtacgtctaatagctaaattaatgacgccataaatggaagtatataggtatggatatattaccatatacccagccgtaatatatttccaaatacctagtttcctttttccaaaatgccgctgatcagtatttccatatacttagttcccgtgttgccaaataccgaggatcagtttctagaattagatacttagtttaggataattccttttgtttttccatataattagtttcaattttccaattttcgcactttccatgattcgtacatatattaccatttattcaaaccccaacttcgggcaagtgattttccatattttcgtgatactattcctaattgtatggcattaaaagtttccattttgaactttacacgcaattatggaaattctatcatccgaattgcatgcatgcattgaaacgtattaattcagtgtatttactatctataactacgttcaaatatatggaattcattcactgttaatagctatattcttaacgggtgtataaccattaagctaatataccaaaatgactgcaccgatcatccacgatcctacggctcccgacattggagcccatacttcatggtgccccatccgggcgtcctatatatatatatatatatatatatatatatatatatatatatatatatatatatatatatatatatatatatatatagagagagagagagagagagagagagagagagagagagagagagagagagagagagagagagagagagagagagagagagagagagagagagagagagagagagagagagagagagagagagagagagagagattaatgcttgtataatcactagtattgtacaccatgacattagagaaaaatttgtgcattccactaattcgtgacatgcatctatctgcatctgggattttctgaaaatagcacgctagacatataataaatcctccaaatgtgccaaacaacaggagccatgcatgagaccttcaacgcaagttccaaaagaaaatggtctactcctctaataattaatatgaggtcacaatctcttaaacatttctggccgctaacaaaaatgggaaacacgcatgaatggtaactgatcgatgctaaatttcaataagacgaacaacggacagtgggttctttcttttttctctgcattttaataaaggcaaggaagagcaggacaaggaggaaattaaagatgtctgatcttccagggttcctgagcgtgagagtgctgcgaggggtaaaccttgttagtcgtgatgccggcggcagtgatccctatgttgtgcttcacctggacaatcaggtagcctgcctcttcttttctttagctatatattaatcgttaaaatctattaattctccgatttgttcataatttttgagatccacaagcacaaggacttgaacattgacattatatatactgttttggatgtgctgctatatttttaagtagttaactgtagatgcactttaatgttttatactattgcaaattaattttaactgtggggacaggacagtaaacaaagcccatgtttagttcgtgtgccaattttttttaaagtatacggatacacatttaaagtattaaatgtagactaataacaaaacaaattacagattccgcttctaaactatgagatgaatttattaagcctaattaatccgtcattagcaaatgtttactatagcatcacattgttaaatcatggcgtaattaggctcaaaaaattcgtctcgcaatttacatgtaaactgtacaattggtttttttcgtccacatttaatgctctatgtatgtgttcaaacatttgatgtgacgaaatttttggaagtttgaaggaaactaaacactgtcaaagtacaacaacgttcacctttcttttttttttttacaactatcgaaaacagaaaagtaatggtaatgtgcacaaggaatccatttatttctttacctgattatccaatagtactggtatgcccagtaaagaagacttaaattacagatagactaaataagataacgagttgatgagatgtgatgtgctaacctatttgacaacaacagttctttaattatagcgtcaagtttcttcatcaacattttgtatcaactctaatttgtcattttatttgcctacacagaaattaaagacaggtgtggtaaagaagacaacaaacccagtttggaacgaagagctgactttagctgtcaggaatccagaaacacctatccagctagtaagcatctgtatctctatacttatatcaaatgctcaaacactaaactaagtagacagttcttaccactcttactgaatttttttttcaaaaagacaggaaacttacgatataggctgcctctttttctcaaacaggaggtatttgacaaggacacattcagtaaagatgaccagatgggtgacgcagagttcgacattgaggcgctgatgcaaatcgtgaggatggatctgcaggacatccgcagtggcaccgtcgtacgcaccgtgcgacccggcagacagtgctgcctagcagacgagagtcacattgtgtgggagaatggtcagattgtgcaagacatgcttctcaagttgagaaatgttgagaccggcgtggtgcacctgcagctgaaatgggtgaacattccaggtatgtactctgcacaattataaggctggggtgctggattcggactcatgatacgtcaacatttagcataatagcactagatggtcaagtacaaaagatttggcataaagagatcaaaagattagaacagattgtccactgtttactattattaccggattcatgctagaaatgatgcattcagattagcaaaacaccattattattaatcatgttgaaaccagtagcaggtttaatttgtttaacatttttattttatgatttatcttgttgaaccaatagcagtaatggtagaggatttgtatcaataacaacctgcatgacatagtgttccaacttgaatcttcagagagtaagcctgttgcaattgaatcaagagtatttggacatcgatcttacgagaaaaagaaaagagtatcggacatccagtcttgtccattgttcattgctattgcctaaaatcctagcatctttcagactaacttttttttaaagataataacggattaaacaatccagcctacacagccagtctttcagactaagtagtaattaggatgattttatatgctatctcttgcaagctgcagcagttggcaaaggtaatctaacgaattttctttcacattaggctgaagaagaatctgaatttcggtacattcatgcaaaggtaaaatgttatagagtaaatgtaatattggctttattaagttttcctcctctagacctgttgatcattcatcggcacatcggaaactaatctaacataagcaatttgatggtgcagatattggttcctcaaattggtgaagaaaccggtgttgttttgtttcagcattttgccatacacattaattgttgtgttgttcttcagactgtatgtagctgcctgtatatgtatgtaatttctgtgacaatgttgatcagacttcagagtatatgcattttgccatacacattgctgtgctgttgttgttgttgttcaagactatatatatgtacttcagctgcgtgcatatgtaatttctatgacaatgatgggaattccaaatgcaagtcttgtttgaaacaaagatacatactgtggttgatatgaatggatcgataaaaatgaatgcattttactggagcagagctgaagatgaacacgtacgtactttccgtcggagtcgcctagaaccgcttgcttcctactgtcgcggcggaggggacgtcaccagccggagctcaggagtggagccactcaagggattgaaagaatcgcccaattcgaggaccggagcggcaaatcctggagaaactgatgaagtcaccatatgtgtctcaccgtcgatgggtacgtcgcctaccactgaaagcacaacgtcgttaaatcctagaaaattcgctcccatggggagtcgaacccaggacctcaggtgctactgaggctcttgtaactactaggctacaggccctttcgcaagaatcgcccaattttcctaagccgatcaagtggtcccgatcgagagtgagggatggggaataatcccttcggcacggaaaacgaagcagaccattcgagatttctaattcacacgtacgcgccccgggcgcgcacttctggcccacggcccacgcgtgtcgcggtgccgtcgacgctatgaatcgcgatgccgttgatgctctaaagatcagtttttttctggtgctttttttaaagtaacgtaactaactatattagttaaggataataatagtagttaaggaaatattttttttctttttgggagattttttttactaatagattgaaaatttttaagttacatttgaaaacttttgacttaagatttaaactttgaagttaaattttaaaaactttcaactaaggtttgaaaactttcaactcgagatttgaaaactttcaactttcatctcaaatttgaaaaactttcaacccagatttgaaaacttttaactcgagatttgaaaactttcaacttttatctcaaatttgaaaaactttcaacctagatttgaaaactttcaacccagatttgaaaactttcaactcgagatttgaaaacttgcaaatcagattaaaaaattttaagttaagatttaaaaatttttaagtcaagattttaaaactttcaactcaaaacattcaaaaaaatatgtgtgctaaaaagatttaaaaaagtaattagaaaaaaggacaaaaaaaggaaaataatcattgtaaaaacgaataaaatggcatgggggagccgggacgcgccagcaactttgctggcgcgcacgcgcgaattagcaacacctcagaccattagcacgtgattaattaagtattagctaaatttttttcgtaaaatagatcaatatgaatttttaagcaacttttatatataaactttttttttaaaaaaaaatacacagtttaacagcttgggaagcgtacgcgcgaaaaaggaggtggcgggaagcagcgcacccaaagacgtaccaactggaggaaaaaatacacccaaggtccctcaacttgtcatcgagttacaatatcgtccttgaaccgcaaaaccggatatgacgcatcccccaagttacaaaaccagtgcaaactatgtccctgggcggttttgactccggttttgtcctatgtagcagctgactcagcgtgggacccatgtgggccccatgcgtcagccacttcttccctcccctctccacctctctttctccctctcctctctttcccaatctgcacgggcggcgcgtgaggagcagctgcacgggcggcggccggcgggcgcaggcggcttggggaggagctgcgcgcgggcggcgagcgacggaggctgggcgggcgggcgacgtccggcgggggaggagctaggcggcggtgcacgagctcctcgccggacgaacgctagaccggctccgccatgtcggccgcgaggaggtggcgcgcctcgtcggctcgctcagccggagtgccgccgacgacgtttacgcaaatgacctgagaatttgagatcattgccatcttgctgttctcttcaagccctatcaacaagattgacacgattaagcactggatcgagatatgatcgatcgagcagcaccgacgaactagccgccgatcata

SEQ ID NO: 13712 - DNA, 7509 bp, Oryza sativa
  unsure (1)..(7509): unsure at all n locations
ggttcaaggacaatattgtaactcgacaacaagttgagggaccttgggtgtactttttccccaattggaccacaaattctttctttctgttacgtgcggcccatatttgttgggccgtaacggaatttggaatttatgcggcccaagaacgggactgggatttgttgggccctcccgcaggtgcgctcagactcgccgtcgctcccccaatcggccgccgcctccgccgcgtctcgtccacttgaagagcaacatctctttcactcctcgaaccctagcacctccaaatcaatcattctcgatctccgcgcgagaatgagatcctcctccacctccagcctccaggtacgcccccgactccattgctctcatttgtgagggttgtatgacatccatctgcggcggggcggggcgggtggagacgccgcccatttcttctcaacacggctagcatgcgacagaggaagccctcaaactgatgggctaggatgcttggcttcgattcgatgttggtgctatatgattatcacaagacttcgtgttaatctttctaatcattacccatcaccaactgctacttcattttacacttgctgctttaatttatttaccttacattttgctactcacataaactttgttccagaaacattgtttgaaaatatggtgatttttttaactattgttgataaaaacttggtgctgttatggacctggcctgatctgtggtggcgaatgagtgaggggatggcatcactctatatatgcgaaaagccgaaaacagccatgtgttctgctctttgttcctttttgtttaagttttgttgctgggataacactttgtagcctgcctctcatgaatcatgatggaaatggaaggggtctccctcttctggctataatacatttgcttctcaaatattacagtacatttctaaaggaaagaaaaaaaaagatatggtaaattgaaacttccatgcctttttccatatctatttataggttttgcacgtgttgtccaaatgtgatcctttatagaggtcacacctttatccaggtttcttatccgagctaatcgaaatccaagaacaaaaatactactgtggcaaaaaagaataaggaagaacataaggaactcccacatgtccaaaaatggaagcaattagtttggtttcaatacaggccacaaaagaaatggtcagctcaactcctacggttgaggctcacacctcattcaccctgtcctgagcaatcctttttaggctccttcctgcaaggctgcaactatataggccgatgaggacagaagggggaaaaaacacaggcgcattctaccgagaggcacaggggttgcaagaagtcgcctaattctcctattgaattaggcacatcttcgcccccacattgcctctcattgtaaaatagtatcaactgataatccacaggaactaaacaacaattaaatccaattatggacggattggtaggcctcttgaaaatacgggtggtgcgtgggattaaccttgcctaccgcgacacaagaggcagtgatccatatgtcgtccttcgcctcggcaagcaagtatgattacttttttgtttttatatctctagcgatttgcctcatctccatctcttttgtttgagtatatattgttctcagtgtcttaccgagttttgtgttttgatcatattacagaaagtgaagactagtgtaaagaagaaatctgtgaatcctatttggcatgaagagctaactttgtcgatcatgaaccctattgcaccgattaagcttgtgagtggatgttgttttcttacaagcatgtgtactaactgattatgatatttcatgttcaaccctgtttttttttaatgaatgctcacattgcggattttcttcttctgttgaaataaacagggggtgtttgacaaagacactttcagtagagacgacccaatgggagatgcagaaatagacctggagcccttcatggaagttctgaacatggacccggagaacattcggaatggttccatcataaaaacaattcgaccatccaaccagaactgccttgctgatgagagtcacctattctggaggaatggtaaatttgtccaggacattattctccgacttagaaacgtcgagagtggtgagctgcaagtgcaactgcaatgggtgaaaattcctggcaggcactaagtgtctcatggccattgggagatcttggctactgagatatcattgacatttccgaatgccaaaacatatattgtgcgaaatggatcatgtcaaccattggggctgtaaatactgtgcaaaaaatgaatcatgtcaagcacgttttgatgtggaggttgtgaccagcaaagggttcatcaggttagtcaatgtctgtaggaaaggaaaatgatgttaaaatgttgttgccgaaatgtattgggagcatgatcagtaaagcttgggatgacataatcaaatagtacaaacgataggaccatgtttgcctgtgcttttgcaacaaatcaatcacaaatactgtttctcatgtggaattcttcttcagtgtcgtggcaatcactatctgaacttttgcctgaacctcaacttttatcatcttaaacagtattatatcctgttatcttgagaattgcttgctgcttaacgtggctcgatgcagtcaagtgggcgaattcatttttgcgattctgaaagtgaaccccttctctagtagcagtaacattttttttgcctgaatttctacggagatgagagtaagggacaagttcaactgaaagggagaggcaaagaagacgatgatgcctttgttcgtcgtcgtcgtcggcgatggctgtggaccgcaggcgaggtgataacccaaccagtggccattgatcctcttatcctcccgcggcgacgacgagcggatgccatctcctcctccccgcattatccgcagttgcagcgcacggggcgcaacaggacaataggataaattccacaattccagtagcctacaaattctcacctgctcccctgtttcttggttccccttcctctctcatcagcacacactgtcaccacaacagccaccaactcctctcaacttcttgatccggcggcggcggcaagatgttcggcggcggcggcggcggcgggaggaagccgctggactacgaggagctgaacgagaacgtgaagaaggtgcagtacgcggtgcggggggagctgtacctgcgcgcctccgagctccagaaggagggcaagaagatcatcttcaccaacgtcggcaacccacacgcgctcggccagaagccgctcaccttcccccgccaggtcactactcctctttctttcttcttcctctactactagtagattcgatcgattgatttctccctattctgttgtgttgtgcaggttgtggcgctgtgccaggcccccttcctgctcgatgatcccaacgtcggccttatcttccccgccgacgccatcgcgcgggccaagcactacctcgccatggcacccggtggactaggtatcacagtcacacacaactctagtgttcttggcaaacctatcatgtatcctttcctcaatcgaaatgctcccataagttgtcaactttagcttccttgcaaaagcctttttagttgtgtatgtagttcttctctcgtagcccatacacgcgagctcgttgactcaggttttatgtaatcaggtgcttacagtgattcccgaggtatccctggtattaggaaggaagtcgccgagttcatcgagaggcgtgatggttatccaaggtcagaatgatcaagagtactcatgacaagtctcaactggtggtgttcttttacatcatagctttcttgggccatattctcacacctgtatcctatacctattgcagtgatccagaacttatttacctcacagatggtgccagcaaaggtgtgatgcaaatgctgaataccattatcagaaatgagagagatggggtatgttattattccttaaaagctatatttgccctgattaattcagtgctatttctactgaagactaatttcaccccatctgattcaaccgagatgtgtaccttccttcgcagattctggttcctgttccacaatacccgctttattctgctgccatttccctctttggtggttctctcgtgccatactacttagaagaagaggctaactggggacttgacttcgtcaatctccgacagactgtggcgtcagcgcggtcaaagggaatcactgtgagtgttttacagaaatttgggagtcacggtatcttattcagtcattcatgcaattactgtaaatgagttcattaccatgttcctgcatacaaaaaacaataccccaagtaaaatagcaatatcaatgtaatattgatgagttcaagtctctctaagtggaaaatggtcactggaatcaacctcctcaccaccggccatcggcgtgttctcttgatcagttcaaatctttgagtcatttctataaggctttgttcaataattcatcaaaaatagaaaggcttatatgaagttctaaagcatgtatgattgaaacatgtcccttggagaggaaccaccgaaccacactcattctgtaatgttatactcctgtgtaagcagtaaggggtacatattgtttttgcatctggtggaaagctatccttttcttaaccagttccgataatcatatcctcatgttatcttcactggctcacctaaaacctctgctagctcttggacagaaacgctagccgttaggttggaggaacactttgctagtcattatctagcatgcaaaaagatgcccacttgatgatttatgtccatcagtacactttgttttggttcctcttttccatgcttatatttcttcccctttcttttattttcaatcatgctgtttgcataaaaatgtagcatttatactatctgtattcagctttgatgttattttttcttccataggttcgagcaatggtgattatcaacccaggaaaccctactggccaatgccttagtgaaggaaacataaaggaacttctcaaattctgcttccatgagaacttagttctgcttgcagatgaagtctatcaacagaacatttatcaagatgagcgcccatttataagtgctagaaaggtaacttttgatttctgacccgtgatgctttatcatgaatacaacatttcccaaccttttactttcatgtggtataccaaaaattaaaatgaacataataagttgccttcaagtaccagatggaaccaagttaattaatagctgctccttttgatgtggaaatttaatagtttttttcacttataaataactaatacatgagtttatgccctaatattgattactttgatcaattgtaaactattctgattgctgatgttaacatggactttctcaatttcttcaggttctgtttgacatgggtcctcctatgagcagggaagttcagctggtttctttccatactgtgtcaaaaggatattggggggagtgtggacaacgtggagggtattttgaaatgacaaatcttcctcccaaggtgatgccattatagaatatgtgattgatctcaaaagatcgtgattcaaatttctagtctttactatatagatttatagaatgcagctacacaaaaatgtagatgcagatactagaaaagatgttacattcttcatgccatgttgcaaagtctaatagagaatatgctagtttcttgttgttatatttggtccacagtaaaatagtgtatatgttgaactatgtaatataatccagtagcccatcctgctaactaggttggtgtagttacatttgttgcaccgaaatattcccttactagagtggtctttgtcagtctcagaaacttgagtatgaacaacgtaaactggagtttgcaagtttgcaactcttaggtttgtccaatttccaaactgtaaacttaatgtttgacaaattttgaagagcctttggcagttgaaatattaagcttttagataagattaagcactcgcacaagattggttatagatcatgtaatgtaagattttactttgaagtttggatagtagcacagataccatttttctgtttgcttgtgatctaattacgttcctcatttcatatgacagacagtagacgagatctacaaggttgcatcaatcgcactcagtccaaatgttcctgggcagatctttgtaagtcaaacaatattcattgtttttgtgcaattatctaaaacagctttccgttcttccagtggccaaaccacaagctttaaaactggaaatatgatatccttaatttatccatggagcattactcaaaatttcggtgccctgagatgcccaaaaatatccagattttttttccatggattgcaacaataatagatgagagcatctaaataatcccttatttggtcagtccatatgttggtgatgagcacaatggcttactttattagcatataatgctgcaccttgaaaatatgtctctgtgggctacagccttacaaggaatagcaaacatgcatttctttttgtgttagagttattcaatgtggtcttagttcctgaaacagtttagttgcaactgtactaattttcttgaagttatgttactttgctttaacaagttaataaaaatggttttaatgtcatttacagatgggtttaatggttaaccctcctaagcctggagatatctcttatctgaagttttctgctgaaaggtatatactttcccttctcatcattttaatccatgtctgcattttcaaggaaaagaagacctacacgggtattcagttattcagtatttatttcctctggtagtaatttcgagtgttctatgtataatgtgcctcctgatgatgttgcagcaagtctatcctcgagtctttgaggaggagagcacgcctgatgacagatggtttcaatagttgccgaaatgttgtctgcaatttcacagaaggtgacattaacatatgagccccttcctttatggcaataggagaaaatgaagcagcttctctaataatgctcttccaattatgttgttgcaggagctatgtactctttcccccaaatacgcttaccaccaaaagctatagatgcagccaaaagggctggcaaagcggccgatgttttctactgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13713 - DNA, 636 bp, Oryza sativa
attgtggtgtacttacgttgacgaagcagtcgtggagaagaggcggaggatggccggcgccgtgcgggggttggcggcggcgtggcgctccatgaccgagcgcacgatgctctgcgcgttggggcacgtctcgtcgtagtaactctccgtgaactcctcgtgaccgaagggatttggaaatccctgagcggcggaggcgagagccgcgacagcgacgagcagagcaacccaagcgacgccgcccttacacctaaacgccatggctgatggtctccctccggcctcgagagatcgatcacgatcgacaaagctccgaaacgagagatcgatcgagccctaggcccctagcttaatgattagcttcgccttggtactgacaaactccgaagtgatggtgagctctgctgctgctggctgctgctgattgcagatgttgtggtggatgatgatgagtaggaagcatgcgttatatagatggccagttaacgcgtggcgaacgtgcgcacgacggggtccctggtctctgcaagcgcaagaccagcaaagctcgtgcggcaactcgtgacgaggtcaccaacaagagaaaaaaatgggaaagtatagagaaaagaaaagtaggaaacgaaccaaaacaaa

SEQ ID NO: 13714 - DNA, 802 bp, Oryza sativa
aggaaatgtggaccgtggtcgccgagacggcggaccgcaccagcacgttaaacctgcagggcgaggtcatcgtaatacttgttgtacccgttgagcagccgggcgaggtcgtcgtagtggtcggcgccgccctggtcaatgaagaagtcgatgccgtccaccgccgcgtcgtcgccgaaggggcggtgcacgccggcgcggtggccgcctaggtaggcgttccagatcaggttgtcggcgacgtcagcggcggaggccttggtggggagggagtagccgccgccctggccgccgatggagaggagcacggtgatgcccctggactggcagtgcttgatgtcggcaccgacggcggcgagcgggtggccggagatgtcgagcgagtagcggccgtagccgaagacgttgtagaaggtgatgatgacggtgttgtagcggccggtgtcgcaggcctctctcagggagccttcctccttgtggcggccccagtagacggcgaggcccgggtcgtcggccgtcgctggcggcggcgtagcgtgctgctcctgctaaggggaggagtgcgtgcacgaggcccatgtgtaagttgctgtgtgctagctaggttgatggttttgccatgtatttatagagagatttgcaggtgaagcttcatgtcctcttgtgttgtggtgttcgtgcgtgatgtgcatgcgtacaagtttaatggattgattcgtccacgtggattgaagcttttgagatgtgagcatttgactctatgatcggcggctagttcgtcggtgctgctcgatcgaatcat

SEQ ID NO: 13715 - DNA, 312 bp, Oryza sativa
gaacgttgggccagtgtcggcttcggtgcgcgttcgagtcctcgaggaaattatccatgtccgccttttcggcggcgctccagcgctggccgctggtcgtccgcgacgatttttcggcggtcagtacccggcgcccttcgcgggtggcggcacgtttggccggcggcgtggcgaccacgggcggcggcgtttccggcctggccgccggcggctgccgcagacgggcctgcagcggttgcgccgcggcttgttcgccgtccttttcgtggcggggaaacagcaggacggccaggtgcaacagggcagacaaca

SEQ ID NO: 13716 - DNA, 629 bp, Oryza sativa
ggctgaggaaagagcccaggtgggaggataagacaacggagttgctatgtccgacaatggcaccaagccgtcgactttgttccattcctcgtgctacttccactcgtcgcacttctcataccccgagctccgggacatgaaggcagcggggagcaatggcatgtcaccatcgccatccggtcggtcaagatgtcggagcttcgccgctgctccagctctccctgcaaaaggcgaaaggggagagaaatagaaagagagagaagggagagagagagggaggaggaagaagggaaggagaaagagaggatgacgtgtgggtcccacaatatttcttttgtgaatgacaaatgggtctcacatattttttttaattctaatactccattcgttcaaaaatataacaatttttagcattcaaagtttgtccaaaagtatataactttttcacctacattcattctcaaccaatcataacctttcaccattcaaattcttcacatactttctcttctcaactaatcacaaccctcttccatttaatcaaacctacttttttaatgctcgtgcccaagcctaaaacttcttatattttaggacggaggtagtatcacataagcgtcacgtcaacg

SEQ ID NO: 13717 - DNA, 1399 bp, Oryza sativa
cggctacctcgtttgcaaaataaacaattggcaggagatactttgtttgcccccaaagaagacgacgatttcgttgtacgtataacaaattacaaatttaactagcatctgcttattattactatcctaactaactaattatgtttgtttcttatggcaatccaaggaggtgcgcattcactttatggatcgacaatgtcgatccaacatatgatggccaaaagataactgagtctgaaacacaagtagagtaccagcgagagaaggagcatcaaaaatgcaatacatgttgaacgacgcggaaggagtcggtagataagctcaagcttgatttgtcaggaccgacaaatttgtattttttatccatgctatcttgccattataatgtttcattattatggtgtgtgttgttgtatgcgtcacgaattataaattaatgtgattgtatcgttctgaattccaaagtttctttgacgccacgatacgttgtatccttataaatttataagtatctgcttatatttttataacttccactttcaattgtgtacatgattcaacatacgcgagaattatacgtaacttacaatttataggtaacaaaccccctcatcgtactttgttcgtttcaaaacgatactttacctaattttaagtgctaaaaaatcaggttcatgtaaaatacctatttcgtaaaattttaagtgcaaaatagttagatttatgtaatgaataatttgaaactattcctccttccatttctaaacgatgatttacgtagtttttaaagtcacaattaaatatttcgatataaaaacaccccttgttgggctagaaaccgccaaaacaacgtgccattcaattctaataatgtttttcttatttcacaattttaaagtgatgatttactaaattttctaaatgaacggagctaaatgcctgggggctgcccttaaagctggcggcccccaacacaatacataatcgccctccctaagggcggtaatggggccgcctgcaaaagggtctggaattttgcaggcggccccattaccgcccttagggagggcgattatgtattgtgttgggggccgccagctttaagggcagcccccaggcatttagctccgttcatttagaaaatttagtaaatcatcactttaaaattgtgaaataagaaaaacattattagaattgaatggcacgttgttttggcggtttctagcccaacaaggggtgtttttatatcgaaatatttaattgtgactttaaaaactacgtaaatcatcgtttagaaatggaaggaggaataggttcaaattattcattacataaatctaactattttgcccttaaaaattttacgaaataggttattttacatgaacctgaattttta

SEQ ID NO: 13718 - DNA, 19470 bp, Oryza sativa
tgtaagatgatattcttgaagtaaatctggctttgaatttatcatgtggatttggtttgttattcatttgatacctccaccattctcaaatagatgacattttggaacttgtgcagtcaaaccttgaaattttagctcactaatatatgtaaaaatatcaggatttgatatgtgaaaataacactaacaggtctgccatgaaaaataatttcatgtagttatattttttattaatatacaattagtgtaatggtcaaacatgtacattggagactgtgttattgtcttaaactacaaataaaaaagaagggaggagtaattttgtagccctatacccctatattatgtataatgtctcgcaatctgattgcacctaactattttattatgataatgtgctaggccaatgttttagcttcttcactgaatgacttgcacaatttttctgaaaacttggctaactatcctataccctgttgacttatatgacgttttgatacttaccttcccatttcttctcatcattcaggtattgcgaatgccagccacagcacttcttgttgatgaggtacatcaatttaatctccatacctgatgtattcgtgccactatttgtgtctgacctagtcaattgtaccacagatccattctgatatcttgcttctcttatgtatctttatcattgttagtttttgcttctatgttcaaatgtgttgggcttttcgcaaacgtgttagactttcagctgctcaatcaattatcattcactaattcaccaacctcacaaatcactgatgattttccttgcccactttacccatgggcatgctgcatgcttcacttgtacaattgcactacagatcatacaattagttcttcatgaatatcatccataaccatcactttcttgaccaggaaaaaaagcgttatgtaggtatcagattggcatctggtcaggatattttgtgccaacagttgatactcgatccatcatatgaaattccttccttggatatgccaagtgatgcaccagtatcaaatttgccaagaaaagttgctaggggaatatgcataatcagcagctctgtgagacaagatacatcaaatgttctggttgttttccccccaaagtgtaagtacagccatttctccctgtgtctctgattagatcttggtgcacctgaaggtgatattttgcttctcttctttgacatcatctgtttccttcattttagcactagaagaggagcaaattactgctgttcgggtgcttcagttgagcagcaatttagcagtatgccctcctggaatgtaagttttttttcaaggatgtaagttatttgtcctattattaacattgcaatgttagggtatttttactacgatcaccaaggaaccactcatttaaaactaatactgtataatgttggtgagcacttcgcttggacccttacaagctaatctcacttgcaggttcatggcatatctctctactccctgtactgatgccttcactggaaagaaatgcatcagcaaagcaatagatgctcttttctcaactaaggtttctaatgatttggaagatcatttggagaaaaacagtgaagaaaataaggagagtgtgaagccaaccctactctggagctgtgtgtatgtacaagagattatacaggtgcgtatatttcattcatggtagtttcaacattgttaaaaacatttgctgttcagatgtgcatatttatagttttataccttatataacttattttttattttgtcagggaacatctggtactgcattgtcatgccccatacctgatgaaaatatggactacaggagtatacttgaatcaacaaaaatggtacgctttcttctcaattttgtactaagtactaaccacatcagaaactaagccagagagtttggttaatcgtggatgttatgaaactgttcctggcttcctgccaaaatgggaagatttatttctaggttacattaaaaaaaaaaaacttagatggagtaacatatgcatctgtgcagccctggtgcagaatcattaatctttcgtaagctaaactgtgtttgagataactttagaggttgactgttcatttcaattattaccctaaaccatatgaaaaacaacatgcacctgtgttctttactatggacaacaacatgcatctgttcgtacctgatgttgcattgttctttttgcagctgttcactgatatttgtcctaatgaagagttcctgcctagaaattcagctcccaaatatgcttctgataatgactctgattctgcagagtaaatccaaacttgcaaaggtaaatattttcatgtggagcttacactgtttacacatgtttaattcattagtattggaattgaaaataaaacattctttgcacatgagttgcagtactcatagtaccttattgcatatgaaagtacgaaacatatcaaaacctttgcaagtgaaactttgtgcaatttaattataaatactgttacatataaaccctgtaatcaactatgagtttgtgccaaggaaattttttggtacaattttctccttaccaccggttaattgattaatattaacgtgtgatggacaagataaataccaagaaagctatgaagatttttgaacaaaatgccaggagacgcatagctatttcaacattacagcactaccaacagaacctttgatactttgatttcatctgctgctttttgattttattaattacaattccaggacaaaatgaccattacaaataagaaagtttgggcggctaaatatatatcaataaatagaatgcatatattcttttaaaagatcatattattaggtacttgaggtttgactttctggttttattaaatgtcgtacatgtttgattcatcctgcttttggaactttagttgtattttttttcctttgtccacatagatgccatatacagtacatccttactagtgataggtaattccagctactagtggtgcgaactcctgccttgaaccctggcttgggcctcagtctttttattagtattattttgaaatcttataatgcaaaagactaatgatggtgacgatagcaaatagataataaagtaaagcacactctttcttgtgatattcttgtgccataggcctatcgtgttctctcattaattggcttgcatactatactatactggttcacacggctgtcctttagaaaagtctgagataaagaaaaaccaggctgcatatattttacagtgatctttttgttggtaacagatgtttgcttgtgctgaatagatgttcttgttatttttggcagggctttgtattctacatgacagggttatcgttgaagatatctgttccatattacagtgttccccaaagtcacggtaagaaatattgcagcaagggggagccctttacgttggtgagatttgccaggtttctctttgactagattgcagatgcctacattgttccatcattggtacgacatattatgatactggtaaaacactcaagagagagcgatgcagatgtccttggcattttgacatttggagaacatcataccacatgaaccgcttagtgtgattactacatccatatggttctctgaattctatgctgaatttgttggcacataggagtactgtactacataggaaggatactgctgagttctatgctaaatctgtgtatttttggtgggctgcctgaatcattgtacaagcgaacgacagaaatggatatcaaatgaggtccctccgagagggagttgcattacatgcatccttatcgatctgcgcggtcaatttctgttgcaatgactgcaacaaacctacagagaatcctgatccgcatttgtttgtttgggagagaacgaggcactgcgatgaattttggcaaaaaaaaaaaggggggggggggggggggcggcttgtctatatgagattcgcatgattttttaggcttctatcatgcagtgtttcaccaagtagattaaaaatgtttcagtcttttaaaaaagccagaacacaactaaatcacatcatgaaacattttggtacaacgtatgaaacaacggttctaaatatattgaaatatgaaacaaatcctgagtatatctaggaaacgtctatatgagattctcatgattttttaggtttccatcatgcaaattttgaagctaatcggacgctgtttcaccaagtagatcgaaaatattttaattttttaaaaggctgatatataatcaaatcaccttgtgaaacattttactacaacgtataaaacaacggttctgaatatattgaaacataaatgatttagctatcaaaaaatcattcgataaccatttagtcttcctgaaaaagaaaagttgatgtaattctgtgttggttcttacattctgtcttctttgaaatatcttgccttaattctcaaatatgtgaaaaccaactcttttgaaaacaaaccatgcccaaataacattacttacacgtatcacgtatgcatggattgaagtattttgctagaggggttcaaattattcgtgtacgattatgcacgcgagagcgtttccaacaagttttcttttagtcaaaataaggaattatagttggttttcgtctctcgtacactttactaatacaatggataaatatattatctcatcaactcaactagtatttgaattttatatgagtttaaagattgatttagatttagattccacgtaatcgcgagagagagagagaagagaagagaagcgcgcagtgtccagacgcaaccgatcagtctcgcttctcgcctcgtctcgtctccttcctccgacgcgcggaaccttctagaagcttctccctccggtcgggggatgccgcgctgaccccctaccgtggttatgctggcgtcaaagctctggtcgaggctcgcgtcgccgtcttcccccgcctcgccgcgcgccctttcttcttcttcatcggcggcggcggcggcgaggtacctactgccgagctctgggatgccggcccaagaaaggtcgccgggtcaccccagtggcggcgacgcgcggcccggtgcggggctcgggctcgccgagactgggtgtggcgcggccggtgcgccgcgaccgctgccgctgccgtgctcttcttcgtcggacaatcccgcgtgagtctgcctcggcgttctgaatcttctgattctcttgtgctcaagcgcttgcaccttatctggatcactgaataggtttacgcatttagtaaatctttagtaaaatgtttgccccaaaaaatgataatgaaattgtagattcaaaattgccctattcttttgtaatctgttggcttgagctaaatttcgtgtttgcggtagggaagagaatccttgcacaagacagatataccaaagacagctaatgccgcatcggttcaagttatttttgggggagaaacgtcattttacatatgcaaatggtgcttcactgaatccgcagaactacagatatttttcatcttcttctggccaacagagtataggaattggtaacaaggtgggcagccatatgttaatgagcttctatgacagagcttgatatgttcagcctttagctttattaaaggaaaattgctgccatttttgttatagaagaattatttccttctgaatttattgactggaggcaacatgtttccagattatacatgaccttccaagaagtgtgaaaattgtggaagttgggccacgagatgggctacagaatgagaagaacatagttccaacacatgtaaagattgaactcatacagagactggcaacctctggattatcggttgttgaggcaactagttttgtctctccaaaatgggtaccacaggtaattttggtttagcaattagcatgcattagatacttgcttcttacacatatacggtttgatattttaaagatcaccatccacccatttttttctataatatttatttgacttccatgattttttggaaggatttttctacttgataattttaagaaaagtttggtgctagctctgttacaaatacagagcactgtatgttatggaacagccattacatgtggttatcgatcgttaacatgatcctcttattcccaatgatgcaattgcttcttgcattataatagccaatgtcatgtttcttccaaagtattaaattgttgcttctcttattaaaagccaaagaaatgtccttattatagaggacacgtgtacttttcaagtaactaaataaaatagatgagatgtagcaaacatgacacacgaacaagtataatctagaaataagcatatgcttgtggcttgtggcatacttatcattgacctgagcaaattatttcaccgcaccaagttccagttaacttgtaatggagtattggagtgagaagaaaaattgaaaaatgtaggagtatctcaataatactttgctgaacttgaatcattgtccatccattgtttccagattttatggttttgtatgtatattacttccattatctaacaaaaaaatgtatattacttgcttgctgctttatgtacttgaccattattttattataatctattttttatcctgtttgttcattggtttatttacccatcacatctttaccgttgagtttctcaataatttcttgtttctaattgtagctagctgatgctaaggatgtgatggatgtagtccggaatattgaaggtgtaagccttcctgtattgacaccaaaccttaaggtaatataatttgattcagataacttttgagtacatatgtctgtttacctcgtttcacatttattctgttcgttggtaatcagggatttgaggcagctgttgcagcaggtgcaaaagaagttgcagtatttgcgtcagcttctgaagcattttccaagtcaaacataaactgtaccattaaagagagccttgctcgctataaagatgttgctcttgcagcaaaagagctaaaaatccccatgcgagggtgagttatgtcacacagtagcctgatgttgcatcaagtttaatttctacatttgcaaatatcgggtgtatttgtatgaaatagtaatgagcaagtaaagtaatctggatttgatttattctgttgaataaccaaccagtctacctgttgcctctggcatcagctcactagctagtctagtgtatgatttatctttctctggatggtagttcagtttaccagagttttattccagggtagacttgtataaatagcttatacaaaatagtgtgtgttaatagtcgctcattgcataaattggtagtagatgctgacacaaagataaactggaaagtcttcacatacatggtttggcataatggtgtgggcaaatctgatttatagaactaccatttggttagaacttagaagagatatgtgagcataatcagttactgaacttaacattctcttcattttgtactggttcttggtgcaacatgttgatatctagttcctttacttgacaagaatataggtatgtttcttgtgtggttggatgcccagtagaaggatatgtgccaccgtcaaatgtagctcatgtggctaaagagctttatgacatgggctgctacgaggtttcacttggtgatacaataggcgttggtaccccaggtgatttcatattacctattttccatctcctgttttttgtgcgctatattatctatagcttcattcaactgctgcaaggccttagttcattacatttgttaaacaaaaaatatttcttgctgcggggggcagttttgcgctaaacagctcaccgctacaatcttctggagattgtgtgtagtttttctttaggagattgtatgtatagttattaacaggatatttgtttttcagtgcatcatgataaaaaaaattcctgttcttattaatacttaccagaaaacaagaaaacatcacataaaaggaaaaacaccatcgcgaaccatgtaattcatgtgaatgccagtagcctcttgcccttttatacacatagaagtttaagtttttgtctactagctttggtttattacccttcttctccagcttcatgatcccattactagccaggttttaaacagtttacttcctccatctatccaggcaccgttgttccaatgcttgaggctgttatgttctttgttccaaaggagaagcttgctgtccatttccacgatacctacggccaatcgctttcaaatatcctcatctctctccaggtaatcatccaccagatactaaacaaatcatcacacagagccaaatggttgtgaacttgtaacaacaaagaatcatatgtaatttccccaccaaaaaaaaaagaatcatatgtaattgatcatgtcctctgctctctttttattgtctcacctccgagtgcagtggccaggatatttattccattttgttctactggaaaatgctgcaagctttcttaccaacgattactgcatttgcctttgaatcagatgggtgtgagcgttgtggactcttccgtagcgggcctcggagggtgcccatacgcgaaaggtgcatcgggcaatgtggcgacggaggacgtggtgtacatgctgaacgggctggggatcagcaccaatgtcgacctgggcaaggtgatggccgccggcgagttcatctgcaaccatctggggcgccagtctgggtccaaggcagctatcgctttgggaagcaaggttgctactgccaacgcatccaaactgtgaggttcactaacattcactgatgcagtctttcggaggatgcgtttcagacatacaaatgtatacgataaataaaggcgaaattggttccatgctattcaagtgacctgggatttgtcggtgctagaaaactaaaatcgggatcgttgggtgatgtaagatcaattttgccagaaataaatggactgatgggattgttgattgatatatatggtcagcttttcctgaagaacttaagctgatgtttccgttggttcatgaaactcaatgtgtgtatagagccagaagcgggttgctcaatattgcatttgaacagctgcacatttaaaaagagaaggaacgggtggtatatttgtatggaataatcgacgatgacataactagaatgaaatggatgaagaggatagtagctttgagcccatttaacaaaaagacaccttataattaaaagtttagaacgaatgctacaatctcgctcacccaaaaaaaaaaaagaatcatcggttcatttccaacttcaaatcaaacgttcaaacagcaataatatcatttacagtagcttgttaaacacaatggtacactgctaatgtgttcctgaaaattgaacggactagtgcacgcaccctccgggcttacttcaattatatacttgatggcgcccatgaggaaataccaaaatgtttgcaccagtccactcaaaatgatcagtcagtcaagcctccctataaaagtcggattgtcataatgttttgctgaactcccctgatggcagcacaagaccttttccgtaggccgctaacaaaagggcctctgctcgccctgcatgagtgtaaaaaaaacattattgagctatagaaggaacatgtgtcatctattctcatggaacgcttgaattaaatggattgaagctaaatatgttacataaaaaacttatttaactcatccatgtaggtcgtgaattttaacacatatacaacctacagattcaatggacaatactagtagcaaatatgcacagtgcacactgtgaatgtgaagcatatcaggggtcgtttgattttgatttgatgcgcacctggaaagacagacaatggttctttgtattgtctttgacatactccctccgtcccaaaaaaaggcaaaccctgggtttccgtgtccaactttgactgtccgtcttatatgaaatttttttataattcgtattttcattgttgttagatgataaaacatgattaatattttatgcgtgacttgtctttttaatttttttcataattttttcgaataagacggacggtcaaacgttggacacggaaaccagtgtttgcctttttttgggacggagggagtatatcgcttgtttattcatgtgtatcagtcaagtttacttcaaatgttcagatgaactagcagaaacaaaaacatggcgagataatgaactattcgctaaaaataagatataatgaacagaaaatgatcttgttgcagtgaaaaaatcatttatattagcaggtatgctcaaggccaaaactgcgtgacataggcagtaaaagtttcacagtatgtaccatgatgtttcttcctattcagggacagggccttgtccgggaacaagattgaagcagcttgcctgctatagtcctgttatagatcataaagacaaccataagagggctatagaacagcaatgagttgatattctacttcaacactaaccatattgagttattgacattgaaatcatgttaggacaagatcaaaagctaacaacagagatcttgagatatgaaggtaatatttttcagatatttaattcatgaactttgtatataggaagtatttcagtgctctcccggaaatgaagaagagtgaaactgtgaattgaatgcctaatttgtgaccacactactgcactaccaacaactctataggacttcccttatttacactaccacactactgcactaccaacaactctataggacttcccttatttacactacagacaaaaataagcaacaaaaactccaggcccgggcacttctactttgttttttctttgtggtgtgtttttgtattgttttttcttccccttaatgaaatgaaatgcagctctcctgcgttttcgagaaaaaaaaaactccaggcccgccatatagaaacaagaagaatacagacagacacatgttatcttcatagccctggtaatgaagtgagacctcaatcccatcccatcttgttaaactccaatagtccattatacccaacctataatgtacttcaaccctaagccagctcccacgcacattttggcctcattatgttcatgttgtacagtgtgttcattttagttgacaccttcgtttaactaatttggatggcttgttatatattctgcaaaatctctccaatacctccaggttaacaaacaactctactagagattgtagaaacaaagagtcataaagcaactttatgttgcatacttccatatgacaagagtaacaaaccttaggtgatccgcttcgtgttagcccaaaataagccttccaggtctgtgatgcaactggaacaactgaaaaaccagatgcaactagagcagcaatccacaggccatacgaaaaacctgtactccaccatccctatatgaccccccaaaaaaaatcaccaacagaacagaaatttattgctgaaattcacattgcaccacatggtgtgattattcaagttatgaataatttcaaattggaattcattgttttagtgtaactctaaacttcagattatgtgagaaacatcctcaggaacatgatatctcaaactgtcgcaaaaattagttctattgttttccaccattgcaatcgtgcatacatcgtcaataaaaagacataggagagcactgctatccaattgcatacattctccaataatcaatgcaggggacattagtctgatactgttgacacaaggacttctacaaaatggctaaatggaaggaaggaaaagaaaataccagctttccatcagttggaaatgggcttgacttctcaatatatgccgtagttcctgcaagagagcgaaacaaacaatgatatcatgattagaaacaatgcagttcttcacatagcgcatatctaaaagaagaatgtgataactatgaatgaccataatgagtaatcataatggccatgtcccttgtgctgattgctgaacacaacacgaagcaaaccagcaccacccacaaaagaatgcagtaagcagtacaagttgcacccatctgttcataccaggaggcgcatcgaggccacggagcagctcgatgatggatttggtgtccaagcgcttccggatgaactccgagaccactatgtgcacgaacgggttatcaaacacctgcaagacatgaacgcctttgctcaagcacacaagttgtacacacagaatgcgcgagttccatcggagcaaagaaacccagccatacctgcgaggacccgtcgggcgagaggacggcgattgcgccgcccgtatcgggatccaccccaatcgcccagccggtggaggccgcggcggcggcggcggcggcctcgccgtcgtcgaccgggagcagcgagagggaggccagccaggggtccctcgtatcggcgtccgccagtagcttcgcccgcgccctggccctagccctagagggggacctggtgggcctcgtctcggcggcggcggcaggagcaggcacgcggcggcggcggcagcttcgggagcggaagggcggggcgaagaaggccgcggcggcgtcccagtgcagggtggagcggcggagtgcggtggagcggagcgcgttcatgtggtcctggctgccggcggggagggcggcggcggcggcggcggcggcggccgctgccataattaattaattaactcgaaatgagggaggaggggttttggggggataaggcgtcagaggaggacgcaggcgtgcgtgatgcctgcttgcttgctcacgaatctcctctccttgtttattttgcttcgtttttcttggttttttcttaattgcaaaagtttttttgtgtgtgtcgaattaggcatttctctttaaaaagaaaaataaaaaagtttcaatgtcacatcctcttcggaggtttagttgaagtgattttgtgtatttgatgtagtgaaaaatgaaattgcgcatgacaaatgtagtgcaggtgtagggtacataaatccaagaacgcatttgtcacttgcgacagaaacaatgccatttttatttagaaaagagatggtacatgtgtttttaatagaaatttagtaatgttaatgattaaccactagcttttatctcttgtcgatacacttttcgtatgaatttatcgagatttttatgttctctcgatattattgttagtctccgtctattggagcgtgtcatggtacataggcgtccttcacgtaatgaaaaatagcattggataaaatcataaaaatgaagaaactaagcaggaacaaggttttctttaccgccagatgcaaacagttagcacccagtaacccaaaccaagcataaaatttttgaacaaaaatttagttatttttgttcaattttatccggtttcagttttcctgaccgaaacatgattagagtacttatccatgaatcgatgctagaactgatcacgaggcacaaatttctaaagaattttacactatgattccaatgtttatatatcatctatcctacaagctgaatttggaattatacatcatctgtaaggtgagagaaatttaaatattgacatagataacccgttaactacggcaaatgtttgctgacttcctaagcagacgcctgacagctagcaagagccgagtggaacttctcatcaaatcatggtaccagtggcaagtgaataaaattagcagcgcaccatttcgtcgccaatctgctgcctaatggacctcagcatgttgcctcatcttagaaatatcaccaattctgcccgcaatgtttccagggaagtcgcattaagttagctcaacgagtctgcgcttcaaggaggatgttcgtggccgtgttgatgtcatttctggctcgcattagcgcctgtcttgcagcatttccatcaaagcccatcgaaaccagcatagcgattgaagattctgggggctccacgacaggagcgaatccagatggctgattgttctatattaaatagacagaatcaagatgtaagcatatagtcattggttttctttcaggcaatgcttaggaactcagagatgataaaggtttcgtgccttgtatgttagaaactataaaaattaatgggctatgcttgtatcagtagaaaaataattgaataacagtaacagatatgaaacatcaaaacccatcaagatgagacctgtaacttaagtatgaactttaagaacattgtggaccaagaccaaggaacaacaattttgtgctagtaactggagtcatcttaatcttgttgatgattacatatatggatgagtatttgatctatctatgttcacttcagttacaatggatcttcatcacatatgatggaagacatcacaaaacaatcataattgtccagttgaatcattgaaacatgcatacatggcagctaagtatatgaccaattactcaccagctaagaatccagatgaaaagatttatttatcaaaggatcaacatacacataaatcaaaacccaaacttagcttatcaaaaactaacctgcacagcacggcttgtacgagaactcatgtttccgaccagactcctggagggcctagatgaacctcccgaagaaggtgcgaaaattcttgcgaaaaatgatgcaataacctgtggcatctgtacaacgagcataaatagttagaactgcagacagaaaaataggcatgttttgagcctttggtcaaactctaaagacaaggaaatataataataaataaaagctctcctgccccacccacccccaacccccaccccaaaacaataaacttgaaaagaacagacaccagatcgtactactcaaaaccaagctagcaaatatccaacaaaaaaggggaaaccaggaataaacaacaaaatgcaatagcaaaaaagatctgactagatgtactttcacttaattctgcctgcagccatatgtatgtcaacatggaccatacaggcggtccgtgctgttcttttcttcgaaatgattatctgatatttaacaactgtaggtggagcaggtaatgactagctccagcctgatattacttggtccagttgattccatatcatattgcacacagtgagattttattaaaaaataacttctgatgccatgactcatgacttgtgactacaatagttctagtatatggaattaaatattattccaagtaaccaggcgactaacagaaaaacaacagaatataattttagtggtactgacataacaagaaaaattaatatagtatgaataagggagaacttaccttcatcctgcggatgccaagcacgttcagacgatagagagaaccagcaatcagaccacaaataccaggaataagagaacgcttcccagaagataaaagcagctgccaagagtaacagggaagttgtggcaatgaaatacttaagcgtaaatgacagataagtatccatttctgtccaaaaaaaaaaactaacctgcaggccagctaggtatatgaatgatttatcactgaagttaacaccaaaaatacgaaatcgtgatgtgacaggaatgtcaagaaagaatggaatgaatgaggcaaatataaggccataaggtccacatgcaagagtgctgaggtagttggtgtctgcaaaaataaataagaatatcaaaagaagctcaataatgacaaataaaaaagtcaacatttgccacaaaattatgacaaaaactgcactctcaataaatttcaaaaactcagagaaaataatgctcataattcaacagctaagctcatgaaaaataatcgtgaaaaagagggaaggaaactaacatcagcatggagcttaatgtctcgaaagaccactataaaatggtgaagaacaataaatcaagagccctatagcataatatggccagaaacaatgtcttggaacaactggatctagtatgtcacatataatgaatctctctaggtagcaactacctgacttgaattcataacatattgaatcaataaatttgtatttgcttgcaagttgcaccaaatgatgcattgcttgctagttcattggttgggtgctgatatttatcacaattcagcctacaaactactcagctaggttctcaactatattgttttttaagatgtataccttgacattttcttatctagacaacagccaatcagtttccagaacatccaaattataacagttgcagaaagcaggaaaatgaaaacaatgttagtatgtaagcatcattcataactactcaaggaaaaggaatttaaaagtatgttcttttcttaaaatttaccagacaatgctagtcagaaatttgtctcattgtcatacctttcaggagaaccaaagataggatctcaagaagcaatgatactgagatagtgaataaactaaaaacctgcaaaatacaattaaaaagcaattatatcatgatctcttactagcaaatttgtttgaacaactatttcttcttacaatggaagttaaaacaaactaaatatactgtttattccttcatgcattatatatggccctaaaactgagttgattccacacttaggctcatgacttgatagagtatttccaattgcacattaggtttttacacttcagaagcatttcactaaagtctgcggcatataaatttacagtgcgttatatgaagcagctaagagcaactttaaagttcaaggtactagacggtaaagttctcgagttccactgtacaggttcagatgcaatatactcctgcttctagttctaccaatataatgtaagttgtttatcaatctccatttcccagaaaagaattgatctcactctttctaccatactattactgttgtttatcaattcatttcacagcagagagaagtacaaaactgaggcacttaccgagtatttgttagagcctatctgcctctcgaaaacacggaagtaatagagcaggtagactccaaacaatagctccggtgttgactgaaaggcaaacccagatgcaaacaacttccatagacggaagtttttgacaatcccctgaaataacaaaaatgattgctttacacatacaaattacaaaagatccgtcataccacggatgcagcccaccttaagttttgcattaaagaagcagaaggtgaagtacagataataacaagaataatttaacggtgctgcagcagtgcaagctaacaggcacatgagaaatactgtttcagagctactattgggagttaactatcattataactataaggtacacacatggttaaacatatataagtggcatggtgcaactgaaatgtcatgtttgccaacttatcaacataaaatcatgtcctactcattattaacatgattagtttccatgtaagtttatatgataagtaaaactttaactcgtagtctactgtccaaaaagaacatatgatatattcaattacaacggtgatgaaacatctatatgtgctagttggtctgaagatggttctttttcttcttttcgggttgtgtacagatatttcccagactaactgaatcctaagttgatgtacacattttgcttctgttctatttgcccagagatgcactgcgtgaccgcacacccctaacagttcaatccatgtcttcccacagatacagtccatcaataagcaccagctactgagcactcctcaaatttccagaacggaccaaaatctgcaatctaacatcaccttggaacaacattccactagcaaatttcacccactgattcgccaacaccatagactattaaaaacaaagtaatcaggcacatcaaaacctatgattcagcgatcgtgcattcatgaatcttaatcaattagtaacccatgaatcaggcacttaatcaaagcaacacaacacaacgctcgtgacctaaccacggaacagctgcctgaaaaaccaatcgagattcggcgcccggctatccagggagggagggagggaggatgacctggtgggagaggacgagggcgcgggcgcggcgctgggcgctgaagacgacggagaggaggccgctggcgaggacgacggcccgcgtcaccggcgcgttctctgcaaccaaccaaagcgaaaaaacaaacaaacaaacgccggggaggcggtcaggcacggagtaaacggggcggaattccggtctcgattccggcgaaatctgagtggggggagggaggcggcgcttacggaatccggacacgccgccctgcatcgctcctctcgtccggaaccgatcgaccaccgccggggtcgggacgcggccccccacctctccgcggtcttccgcggcgagggttcccgtcaacttggacgggaggcaggctcgcggtcgcgggcggtccgacgaggaaggaagcgcggggtgggggccgtgcgagaggtgcggcgaactcgacggcggcggcggcgggcgggcgggcggagctcgggagggaggaagggggaagaagagtcagatgaggcgtggcgtgttttatgaggcggaagagacgaagagtcgttgacggtggagggggggtggttggctggaactcggctttggactctcctcctcctccgacctccggtgtggagctttctagaaatcacacaagtttgctctcttcgcatcagttccctacacaaacttgagaagcctttcttaaggtctatttggattgttatcataccaattttttaaaaaaaacttagataaattttggtactaccaatttttttttgttagggtaagattgtatttggtttgctacaaatataaagccagcacatgaattctagtgaagattgttctaaattgatgccaaatctagcatgggcattaccaataaattggtctcaatcaaaacaagcacatgtactatttaaactaccaaaatattggtagggctaagttttggtagcaatccaaaacagcccttaatttgatttctggggcggggcagattgtagccaaaatattactcaatattaccaaaaattttggcaggatttcttacgtatttactaaagtttggaaaaaaaaactaaatatatgcacatctttggtaaatttactagaaaataatatggttaacatcaatatgaatagcccctctattaagtcaaccgcaatgccaaattttaataacgtagctaaggttaagatgtgtgaatcgtgtaaaaaaaagtaggttaaggtgtgtgaattgtatctggtttgttactttatttatatcgaagaaaattttagaactatcaaatctttgtagaggctattttgggtactactacctccgtttcaggttataagactttctagcattgcccacatttatatagatgttaatgaatctaaacatatatgtctagattcattaacatctatataaatgtaggcaatactagaaagtcttataatatgaaactgaggaagtatctaatgggg

SEQ ID NO: 13719 - DNA, 6636 bp, Oryza sativa
cccccccccccaattgaaagtccatccaacactctaaaacttaaaacgagaatactgttcatataacaccctaagatgattttatcaagtggtttttatctaacttgcatatatgttgaatgagtttgaccatgtgacacatgcattgcacatatatatgttaaaatccttgcctaaacattttgcttttaccttttttttctctcacttacaaaccaatgttgatataatactagtatgacatcactatagagggatcgatgaatgacgatatataaacatactatgttaattattattcaaaaccacttatttaagctccaaatatgcaaaattactatccaaaactatcttatggtgtaatataaatgatattgtaaaatttgaaaggttgaatgtttggtttcaaagtttggtgtgcttcatggaagtacagggagtacacagacttttccctttcggcaaccatgtgaatttaagtttgtattgaaacttttaaacaagtactcgaaattctatataaatttgctttagaagttctaaaattggctccatgttctataagggccagactgctctgaatgtggcaatgtttgggtgtattagatggacgactattatccaggtccttaacaatcctatggcaaaaaatgggacaactaaaacagtaagtccaataaccaacatatattctgcaaaaattatctatgtcttaaaaaaaactatgcaaaaaagttcactctgctgttgtacaaaggaaaatactcttttactctcataaaaaggttgaaactaaattgaaaatggtactagctgtaaatacagagaaaatttgtcacaatgatacaaatatagcagtactattttgttttgtaagaaaaaaacactcgctccatctcaaaatataacaacacagtattagattatatgcaaatagttcatagtattagattatacaccatgttcacttggagaggagaggagagatggctatctcagcggccgtgcgtacagtggaactttctgttatcttttgaattgatcaaatcgttctatagttaaattaatttgctcaagctctaaattattttagtcttaatttcctcttctcatcgtcttcagtttttcagttaatttttcatgttccatctttatcaatattagtgttcaacaattttccatctttgagtgcccatgtcatcctcaagggtgactcaggcgacgaccacccgcggcagtggcccaccacccttccccttccttccccctcgccgtcaccgatgctagccgccggtctacgtgcggtgacaaggaaggcgacggtggggccgcttttcctctccagatctagtcgaggctcctcgcggatctaaggcgttgtagtttggagttcgcaaggtcagtagcaacacttgcagcagaggaggcggcaacccgcgtagaaggaggagacagagtcgacgacgacggagttggcggtgacaaagtttgggggtcgagctgttggtggccccatggacagatctggtaccccatggccggatctggagaggctggcgccttcaacggtaggagagcaattccaaggtgggcagggctgcagcagccacaggcttcgcagtggccgataggtcacggcggtggtgtgctggagttgctacggttgcaggggtagagttgaagccgccagagcacctagaaagggtggagttggagttggagccgtcgacggatttgtctggattggcgtatgttgagggtgtccgcatttgcaggaattgctcgtgcatagccgcagggcaacaacatcatggtgggcatcggctttcttggtggcttcaaggacggcttgtggtttccccctcgactgaccaatctccttttcccacccggagctcctccccttctttgtatcgctctgcttctagatcccggtgcagggagccccatggtagtaatgaggtttccgtatggtcaagcagggttcccacaatatgctaaagtttgagcaaccttcggcgtcatcgtcattttctcgaggtctgcgacatctaggtgacatgtgggggggtgtacctagggattttggtggttttggttggttccacccacggctgagctttcgcaagctgaggtgaagtcggagctacttggtgtgacgagcttggcaatgataacccctcaggaagtgtagttcaacgtggatggaggagcagtgttgtatgcccctgaagtgcagtgtcatcttgtgttgtggtggaatcggagctgttgtgccgggtggcaagctaggcaatgataactcagaacacccttgtcttgttctttagggtactccctctgtcccaaaatataaggaattttggtgggatgtgatatatcctacctgtccagattcgtagtactaggatgtgtcacatccctccaaaatccttaatattatgggacggagggagtaatcaacaatcgagagagcccaactgcccaaggcggaagcctttcgtagtctttttggtgatggtgatgttgacgcctttgggtgccgtgttcttcttgggtgcatcattcatgtgactctctcttctttaggtgaacacctagtttggtgctacagtcaggcgtcaaaagcattcttgatgttgtttccttgttggaggcttcgattaatagttcctgctcctgtggtgggtttgtttgaaggttgtggctcttcttaagaagtcggggcgcttctcgtctcttgatgagtttgacaacgatgacttgagtcgtaccttagtagtcttgtagtcgttggttgtttctcttttttctctatgtgtaggttttgacggttttccttataaactgggctaaatctccttcttaatatatctagcagaactcctgccgtcggtgtttttttaaaaaagtttttatgttcctaggtgacatcaaaaccaataccttgacggcctcctcgtttcatgcaaggccatcagttggcgccaacgcacgccggtgtggtttcctctccaaaattaaggcgtcccctctcccaaccgcacgtcgcgcgttccctctcctcgccaccgccgtcgccgccgccgccgccgcgccgttccccgccccgaccagacgaccgccgccgccgccgccgccgccgccgcgctgccccggcggcagcgccgccgaccgccacatgacacagcctccccggcgacccgacgccaccgagacgacgaccgccttcctcggcgccgcgtccacaccgagcccgcggcccgcgccggccaccccgctcccggacgccccgtcgttcctgctcggcccgtccacgccgctccccccgccgctcccgccgccgacgtcaactgcggcggcggcggcggcggcgaaggcgaagcaccagaagcagcagcagcagcagacctccaagcactggtcgcggccggcacggttcgtgcggtcggtgcgcgccgcgttccggtcgttcccgatcctcccggcgccgtcgtgccgggggctgccgtcgctgccccacctcccgggcctccaccacggcggcgcgggcggcgccgtcaggaaccacttccacggctccacccgcaccacggggacgctctacggccaccgccgcgcgcgcatcaccatcgccttccacgacagcccgggcagcccgccggcgctgctgctcgacatcgccgtccccaccgccaagttcatccaggacgtcagcgccgccggcatggtgcgcgtcacgctcgagtgcgacaagcagcagcatcagccgccgccgcacgcgcacccgccgggggatcccctcccgccgcggcggctgctggacgagccggtgtggtcggcggaggtgaacggcgagagcgtcgggtacgcggcgcggcgggaggcgacggaggcggacgagcgggtgatgcggctgctgcacgccatgtccatgggcgccggcgtgctccccgccgtcgccgccgacgcgccgacgtcggcggcggacggcgaggtgacgtacatgcgcgcgcacttcgaccgcgtggtggggtccaaggacgccgagacgtactacatgcacaacccggagggatgcgccaccggcccggagctcaccatcttcttcattaggacatgatcgacgatgatcactctaatttatttaggtttttctttcttcttcttcttcttctttttttatcttggatcatattgttcttgtttgataagtgtgcctcatcccaaccttgtgtgttttcctctatgattgtttgtgtagattattacatatcaatggtttagtctagattgcatataaagaaaccatgtagagaatgaaatactagattgaaatgttcagatggaataagcttgattagttgatcatgtgttcaattggtgcatatatgcttacattgtattgggaagtcgaataagttacatggtgatagagctctacgcctccatgcctaacgccaaaagtttttgttaagcaaaaggtatatgaagagggcaaatctattattctcctttcaaaaattgatcgattgtcacacattaccattcgtgttgtgattcgtaacgcaaaggctaaattttggcaaataatgctctgctccaatgaagtaatcttgtcaagtttctaggggtagaaacatatcgaactaatggaggcctcccatatcaatgttcatatgttaatgataatgaatacacatcgaattaagatattcatgtactccaatgttgtgagtaggaatcaatgttgtgaagaatacaaatccaataaatgcttcatatggttggatcaaattaatatccaatccaacaacataataaaggagttcagtgaaagaagtttttaaggagttcaagagttgcaaacttctcccaaaaaaaaaacacattgtcttcctcactctttgaaacccaaattaaatttcctttcttttcgttgtataaacaattggttatgaaatcataatactttgagatccctcaaatttcttacaaacctttctccaacggtcgacccaactctcacaaacacagccgggaagccaatccgggcctcaacctcggcctcagacccatgcgacatcccctctcctacaccccctctactcgtacgaccaccgaactcatcgccggtccaaacgtgcttccataagccgccatctgacatgggaaagtaggcggtcaccgtgctcctccccttgtccaagaccggcaccaccagcatctctgtcccaaccaggaattgttggtatgtcatcttctgcacacgctgatcctccgggtagtggaggaagaggtgccgcgccacgggaaggcccttctccgccgcctcctgagaagaaaccagttgtcaggataaacaactaggtagtacaatacaatactgtgtaaacatgatacaatatatgggcaatcacttctaaatgggcaagtgatttcatcccttgaggggatatcctctcgtttcgtgtatgccacctaaatagtctttaaaaattttgacaaaatttggtaagatagattaatatgatatagtatatcactccacaaacatgcaggttaaaattcaactcctacaaattgtaacaaaaataacaaatataactgcgaatgtacgataactatttttagtttattttgttctttttgttgcaacttgtagaagttgaatttggtttgtatgcttgtggagtgatatacttcatattaatctatgttgtcaatttttttaaaagatttttataactatttagatgacatacaaatataataatatttgcatgagagatgtccactcgttatttatgtcctgtaacgtgcaccgtgtaaactttttttttccaggcacgtgcaaaagctttgcaatgacataagagcgagaaggaatagagagtggcgtgtcacgtgtcagttcagtacctcgacgagctggatccggtagaactcccaggctttgtagatctttgcgcagcgcgcgaaatgcgcgagcgtgcggttattggagtagaactggcagttggatcctggcttgttaccctgcacatccaaactcagaattaattggatcaatggatcatcttgctagctagctagctcgatcgaattaatcagctcattgtttgatcagcaatggcgtcagctgatcagctgatggatgtatatatatgtatgtacctcgtgggtgcggaagacgacggtgaaggcgctgagctccagccatcggaggaggagctcctcgctgcggcggtagcggaggagcggcaggtcgacggtgcagtagccgccggcgtcgccgtggttgagcgggaagccggacatgccgccggtgaggaggccgacgacgctgctcttgatgccgtcgttcgcctgccagctcaccatctggtccccttcccagaacagcatcgcccacctcgagctctccctgaaccccgcccgcacgaagaacaccagctcgccgtcgccgtcgccgtcgtcggcgtcgtccgcgacgcggcggtgctcgccggagcgccactcgtcggcgaactcgcggttgacgcgcgcccacagctccgggtaccggttgtgcgccgcgacggggccgtcgtcgccggagccggaggagtgcagccgcgcgttcagcgggaggcc

SEQ ID NO: 13720 - DNA, 4990 bp, Oryza sativa
cgtcgccatgatcactgatctctggagctcaccgggacgaggcatgggttgcagtaggtcatggtcctgacgccgcggcgccggagatcgcggaccagatcattccatccggcgtagtggtcgtcgtctacctcccagttccaccatagctgggatccaatggacgtcttcctctggccaacccaatcctgcatttttgtgaaagaatttgtccagagcttggaaattggatcatggagagtttacttggttcagagcgctgaatgcatcaggatcatggtcttatcattatcgacagtcaggggtctaaggccatcaacaatttatcatgacaactataacaaattttaactggtggagtttcatggtagttgtggtttcacacaattttttctaattaattgtgtattgtaaggttgtttccttttctttttaaaacggggcacctttattttttatataaaacgtcggtaatggtttggccattcaaaaaaatattgaacaaattttagttaaaaaataggttcataagacctaaccaataagaattgtggcattttggtcaaacgcatctaaggccaagtctactatataattttattcgatactacgaagaaagccttggcattgggtctacgtattagagcaagtttaatagtatagcccactactagctccaaatcatctatagcccatgtaatagttaattcataaaatagtttgcttactatactattaatatttgatctcacctatcagggcatccacaatggttatctataaactctctacaagagatccatgtcagcatattttcctacttgaaagagattaaatgaagcgagagagcaaagctatctactaacatggagatagtctatagagaaaaacgaggcaatggattagagagctatagatacccatgtagacataccattgaagtggtttactattaatctagtctattgctgagatgtacatgttttatagatagcaccttactttaccattgcgggtgctttcatacacacattacatcttagagtttgtgctgtagctggctacatatctatagcacgctgctattctctctctttctttttaaaatatggttatagctggcttatagcctgctattgtacatgctattagaaggctagtagatgctaaaataacacaagaactgattcatgtagagacatatatttccaatggataaagaacatttctttttactgtcactaagtttgttacttgaccttcgcatgataagtagaaaaagacaatttcttttgtttttagacagaaccgataaacactagcattgtttctagcacacgtactagagagagagaaaaaaaagatctagcacatgtatgacaaatttatctactacaagtcctatgaatatgatagggaatagtagcaaactttggcaattgcgtagggaattcagctagtaggttcagagttcagatcgaatgcaacaagaaactcaggttcagagagggagagggagagggagagggagaggttgagacctgcagccagaatgcagagaccgggacgtcgtggtcctgcagctgcttccagacgcggcggacggcgtccgtgccgccctgcatcccgaccaccgcgccggacgtgatccaccggggaagagccggcggcctccccgtcgactccgtgtagctcgtgatcagctccgtcggcgagccgccgtgcaggatcctcccctggactgaactcccgtacacctgccagattcattcagcacagaattgtaatcggcgaattgcaaaagcagaatggatgtgcgagttcttggaattctgtccataacatcgatgaagttcttggttttatgattgaaaaattctgagatgcacttgatagtgcagtggtaaagggtgtgtggttttaacacgctcacaatttcttcttaaaatgtttggagggatgtctctccctccaaatctcctttttttttatttggaaaatcgcaaaagcagagtgaatgtgagttcttgaaattctgtccatgaacatcgatgaagttcttggatctggttagtttagctaatcaagtattgacagttcagaatgattagtcagaaattcaggattcagaaatgtgtttagggggtaatggaatggctacctgaatctgcactctatcaggctttgtcaggtcaaaaatggagtaatcgtatccctcgaggtacaaagatctcatctttgaggtcatgtagaacggagacggagcatacgtagtactccagtttcctccagacctatacatgacgaaacaaagtaataaaccaccatgaacaacaacatactaaaaaatgcatatcaagttatccaaaagaagagaagaaaactcgtagaaatcatggatcagtgctcacaaatcgacaatttgacatgataatttctctcaagagaagtacaatctgcacaagaatttcaagcacacacgcacaagctacaaattctctaaccaaggcacaacggtcagtcactgtcgctgcggtttcagagttctcatctgcaggccttacaattcctagaattatttggtgatttctatcaatgcaatgtcgttttctaccttaaattgctgtactcttcgagctcatccaaatgagctgcaagtggcaacgcctggataactactcctagataagttcaggcaagctctcaatgcagttcttgacacttgcatggcaatctggcaatgaggattttcactttctacttactattcaactacaaaaacagtaactttctggagtactttctattgcttaccaagacgcaaagaaaccgaatatgtgaccgaacggaccgtgtcaggaccggtaacatcaaactttgaaagatcttttgttggttgaagtcaaagtttggtagggttaaaaaaactggaataagtcatgtacataataaggaatatgatcagtgcggtcgatttttaaagaaatctgttcaatttcatgggaattcggaaattttccccgtactcaaaaagagctctgatctccttttgagaagtactcacatgtcacaagaacaagaatgcaattttcctagagttgatgtggtaaaccgggaagtaaaaagaatttataaatgataagtgaaaaattgtataaccatgcatgacaccgttgatgtaccattaactaatatttttctattagaatataaccacgacatataacaaaattataatattataaaaatactccttccatcccaaaatataacaatttctaaaatttaaaatttctttcaaatataacaacctattaccatcaaaagataacctttaccactaaactacccatactatcctacttcctccgttttatattataaaactttctagcattactcacattcatataaatgttaatgaatctaaacatatatgtgtatagattcattagcatctatatgaatatagtcaatgctagaaagtcttgtaatatgaaatggagggagtagcatcaaaagatagtttcccaactagtaagggcctatatctcactccccccgaaaaggcaacaagacttttcacccctccccttaatagtcgtgcaaattactaaaacttgatatatttgaaatggaagtacctataaagaaaaacgtactcatacgatttttatttttccaaactaaaatcatttatcatactaatattttgagaggtagtattaatgatcatagtttcaatgttggactaaatcaacaataatacgtactacctcagtttcatcgtatcctcagtttcatcgtatcgtaagttgttttgacttttttttctaaatcaaactttatcaaatttatagaaaagatatgcaatattttcaacatgaaaaaaagctattaaaatactaagtttgacttaaaaaaattaaaatactccctccgtctctaaatatttgttgccgttgacttttttaaatatgtgaccgtttatcttattcaaaagtttaagtaattattaattattttcctatcatttaatttattgttaaatatacttttatgtatacatatagttttgcatatttcacaaaagtttttgaataagatgaacggtcaaatatatttaaaaaaaatcaataacgtcaaatatttagagacggaggaagtaacttctctaatatgaaacggagggagtagagtaccctgtagctgccggagtattgtggattttgacttgttacctgtagctgacgaggttggcggcgaacgtgatgggctggtcgcccctcccgatcccctgctcctggaccaacaccggcacgcgcttccccttaaactccacgcggctgaactgctccccgaacccgtagaacctctcctcccgcgagctcgccaacgtcatccacacccggttgaactccaactcctccttcgccgccgccgctggcacgagcggcgcgagctcctcccggtcagccgggacgcccgcggcggcgaaggcgagcttcttcttcttcttgctgccgccgctgctccgctgcacccgggtggataggcggagccggaggatgctgccggcgcggtgcgttcttggggaggtggagggggatggcgatggcaatggggatgggtgggtggcgtggcggtcgtggtcgcagctccattggtagtcgccgaggttgacgcggaacgcgacctgcgtgtcgctcttctcctcgaggaggatccagtaccgcgccgagaggaccggccgtccggcggcggctgcggcgcggcgccggccgcagaggcaggacggcgagggggtcggcttcctgacggacacgacgccggtgatcaccaccacggggaaccgcgcctgctcgtgctcggacgcctggaacgccgcgccggcgacgcgcaggaggtcggcgtcggcgtcggcgtcggcgtcgcggcggtacacggcgcggatcctgtcgacgcgctggcggtcggggacgaggcgggc

SEQ ID NO: 13721 - DNA, 2819 bp, Oryza sativa
ctcgcggagcgcgaacgagccgcggcactcgtcggcctcggggtccacggaccccgccgaaacaaacgcgacgccggggacggtctcccacatcgtcgcgccaccgccaccacggcgaggagccagcgacaccgcgccgccgagggacgggtcccagcggaggaggaagtgggggccgacagggaagtcgtgggcgccgtgggcgagcttggaggacggcgagaaggagagcggcggcgcggcgtcccggtgccggagggaggacgacggcacggccctcgggaacgggttgttgaggcggacgtggtccttctttctggtcttcggctgcgccggcgatggcgtcggcggcggcggcggcgccatgtctccggcggcggtggcgagagaaggcgcggcgcgggtgctctgcttggcgaggcgagaagcagagagccgattggctgaaatagattctggaatgaagggggagtgggggcccaggtggtggtgggcctggagagcacgcgctcgttttgactgaagtggattcgtgtgaatttaggtagtgtttggttggtgggatgggatgggacgaatctacttttagaggtgtttggttgaggggcgagtgggatgggttggtccctagagaggaatattcctcctagatccgggacaaacacatccggcaaaatcggccagacgagctcgtcccacttggacgaagcacacggcgtctcctcggcgaccgccggcgctcgtccgcgcccgcgcccgccgcctcctctgtgaccgccggcgctccgccacgaccgcctgccaccacctccacgaccgccgacgctcctccatgaccccctgcctcaacaccggtcgccgccacgagcgagatgctctgcgccatcctgccgctcatcgcgatgctcgacgagagcggctgcggtgatgtcgacgtggcgggctcgagtggcggcgaagcttggaggtagggagggcggcggcggtggatccagaggagggggactcggcggcggcgaaacttggaggtagggagagcggcggcggcggatctggcgcaggggatctcccgatccagccgcggcgacgatggtgggccagcgggttgggtgctccgacggtggtggccgtcctgctgctgccactgtgcttgattgtggcgcagtcaacggtcgttgacggtgatggcaaacaatgtccatcccatctcccccttatcccttcaaccaaacaaaaaattaggattgtcacatcctacaaaccaaacacgtgagtggaatcatcctaacccaaaatcagatatggtttcatcccatcccatctagctggatcatggatggagtagcaattttggtcacttccaactttgccatgtgtttatttggattaatagcattttttaccctgtcaattttttttggcagcttcaatagtaacgtataaaggcccacagtatttgtattataagttgtttgacttattttctagttaaacttttaaagtttgatcaagtttatagaaaaatatagtagtattttttttaaaaaaataaatatattataaaaatatattcaatgttagatttaatggtactaatttaatattttagatattgctaaatttttctataaacttaatcaaactttatgaagttttattagagaaaaatcagacaatttataatatgaaatggagggcatatgaaatttggtagtgccaaaagttatcaaggttttagcactagcaaaatattggtacgacaaaaattggtaataatccaaacaagcctaatatctattagtattaccacatttttacaaggtaaaaaaaataatcttactattgctactttaccaaagatcgataaggcttcaacccaaacacaaaaatactatcaaaattcggtagcataaaaatgtgccacaatttagtacttcttaaaatttgataacgttaacaacaaacaggacctaaatgcgctcaccaatgttcaggccacaagattctctccttgcgtaaacagtccacgtggaatggcatactggcgaggtaaataatttaagaatatcctaattaccttgtaagattgacagatgatacggttttgtatttggcgccaaacttgattttgaaaagtttgacccaaatatattctaaatattaaatatttatgtacggatggagtataatagatctacaatcccaacaatgttataatgcgaggtggagcagaacgacgcaagagcggtggagagtgtgtcgtgggcagccttggatgcgcgccgagcagcggcagcagcgaccgcttctccagtagttgggtcaacgtcggatccggaggagggtgtgaaggaattgcgtacggcgtcggcgacggctttgacagcctcatcgatcgcggcgttagctgcatcaggaaacaacgctggcttcgacgtggtgtcgggcgccatggagaagaaggaatagggtttaggtgttgtcgacgtttgatgtcacgattccggtatttgcacagtatggggatcgttggtactaggatatatgcgagatttaagtaaaagagacggagacgaggattttttataggttcgggcccctgaaatgtcaggtaataaccctatatcatgttggccaaagccggtattgcttttattcaccataatcataccagtataatatttggggtagtctatctaactattgtcgacttggcagtctgtagtactgactcgtagtcgataacagggtagtcttcctcctcgaatccacatccagtgagatcagagacaacgctagattcctctctttggttcccg

SEQ ID NO: 13722 - DNA, 16331 bp, Oryza sativa
ttttatatcgaaaattaaatggtaatatattctggtaggaagtttcctaggtgaattttattttaaaccattatatatatattagacatattgcgaaaggaacaaccatacacgtgaagctagaatgggactatagaatgattacatgtttatgatttatttggtactgcacatgtgatttggtaagtcaaatggagcaatggaaatgcttggaaatttagccccatcgttttgcttatacttaaaaatttagtcaaaatttaaaatttaaaactaaatctttcgagttgaatttgtggttcttttatcatcatttattttaaattatttacttttgaatggcaaaggacacacatatgaaaatcttaatcacaaattgtttttctttctaataagctgtacggataggaatagtataagcaaaatgatgtggctgactaaaaaatttaacctatttcaaatataggcttcacctgattttatacgattgtaaattcacaaatatttttggtttagtaagattataatcacgaaagtagcgataatatttaaatatgtaaattatgtgcacccttcaacatgcatgatggatagttattttctcaaccaatttggttattattccggggtgtacatatcaaatttactgtaagaatctaaactggtcaaacctcagaaatgtaaacggagatactccggaactccccataaattaccgaagtttatggtaggattgctttagtgtatattactccctccggtttcatgattcctgactttttaaataagtttaagattaaacttttgtaacttcaattatcgttaactttaaatatatttagtttaaagaaactagaacaacatatatatagatttatatttcaaaatactactctctccgtcccaatttcatcatcacataagaattttaaagtcttcccaaaatgatcaaacaagtgactatttgtttatttgtgcaaagagtaaataaacatcattgaatgcactgcatgttaccaaccaaattaatttctatcggtgcaaccgtgaaatatttaaaacatgaagcaattcatggaagacgatgcatcgtagcaccttaattgatgataattaattatagaatgaagatttttattgtccttggtctctgcgctttttctttaaaaaagtaaacatgtatttatttgttgtatatactccctccattccataatataaggcacaaccatttttttagatgttccataatataaggcatacatgcatgcatacaattaactatgacatcttctccattaaattattaattctttaaatcattcactcttacatcctctaattctattagatgcatgtattgtatttattaggatgatccaaactataagatgataataattatttcttggtctttgggttaagggtagttgtgccttatattttggaatggagggagtattataataaaaacaaagtcatatatatatatatatatatatatatatatatatatatatatatatatatatatatatatatatatatatatatatataggagactgtgtcattgtccaaacattaagaattatgaaaccggaataaatactgtaatatgctttgaattatgcagatttgctatataaaagttatattattagatctgccactgaaattgtttctatgatgttacactcttactgaaatatttttatatagatatataaaaagttaaaaattgaagacgcacaccttagttaaaaacatatatgatgttaattttttaggccttcgagatatgactgaccatatttttttgttagaataatatatataataagtttgattactaattcaaataaatctgcatatatcatttttatgtgttcatgctggatatttaaaagatattgatagattaattaagtttatccaaggcatgtatcacagtcatggtgcaaaatcattaggttaagtgaatgaatggcaggagtacagcccagagttcctttctttgtaaagtttgttgtcccgttgtgaataacaccgtgattgtggaaaggtgcatctcgtatacaaagttagccgtgtacgttcatgcttagtactcctagcaagtagctttggcaacaaccgagcagaagacaaagtaaggatgaggcttcttacaaggtacttctattaattaatggaatgaatgaatttagctagaggcatgtaacgtgccaaaggtggccagatgcaatgaacctagtagaggtttacatataggacaatggatatgtgggcgtaccgttgaagtgatttaattcggcaccaagtttttaggaacaaacaacttcttctaacaaaataaatgaattgatactctcttcatcccaaattatagcaacctagaaacagatatgactcaaacgaatctaaacagaaagcctatccaaattcgtaatagtattttgagtccatctaattctagattattctatcatgggacagacgtagtacaatttggaactccgtctctaaacaagatgcataggttccctctagtcattaatatatgactttttaacactagtttagtgttaaaactgttagatattaatgagtgttaaaaatttcatatatgaatattattggagtgagtatattataggacaagtgaaataacttacactcccgtctgatcatattaatatgttgataggggattgttgtgatcctattatcttactcaataaagaaagaaatcatatgactagatggtttcataccacatatcactatttggatattacctccgttctcaaaaagatgacatcaaatacatgcagccaaagctcgaacttttaaatcagtcctagattaaaaaatatattagaatttaatatgttcttttcatgtattttctcgtaacgagttttataaatatatatttagaaaacatgtgtatcggaaaggggcaatttcattcttacccctacttcgatgttcatattgattttgccccttcggaaattatgttgatgttcaaacaatgagtaaaaaaagaacggagcaagtatataactgctaggaaacgttgaacaagattagtagttattcaacgaatttcagttattcatgtgtgctttaactagatgggatattcgttaattgatagtagtactacttagtagaacgtaattcagcatgagcttcagtgatccatgtgaccatgtctatgttacagccttacaggcctatatacgtaagatcgagatggttcatccattggcgtgcatctggacgttttcgcagctgtgttcatccatgctaataagcttcagtatagcatgaagacacgtccaaacctctcgcttttatggagtaccttgcatctgctcgttgcttatgaatcttcccgccatcgtggaaatgttctcagtagaactgcatgcattacaagcgtacgacagtctgtttgtcatcatgcaaacgagatgtttcactgaagtactcccgacgtttcagattataagtcgttttgattttggtcggagtcaaattgcttcaaatttaatcaaattggtaaaaaaaatagtaacatttttaatccaagataaatatattatgaaaatatattcaattatagatttaataaaactaatttgatatcgtaaatattactatatttttctacaaactaatttagagcggtttaactttgaccaaaatcaaaacgacgacttacatcaacatcacaataaggagagatagttcatttaggttggactcttggaaaaggccgatgatcgaacaccatgaagaagaagagagaatcttaaagaaagagagaaccggcggtatacctatacaacttattacaaggattgagttcagaagttcagattccttagattgatagagaaagtgtttgtggtattatatagaaaatttatgtccttaattgtgggttgtgaatagaagatataaggtgaaaattaagacctgtagcaaatctaggggtgcatttttttttagagggggtgtgatgttgaacgtaataacgtttggaaattggaatatttgatctcgaaaataacatctagagccattcattaaaattgttcgaccaattaatttctaagaatggctttagttgagttttttttttataaaaaggacaaagggggaagttctcattattttttactatgatttgactgcttatacatagagtataactaaaaaatcagttgaatgtgacgtaagatttgcgcaggttcacaacgcagctattttacgtaagttttactagaaaattccacaagagttacaattttttttcatagtaatcagagttaattatcgtgttccaacatgaatcgatttgcgatttaggaattctacaggatacatgaatcgatttaactaggtgaaaccccacgcattgctgcggaaatttagtatgataacaataaaaaataatgtgtaaaatagctagataacatcagattaaataaattaatgtggtttatgataatttaaatttaaatagtacgtagaatggtgattcaaacgtaaaaagtaagctagtatgactttatggaagaataaaagtagggagatagtttggaccgtagattaatcatctaaaggctaaaaataattgatgatatgacttaattagaggaaaaaaggagaaatataatttggatcatagattaatcatttaagtactaactaagtgaggatgaactatataagtatataggatatcataaaacataataaagatatacattgaaacattatgtgaattatgttgcatgataatttaacatgtttgtatttaaaaagctcttaaattataaaaactataaagatataacatgtttgcatgatgtttaaatgtgatgattgttagtggatgatgatgtggcatcttgttaattagtgtatgatgatgtggtatcttgttagtggatgataatgtgacatctttgcatgtcaagcttaaggagttagtggaaataactttatactacctccgtcccaaaataattttatttctaggattgaaaattcgtcccaaaataattgtaattctagagtactaattgccccatcaatcatctctcatttaaatttctccctattttaacctcagccatctttccactctcacataaacaccatttaataagggacaccatagtctttcttttcaatttcaaaccttaatatatgctaaacaatatagaattacaatttattttgggatggaggtagtagtaagataggattcctacgtcaactagacgagatttccacgctccactttccaagtccagtctcactcacagtcccgactatgctaccgttcaaattcaactactacaaggacacgaccaacgaagccgtcttatggtgcacacgcggaaattcagaaaacgggggtagcacgagggtgcaaggaaggaccgagcgtttgacgcgaacaagagctggacgagatggaaataactgtccaaaaacttgctacaaaatctaaacaaaattacaggcgaaagaaacattaacaactactcctgaatacttactagtaatacttactactagcaggggattactctttgtaagtgtccgcctgtcaggggattacgtcttcccctagcaagggaagattacccccaatgtcataacgagttccaacttacaacgtgaccacaaccgaactgtctcccagatataccagttaattaggcagtaattgtgtaatgtagtaggggagttgacagctcccctggcaaggaattaaaccccatgaaatcatttctggtttcttccctagcctacatttactgctaaattagcaccaaaacaatgttggcaaggaattcaagtttgctacgcttggttcctgtgggaggggattgaaacagtggataatctcctgtaacatacacgactgtcagcattgccgaatgtgctcaaatatcaaggtgttctaggttgaccatgcttgcagcattctggatcagttgcttcctgacatcaacctgaaataaaataaaaagttctgatgctaaagcgagaatataatatgttaatcgttttttagaatttagtaaacttagctgcttacccgggtacccataagagatgagaacacaacgttggcctcagcagcatcttcaacctttagctgcttcaacatcctcctctcagggtccattgttgtctcccataattgtgccggcatcatctcaccaagacctatttagccacaagagaaaaggatgcaaggcaaaatgtctaccactgagataacagaaacggatgaatctttggatatgtaacataaaaaaggtgtatagtatacaagattgcacaaagcatatttagtaacaatttcatgtgcatgtatgcatgcatggtacaaagactgagcactaataacgttttgttatgaacttaaaagtcagcatttgagcataagagtaaatgtagcagtatatgcatgttttttggctcaagtgtacagttcaattacacgtcatatagagcgccataaagatagtttggtagatgagaaaggggcacattgcatgcgatacggtgctggaaggaactggggggaagattagaacggtagaagtggagatcaggcagagtacatgaacaaggagctctcaacagtaatggcatttgtgcattctctagaaacgtttgtgcacaaaggtgtgtgcatagggtagagggtggaattaaagttgacttggttgactggagctggaggtaggaaagattaatgtaaatattaacaaagtgttatgaatactgatcaaatatggataatgtgttaagttgggaaatcacagaaaatagattagataatcacattgaaaacttatcagttcataattgtcagaaaaatctacagtgtagctatttctacctaagcacggtgatgtattgtcacctagcaaatggtcttataggtagacgagttcttcactagatgattcaaaagaacaaaagataaacttggtacaatatcgtcaattgagatggctcagcacaatagcatataaaaccgcatcaacaaaataatattggggataacaaatagccaaatgtactgagaaatgactgtgatgtgttgacagattttctcaaagttcattgcactcattagttgattgattcaaatgtttgtacctttaaacctttggatatgataagaagcatttgttgggaaggtgttaactagctccttaaggtcagcatcatcatagcagtagtgcgcttgtttcccacgttcaacctaacaccaaagataaagatcaactacaaacttaagaccagctcttccgtcaaaatttgaaggactagtgttgcatccacaatcaaaccttgtaaagaggaggcacaccaacataaatgcaaccttcatcgaatagtgctttctgcatagacagtagtgttagaacggaaaacatgccttttatggttcatagtatcagcatctgccatcataatatggtatggacagttgccatttaaaacacatagcatactcttctaaaaaaatgttaacatgataaggctcaaaactaacctcatccagactgagattatcataaacagctaaactcccacccactgaaactgatcttatgcaaactacaaccctatccattgtcaagccttagttgtacaagagtcaaaatacacaggcaaaaccagagaacaatttatttgaagttgcaacacctaggatggcccctaacagatcagccataactccagtttgatcagtatcagaaagagggtagaagtacctgatatctaaagaagaaagtaaggagaagagtccggatatgtgcaccatctacatcagcatcagtgagtatgactatcttatgatatcgaagagcttccttgttaaaatcctcgccctgaaagaaaatattagagaagaaaacaataacagtagaagtttagatcaaaacagtatgcacctttactcctaatccaagagcgacaattagattttggatctcttcgtttttgtacaaggctgcctcgtctctcctttcaatgttaagaattttgcctcttagaggcaaaatagcctgcatccattttcgaaggtatacttagatctaagtaaatgacaaaacatggtgtgcaagtccaaacatgcttaatatagaacaatagattatgactccttatgagatctcatctcacattccacaataaaggtgtctacgtaacaaaaaatggacacgctgctcttgacaattatgcgccaacttgtgctggtcctgctcgacagttgcagagtgtttactgatattctttgtagcttaatttatgtgccaacaccagccggataattatgtttgctgagattgttggcaagttaacaaactgaaattgtatatagtattctgcagtttagaactacatggcagcagctttgaacgaagaagaatttttggaatactgatttacttattctcgaacaggaaggaatactgattttgatggactaataagagagcatccatttgacaaaaacatagatactctatttggccaagctccaatatgggccagggcctgagccagggttccccagccaaatgaataatgaactttggagaagctcaaattcaagcaggccaagtcccaaatatttgtggagtctagtttctccttaaaccagctactagagctaactggtgccagaggctcagctaaacatggccttagcaactaaggctgtgttcgggagggcaagttcccaaccttgcctcccaacacggaaaacaaagcacgcgattatagtgagattaattaagtattagcctaaaaaaattgaaaaatggattaatatgattttttgaagcaactttcatatataaaactttttgcaaaaaatataccgtttagcagtttgaaaaccgtgcacgcggaaaacgaggggaaaagaacacaacagacaggcatccatgttggacctagaaatggattgctttatatacaaaagaatgacaggagggcgagggcactcgtgctcttcctagtttcatgtacattatattagaaaagaaaagaacacacaaagattggcttacaaccagacagatttcaattatgtaaacagacaaattgaagcaatatgttctccatttttaagaattttcatggtcttcttaataacacgttgtccattccaacactaagcataactacttatgaacaaaaggatgaactaaccatctcaaaaaaaaaaaagggatgaactaacttaggtatatctatccttgatggtacgacaagtagaagacatggtctaacatttttagagttctaaagcataaattgatgcaatggaagtttttttttaagaaaaatacatatattcaaggaaactttgaaagggtgaacaaaaaccgccaatagatggaacaatgatcaacacatcagctgatcaggaatactaacagctatgcaaaatagaattagtcaaatcaaacttcttcctttagagaaggtaaaacgacagtagatagctataaacatctactcttggctgtatatcatgaatattgcaattcttctggtgtagaatcattgaatgcacattagcgtgactagactggcaaaaaaaatggtatacctgaaatttcctatcacgtccttgttttgcactacccccagctgaatcaccttcaactatgaagatttctgaattcatgtgtcataaccaaaggtcaaagtttagaaaaagtagaatacgcataaatcatagtttaaacaaaaatatacactacatttgtcaggcatatatttaaaagaagagttgaagaccagggagaagtcaaatcagaagggccaaccaaaatggtatcaataagatttgaacttgagccacttatgatgcaagggtttcatggtacaagcagcaacgcaccagattcttcaggatcactagatgcacagtcagctaatttcccaggaagtgaagaagatttcaatacactttttgtcctcactaactctctagctctcttagctgccaatgcagcctgcaagagaaacatatgccatgcattgaattagaattacagtttttgaactcctgggaagggctttttcatccactgagaatagaataggaaatgtcctttcctacactgtcaatcagattcatgtcaaagtgcatatggcagactgtatcttaaggaagcaggataaaccatttaagttatcgtttataacagattatgtaccttgagagcattaagggactttgacagaatcgaatctaaaacatctggatgtaactctaagtactcagttaaattttcttgaacagattgttcaactattcttcggacttctggatttcccaacctcgtctgtgaaaagagaaaagaaacaagatttagccaatcatcagcacttaaaagacaaaagttatcgaatcattcttctggcacatttgtctgtatcaggagcaagctgttacctttgtttgcccttcaaactctggattagggaccttcactgcaataatgcaggtcattccctctcttacatgctccccactcaagctaatatctttatcctataaaaagcattatatgttaagataaatcccactaaaaaaattaccaatacagttaattaaaaataccatttgatcagatgaataagtatgctaaaaacatagtaataaatagaattttccaaaatatggatccaaattccttactttaaacatttcaacattgtggtcttttagtgggaaggacagaacaaaattaatatgtaacttatcaccttaagagtcttcgacttctttgcgaagttattgattgttcttgtcaatgaagtcttcagcccatcaatatgagtaccaccatcaatagtacggatactgttagcatatcctagcaccgtatcagagtatgaatcagagcacctgtaaatagcaaacattttctgtttcagaataaggcacaaaacttctatctagctgctattcagtaagacctagaaggaggaaaatgaagagatagtgaaaaaggaacagaacataacaacatcacatgacctttgaatctggactgtgggccatcatttatgaaatttacaaagtttcttgacttcttgtatggttatgactaaaggtactgcacaggcagaaatcatttgtaaaatgatcaataccatttaattccctttgccaactgatggataaaatttcaacagtttgaacagtgtgaaacttccacacataataattcgaagggcgtcaattaacttataaagtacatattgattttgatcacaaaaaaggactatttatgtaccactgcatttatagcccttcaatactttgaagttattctaagcacattttttttcaaaagtttaggctaatttctaaaaaatatagcaatccagtagtttgtcataagctgtgatttttttttatcatccagaaattgaccattttgatgctacctaagatcattcattttagaacatgtagtggtactttggtagaaaacacaatcaaaaactttgaaatcaaggatctgatttataaaatagacaagacagccaacaaaagtatcaacatgttcaaccaaatcaagataaactgccactaccagctagcagatgaccaaacagaccatggaggacatgatattaggactttttatttctttttctttcaaaaattcaagccaaggaagtacattttaccattgaagggaaacatccactgttattccatccatttcttttctgaatgcgattggatcatgaagggatttctaggaaagaaaacatgaccaagcaaagtattagggttgctgctggataacattataaatgcatcatgtattgctatgtgcagaagtaggactcatcactcatatagtcatatctggtggcatattaataatagtatacgttacattattactctaaaatttaaggtagattaatgtaagtttcttcaaaggaataataaagaaattcacatgacaggaaaatataaccaaaataaatatagatccttcaacattttaaaatatcgtaaacataaggcaagtgtagattcagcctataagcatactgtctaattcaactctgtgaattttgtccaaagaataaagcaaacatagcatatatttcttcatttcattaccgtattagcatcagtatgacaggagttggttaggtatgcaagtttgctcacttgtgtgcccattaacccacatggtcacaccattcaactaaaagtgttttttatattgcatataaaattataaaccaaatagaatagcatggacgggtacccgactacccgtgggtcaatccacttgcatccttagcgttgattggtttatgtaaaattttagctcggatccaaggattaccatcagtaaatgttaactacaatgtgtatttctctttttagttggttgtcgaaacaaagatagaaagaagtaaagctagccctgatatttttaatgagtcatttgaaaggatcaaataagtcaattcgtaacaacaggtactactatgttaggagccattcaagtagcagatatgaaccattttctatgttgaaaaagtgccgaaatggagctgcatgaacatgtttccaatggtacaggtcaaaccttgtcagtattcaaccatttaacatactcaaccagaccaccagcataacagtattcattgtgttgaacctgtaagtcatcttcttcctttgtcaatgctattgtcagctggcattgagagaataatatgaaattagacattggcctactttaagaatatcaaatattactggtgaggtaagttgtgcatacaaattaacattaaaaaagaggcataaggatgttcaaacaaaactgccaaagtggcaactttccagaattttgaatgaacatatagggatttcacggaggaaaaagttccaagtaaaacttgacctaagttaaaggtgaccgtaacagcaccaataaatgaatgtgacaattcaggtttccatcatagcatttttttcaagtacattgattcctaaacttggttttgttacttttatcatcaatatctatgggtgctctccacaaatataaacaatcatagctgttgtggactcccatattacatatatcagataaataagcgttggcattaaattagagtacatggagagaagaacaaactatatataacatgatttgtcttgattgtgaataagtatacaaaatgaattgcatccttcaatgatgaaaagataataacttgtatgttttttctactgattgaaaaaaaacaggattaaacatattcccatggtgtgtcactaggaatcctagctcccaagtgtgtggcctggttttaagccatgggtagagcaatggttaaaagtaacttcttagaatatcaaataatccaacagagcaatcatgattcaagcattagctgaccgataaacaaataaaggaaataatgattgttcaatgatatcttcgagaactagcaacaggaaatataaaacaatacaatttatacctcaggatttagaaaggcaagttcccggatgcgaccagctatcgtattgaagtcaaagtccattgtggtggtaaaaactacatcaagaacaataattacacattggggaacataagtagtaatggtacagctaaaaaaatatgtaaagacagaagcatactatgtttatcaggccaaaatctgatccgtgtgccttgacgagaacttgattcatcagacaatgtcctactagttagcatcgtgatagcttttccacgtgagtaattttgtcggtattcttttccatcacgccaaacagtaacttctagtgcctgtcattataatatcacaacaaaacaaattatcaatgtaagctcatgagtaatatgtattgtttttgtcttgagactggaaggttggaaggttcttaaacttagtgcagagtagccagtatacgtaaagataaagccacatgaccagatttgtattttaaaccaaaacctgacaaaaatgacttcgtgtagagactagaaagagtttttctgtctgaatcatgattgttgaacttttatcaagagatgctttcattttcttaagaaatcttagaataataagtaaataaaggtgaaagcaagaacctctgacaaagcattaacaactgataggccaacaccatgcagccctccagaaacagtgtagccactctttgaacctccaaatttgccaccagcgtgcattaactgcatggttaaaaaattagattgattggcatccaacatgttgaacactgggtatgccaaatggataaacaatgtcgcacatatttgttttttagaaggtaatgaattaacaggtctgcacagaaaatgaacatcacaacacatgtattgaagtctggatatgcacatagcaacagcacacaaacaggccttaggattaaggtgtggactctgacacctaaatataaccatgagatagcatgtcatatttcatgctccctccctagaaaatgaaatgccccatgggtttacttatttgggaaaaagacggttgaaaaatagaaaaaaataatacagttgattgaatctaaaaggagtataacaaaaaagaaattaacagtaccgttaagacggtttccacgcaagatttcttcgtctgagggtgtatatctgtagggatctgcagtatgcgtaggtttaaacagtaattaaataaacaattgacagatgatccacaaagagttacaagtgaaagatgctgcaagtaaatagtcaaaaagtgtgataagcaaattataaaaacttccaggaagcaaatgtaaaactacaaaatttcaaacaaacgatgacattaatagtctagcatagttattcaatcaacaaactatgcaaaatggactcgaactgcatagtatcaagaaacatgttctgcttcccaccaagtcatccctccatccacaaatataagggattctgtatctttgtttacgtatctggacaagtatttgtccagatatatagccaaaatcccttatatttgtgaatggagggagtacttggtacatcagaatgtgttagcagcataaatttaacctttcgtgtaactatgatatatagtaatgtagaaaagcttcctccatgtttgttcacttcttcttaatgtgggattactcaatacaacagtaactaaatactgtagctgaaacatgagtgttcatcattaacacaaggtcgtcaaaatttccccaaaaaatgcattggccatacaggaagtacatcttgataaggttttaggaactacataccccacgaccattgtctgttacactaactgaattgtcgccatgaaggataacatcaaccttagtggcgtagcctgcttgagcttcatccacggcattatccaatatttcataaacctgtgatacaccattcagacgaatgatcagaaaagaacaatatggaatactttgtaccacagaaaaaaaacagtagcctaatctgcattcaatataccagatgatgcaaccctcgtgatcctgtgcttccaatgtacataccaggccttgtgcgaactccatccaatgcttctaagacctacaaaattagcagttcagcatgcaaccaaaataaagctaaaaagtacagcttgtgtttgaaaagatgatggtgtcagataggagaaatcttgaacaaagctgtgaaggtatacaatgttatatttatttgctttcaaaaaagataattgaattttaatactaagctgagttcataagtccaatgactacgctgttgagctaatgactaatttattgttggcttctgacgtctggatacagtgtataataaagtcctttggaaaatgaattagatgtaaagagcattttctagacaaattttcaaggacataaatactaactttaggttgtaacaaacttaaacagtaacaatcttatcccctcttacgctccatgaaccaccatcgaagtatggaatccacagtatgtgaccatggaagtatggaatccacaatatgtgctaaagaagatagaacatttgcatggcatataaaattgtatatattgcatgttatttgggtaaacagctcacaaagtcagataatctagtatcataagagttaaatatcaacgaaataagaatactccatgagaaaaaaaaacagctaatcgtcatgttaacagaaatcgtaagatgaggaaatcttccccttaaacaatgagcatga

SEQ ID NO: 13723 - DNA, 19642 bp, Oryza sativa
ccccttaaacaatgagcatttgattgcaccagattgatttgtaaaaataaactacatgttgaattaataaaagttatgaaaaaaatgcatatgtttgcaaggctaattggacaataaatttaactaccacttacatataactacagaatgagacggatgcttgcactagcaagtccttgcctccttcccacccaatctcatctctttgaatgctatgtacatccatttaaaatcccgggaaaatacactgattcgttggccccctaaatatcaaccttagctcttagccacagaagcccccatcgtgcaagagaagcgcacgagagcgaatcacctggacgttcgcagcggtgtactccccggccacccgcttctcctgcatcgcctcggaagccgccgtggatgccatgaaagccctcaccgcgaccccattccgccgcagaggagcacccgccgcagcagccgcaaccgcaaccctagagagagagaaaaccccaacgttaccaaaattaacagcccagaataatacccccattgaagagagagaaccccccaacccgaaaggcgcgcacgtctggattcccttacctgggcctgacgaggaggcgggcggaggaggaggcggggagcgggaggaggcgggagggccgaccggcggcggtggagaggaggcggcggaggaggaggcgcaggtggcgcggtggcggcgacgaccggaggaggggccccatcggcggcgggcggcgcgcttcgacgtgcgtgcgtgcgtggccggcctctcgctgccgctcgcttttgctgccgctgttgtggtgagggtgaaacgggagggggaggggaggggacgctggggtttaggcggagccgcgtcgcggaggcaggcaaagagtggatgaggcgaggaggtcgagggttttagacgagcgggccgggcttccggatttccgtcggggcgggcagtgcggggaaattggaaaaaagtccacatggactccctccaatatacgccgtgtttattccaaagttgttcctcaaacctccaacttttccatcacatcaaaactttcctacacacacaaactttcaacttttccatcacatcattccaatttcaacctaacttccaattttggtgtgaactaaacacagccatagtcaaatctaatttataagaaggacctgactacacagctagtggtagctggtttgtctaaaccagctaccactccatatatgatagacactatccaactatacttcaaatataattttctctaaaactgcttatccgatctacgatctgattacaccgttgtgttcgtaacaattaaatctttataacaagatatcacatgattatattttgatgaaaaaatataaattaattttataatatatctaaattacttttagatttcactaagttactttttagacatataaaagtaattcaataaagcctaaaagtaatttacatatactatagaagtaacttataacaaaaagaaagtaacttctataatatatgttaattactttaaaactttcttgaatttacttttatatgtttaagaagtaacttagtgaaatctaaaagtaatttagatatattataaaagtaatttgtgattttttatcaaaatataatcatgtgagatcttgttgtaaagatttaattgttatgaacacagcggtgtaatcggatcgtagatcggatgagtaatttaagagaaaattgtatttgaagcatagatggtaggaatattttttctacttgcttgatcaattagtactatagtaaagtaagattcttcaacacacatatgacaatggctgattgtatctggacaatggctagcgttgctcgttatgactaaattgagagcgctctcgatttagattttacgttataagaagtatctctcaacctaaaaccagatataatatctcttccaactattaaaacggcgcaaataaacttccttgactgctttgaaggtggttttcgctgtcgtggcgtccacgtagtattccaatcatcacataaattaaaaaatagacgtacctgaaaatggtctaaagaagcccattattgcttattattgtaggcctgttaaagactgaaaaaatgtttgtgcacctcttgtgaggtaaatcagcggtaaatagtttgttcgggggtttgtgatggcataccattttggttgtaggttaaaccacatctgcgaagagacatctcactcgagagcctaaaaagaaatatggccatatgggtgtattatataattatggcgcttatgttttttttccatgctcttttctaaatttactcctgaattgatgtgcaagttgttaaagggccaatttgcctagtaccatcacaaaaaacacggagttagaaaataccatcgtatgtgtaattgacatgtgggtctaggcctcacatgtcattatcacgtatgattatattttacaactcacatacctttgcgatggtacttcccaaattttcccattgttatctcagcaaccattgtcgtggaagttcatccattagatcttaccaccaacatgtacagacgcatctcaacgtgtgtccttttctatcataaaggcatctgatttcaagattcaggatttagtattgacctaccaaatgaggaggtaaaaaaaaagaattgctactccatcttatattactttacttaaacaccgtgggattgctgaagaattagcgcgccacgtcaacgacgtttttgcaaaatggtcctcgaatttccagttaattacgcgccagtctctgctaccccaccgtccgatctcacgttgcgattgatctggccatacacgtgtcccgccatggcggccctttcacaccagtgggatcgtcgaatcgcgaacagacggtagagatttcgctagcccacaccaaaccatagccctcttgctcgctcgcttgcagcctctcacgcgcgccgcctctcccttctcctcccctcgcgtgcgccgccgctgccggtgtagcccgcgctcttctagccatcgtcgccgcgtggacgagagggacgcaagccgccactgccctcttctcccttttcatcccagctatccccgccaggtcgacgaactctctcttcgacgggttcacattacactattataggcgctaacatgtgtgacaataaaaagaatgggacccacataccaatgactataataataatggtattatggtagagggtcatcatccgtctttgacacccgcaagcaatgtccatgcgaaatcacatccttgcttacaaatcaccaactacgtgccaaccataacgcgtcacacggataccataacgcgtcacacggattacaaaactgtgaatatacacatcatcagaacaaatgaaatcgaagaaattccatgcgtgcgaaccaggtaaacttggttttttgactcaaacctatcatgcttgcatggatagtgcaggttgtggtttgtgtgctcacgcaaaacatttacggttttacctgtcaatacggttcggctcatggaatgtgtgtgcccaatcgaccaaccgtatttggtgacatgagcaagtgggagcgaccaactgaacgtgtcaccagctcgatcataacttgtaacctgcccagcgcatttgatcatttccaaggacgactggggcccaaccaaaggcacatgagagtaggtacaatagcagactattacctctgctattagccagttataaacatattttaataagataacgataagagataaaagcagcggactttaagggcaagtactatgagccctttatcactaattctaagatgccatgtagagtcatatgatgatgtggaggagagaaaagaagagagaggagagcagccacccctcatgcaagaggcaacctccacaccaatttcaagaaataagagagaaagagagaagttgtttggtagtaaatgtattgggtgtagtataggtagatgcaatctattgtatgtattacctctaaattaatatgtagatgatttggataaaattagatgtgaccactacctctatcataaaacttgccctaaatctattgacagctgcagcacagactctaagaacgcaatgtgtgtataacaggtgggaccatatattaatagtatagtaagcaactactgtatgaattggctattagattggttatatgtaaattagagctagtagtgggctataccattaaacttgctctaataacttgcattcaagactccaacgaaaaaatggtagccaacaaactgttttttccttccaaaatttagtgtcgtgtagcatataaatctgcaaatatataactagattttttttgaggagcttcttatcaatggtatctatatatatcatgtaaaaactttatattcaattaatatatttaccatttcttttgctaacatagagtaatcgaggaaaaaaagcagtggcgggcaaaatcaactccaaaataaactttgatgaccgctgcgggattgatggcggcgcgaagagaggagatcggcgaggcaatggcgggtgatggggaggagaaggacatgaaggcggtggggagaaggaggacacgacggtgtttggtgaggaggaggacaacgcggaggcggtggggaggaggcgatgcagcagcggtgagtgcgaaggaggacgacgcggaagcgatggggaggaggcaatgcagtagcgttgggtgggaggaggagaacgcggcagcggtggcaggtcaaggagattcggcggcgcggggagtggcgggaaggggatcgagagcggtagtagtgagtagcacgggcgaagtcttcgcgcggtgatgggagcgaaaatcacggtggagataggatggagttgctgtgcgagggtgaatcgcagtgtacggtagggatgagagcgatgcggatgagatgcagatggatggtaggatcaacatgttgatttagcctgtatgattgcaaagagataactcttttttttattagtaaatatttaaatggttatttagtaattaattatcattcttaggcatcagcggagccatatgtgttggaaatttggtcataattcggcatattttaatccaaaataacaagataataaacatgatatttacaataggatttgatccagtgatagtgttgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcaacaacagctttggaaaatggatgaaagtgtgtcttctttttctcgcgggagatcaaatccattcccattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaaatgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaattttcaaggctcatgagaatgctctctattccatagcagcttttatataccagtgtttcggtgaagactgttaagttgaactttcacctagaaaaggagctacacctgaccacaactgaacaatggactatgccttgaattgtcagtcttgtgcagttaggtttcactcaattccataactgatactaggcaaccattagtattccctcgggttggagcttataagtcatactccaggcctttcatgagtatctagagatcacccaaatctcatagaagcagtcgaactcatataggtgtgttccttctaagatgttctgcaggtcaacatttctgcttggaaaagccactcggatcacattaagacataagccatcctaccatgcaggaaagaagaaaagcacatcatgaaaatgagcccttttcaagggtctcttctctcagtcacacaatagtttgtttcaccatccaaattcacgggatctccgatcataatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtaccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatctttcatttcaaaactcttggacagatagtctttgacctcctcaatcacattaaggctggtcccaaagatcagtatgtcatcgacatataagcacaagatcaccccttctcccccaccatagcgatagtatacacatttgtcagcttcgttcacaacaaagcctgcagatgtaagcgtggtgtcaaacttcttatgccattgcttaggtgcttgcttgaggccatacaaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtggtcaagcgagcaactggtgagtatgtgtcgaagaagtcctcgccttccttttgggtataacccttggccacaagccttgccttgtacttttcgattgtaccatcaggcctaagctttttcttgaaaacccatttgcatcctacgggcttgcacccatatggacgctcaacgacttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttgcaaccctttgtctcttactcttgcgagtatctacaatgttgtcctcctcaggattttcctcaggcgtttgatcattgtgttctatcggtgcaaagtactcatggggcatgacagtttctttactagaagtgctaggtgtatatttcataggaaattcattctcaaagaatgtagcatctctggactcaagaattgtaccaacatgcatgtcgggtactccagagtttactattaagaatctataacccacactgtggatagcataaccaagaaacacacaatcaacagtttttggtccaagtttccgctttttggctataggtacatttaccttggccaaacagccccatgttcgtaggtatgagagatttaatttcttcctttcccattcctcgaatggtgttacttccttatgcttcattggaattttattcaggacatgacacgcagtcaaaactgcctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattggaaaaatactccccacctctatcagacctcaaccgtttgattttcctttcaagttggttttctacctcagctttatagattttaaagaaatgcaatgcctcatcctttgttttcaatagatacacatagcaaaatctagtgcaatcatctatcagtgtcatgaaatatttctttccccctttagtcaacacgccgttcatttcgcacaaatcggaatgaacaagttctagaggtgccaaattccttgcctcagatgccttgtgaggcttgcgaggttgtttcgattgaacacaagtatggcacttggaaccttttaccaaagtgaattttggaattaaactcatgttagctaagcgcgtcatacaaccgaaattcacatgacagagtcgcgaatgccacacattagactcatcattctcgctaatatggttcacagcattatgattattacacatgtcattcaaagaaaagcggaacaagcctccgctgtcataaccttttccaacaaaagtctcatatttagatacgacacatttattggactcaaacacaagtctaaaatcttctctacacaatagagagccgctaactagattcttctttattgaagggacatgctgcacgttcttcagctgcacggtctttcccgaagtaaacttcagatcgaccgtaccaacaccatgaacagccgcaagcgacccgtttcccatcaacaaggaggaacctctcccgacctgataagaagaaaatagagaaatgtcagcacatacatgaatattagcaccagtgtccacccaccaatcaggtgaatgaaaaacagagagaactgtaggtaatattttaccgtaccccgatgttcctccgccctcgctaatgatcatgttggcagacttcctgtctttgcgctcaggacagtccttggcccaatgcccagacttgccacacacaaagcagtctccatttgcctttcccttgcttttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaagaacactgaactcttgtctcttgtgctttagagaagtggcaaagtccgaccaagaaggtggtagtttggcaataatgccacctgccacaaacttgtccggcaactcacagttgttgttctcaagttccttagccagcatctgaatctcatgagcttgttcaactacagaacggtcatcgaccatcttgtagtcatagaactgctccataacatacagctcactgccggcgtcagaaactccgaacttggcctcaagtgcatcccacatgtccttcccagaaggcatgtgcatgtacacgtccactatgttgtcagcgagtacactgatcaatgctccacggaacaggcaatccgaagcctcgaacttagcctcttcctcaggagaaagaggtggttcacttcgtttgccccgtgaaacatagaagcactgcatcgctgtcaactacaatagtgcacgtgctttccatctcttatagtttgaaccatcaaaggcatgtggtttcagtgcagcagcaaagccaactaccgaaaatgacttatcaggtttttggattgttggaaatttggtcataattcggcatattttaatccaaaataacaagataataaacatgatatttacaataggatttgatccagtgatagtgttgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgcccgcccgtctgtgcaaacgtcgcagcaacgcgtggtttcggaggcctactctcccaacgcgtgtgcacacactcgtcgggatgggattaccgtagcaacaacagctttggaaaatggatgaaagtgtgtcttctttttctcgcgggagatcaaatccattcccattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaaatgtcatcaactagccatgaaccatcctccactacacaaccatcaaccatccatcaattaggactaattgacataagttaccaattccttaatcaaatggattaattctcaaaactcttcatcccattgatatcccatagaagaatgaattcacatgaattcctagcataatgagccttgaaatttatttgatttaattgatttaaatggattaattacccaattaaatctaacaatatgcacatatgcatgtggtcagaggagtaggtgacagtagcagcagcagcgtacagtaatattaacgaacatgcttaagggcaactctaagagagtaagcagccatctacttacatgttattttcatatcattaaaggtgatataaaaattaatccggttgtgtttaggcacttgatcaaatttttttaagtatactgacacatatttaaagtattaaacgtaaactaataataaaataaattatagattccgcctgtaaactacgagacgaatttattacacctaattaatccgttattagcaaatgtttactgtagcatcacattgtcaaatcatgacgtaattaggctcaaaaaattcatcccgcaatttacatacaaactgtacaattgattttttcgtccatatttcgatgtgatgtttttagaaaaaaaataaatctaaacacggccctagtcattatttttttctcaatgtgggcaagccttggttctctctcctaggctatctaccaaccacttatgctctttcgatgtgggcccaccttaattatctctcaccaaatcttttaaccaatcacagcttccatcgcaggtacattgtgtccaggcacccgtccgaagctgtcatcaatttagagcgagtacgatagcaaggctacgagtcagctgcgagttcacgcggagaagataatagaagatagagaagggaagcaaagtataaatttatagctagctgtagtatacactctaatatattatgtgtataaaagatgagactatatattagtgatgtagtatatatttatagataactattatgtgaatgaactattatattagctatagatgaattggagataatagttagctatactattaaacttgcttttagtcgaccgcttctctctccactccctcttccttccagcaatgaaaaagagctgatattagcagctaatagtaggtataatttccttattacacttgccctgcttaaccaaaattagcaaaccaaagtgacatactaactcttagtgccatcattttttttctttgcatgatagtacaagcactataatttcgtgtactgtttttcctcaacctaaattagaacatgccgtttgttaattttactcgagtttatggtaagtgatatacggatttatacaaatatatgtgtacttctatttgttgttagctttgtccaggctcaagaaaaaatttggatctgccgctgaggttgttctattttaggacagaaagtattaatgcagataataaacagtactgcgtaccaggggtactgcgttcaatcaataattgaaggatcagatcgtgcgctaccgtaaatctaggccttgtttagatccgcatgataataattagccctccgaaatcttgttatttaggaatatttaataaagtctatgtaaaaactatttgcagaacccttgggctaattcacaaggtgaatgtagcaaggtgtattaatccacgattagcggatgattattgtagtatcaatgaagtgaaacatagattaattaggtttattagattcatcaagcaaattagactagaggttatggaatgagttttatcagtaatctacgtttaatactactaaatagcaatattttggagagctaattattagagcatcaccaacggtctacctatatgattcccaaaactaattttgagcgattttagtccaaaaatcagctccaacagatcccctactctcctacccgagttttggagttcccttcccccggttcctcactccatttatatgcgggcacgaaagtcgctcccaatccgcaatcctgcctctctcctttgttcccgcgcgtgggagatagcgatatttctacgcgtgaaagaaaaaaacggaattttctcttggtagttttacagacgggcccacttttaagtttgggggattgaatttaggctatctgttggagggaggaattttttcacttcctattttcagtttaggaaacccaaaaataaatttttaggagaaaattatagataatctgttgatgatgctattagccctctggatgcaaacaagaccctggtacaatactaaaacagtacactacattagtccgaccctgtagctacagtacggtactgtttatgcatgcattcacagaagatcgatcctgtgcatcagtactccctccgtcccataaaaaactaagctagtaacatattttagtactacgaatctggacatatctctgtttagatttactccatccgttctaaaaaacactacgaatttagacatacctctgtttagatttactccctccgttccaaaatatagggcatacctactttttaaagtggtttcataatataaggtgtgcatgcatacatgtaattaattagcacattctctcccctaaatattattattttaaatcctatactcacatgatcattaattctattggttgcatgtattgtattaattggggtgattcatgacaacgatgagatattaattatttattggtttttattgtattaattggggtgattcatgacaacgatgagatattaattatttattggtttttagattaaaagtggttgtggcttatattttagaatggatgaagtagtgtactcggaaatgttatatccggtcgtagcttctttttttttttatatggagggagtagtaaaaatttaggcaaccgtgaaccgttcccgacttttccgttgcgcgagacgatgcaaaggagaacacggcagctagcagcatctcaacaagaagaaggaaaaaacgcgcggctcgcgccgcggggcatgagggtgcggatgcgaattaagccgcacttgaccacgacgccacgaccactctccatcgatcgcgtcctccttacattactccgcccgctgcggcgaggattccctcgatccagggggggggggtggtgaagagctagagctggcggcgggttgttgaggagcggctgactgaggggagaccagaccaatggttggcggcggggcgggcgagccgctgaggagggcgtgggggtaccaccccgagtgccccggatgcagggtggacaggaggaaggaggagagggaggggatcccctacacggagctctccctcatctggctcgtcaccgtctcctccagtgagtgttcatcggcctcgcgccgcctctcttccctgaccttgatcgacctgtagtagtgcttcgtcttttccgccgtctgtttctttttttttcttttttttttggaaattagtggaggataacgccgttctttccttcttcttcttctttgttttgaaattagtggatgatggtatcgctgtcgccaattcaatactttgaactttttctaagtcgaactaacattttcaatacaaaacaaatatattatcaaatatatttaatgttaaatttaataaaactaattttgatatcataaatattgctaattttttctataaaaaagctttaattaagaaaaaaagtcaaataaattataatataaaacggagggagtagtactatcgtagtgttatcattgtttcggttcgtactttgtagtacaagtagtacacatgcatgtgtatatcatggtgtaatggggattcaattagtatgggtttgtaggagcatctcgttgccccgagctttggcatgccacgatcatgctcaacgcagtagatttgctcggtgctctcgcgggtattctcagaatctccactgtcaaatgccactgcccactggggattggtgcaaaaccgcaaactttgaagagcaagtttaatagtatagctaactactggctacaaatcatctatagccaatctaatagtccattcatacaatagcatatactacactattaatgtatagccctaccttcatacgcacataacgtactgagtccgtgctagttggctacaaatctgtagcccgttttccttctctctcttcttccctctcctacacatatgcttacagttgctattctactcgctctaaattcaaaatcgaccaagcgaacttctattcgcacatcccgaattcgaaagacttttgacagaaggatagtgcacgtatggtacctgcacgtacacttaggaaatgtacttctcgttttctctaatcaaacactgaggcttactaaaatgttttctccatttgcctaatttgctcatcttgttaggccaggaaactgatttaaagaagattaactgcacatctgtgtcctatatcttgcgatctatatctttattgtttatcaggacctgatattatttgtccctttctttcttaatttgtctttctctgttgctctttgcagccctgccgatacaatccctgtttcccttcttgtattttatggtgagcaattttacttgcttttttttagaggtgcaatatgatgacattttgtttcatgagaagagaagagttactagcgtcactatcgattttacatttggacttaacagctgtgctggatctgtagtatgtaaaaggtaaaaataaaaattaatatgcactgtcacattgtaattatttcatatattgagccaaggaagaaccaaatagtaaatactataagagcaatgctacacgtactaaatttttcttactaaacttttactaacaatcatctcaaccgtttgatttaagtagatggaagttacaaaaattctaggtgcactcatagcatgacacatcagtgttagtaagaaaaagttagtacgtatagccttttccatactataaacctggacacatatcaccttcattgttgtagtaccaaaagagccataatctgacatcctctattacaatgatcggttaaatatttctccttaaatatgcgtcttagatattctatcgacattttgtttccttatttggtatagatttgtcggaaacataacttttgaacgtaaaacagctttgcaaatgctgaactgtgttctaaattaattctcttttatcaacattggagtttctgtttgcagataagggacctgcatattgctaaacaagaagaagatattggattttatgctggttttgtcggtgagttttctctgaaacatatttcctcttttgcgtcaatctgagtaagcacttaaaagtagcttctaaggatgtattatgaaagtgatagcctcagcaaggcagccttatctaacagggtgaacttgtgatatgtgaaggcgcttcatatatgtttggaagagcactctcctctgtgatatggggcatcgtggctgataagtacgggaggaagccgattattataattacccttatttcaatgtaaggatcttcgttgaatgaaacgtagaatccaatactctcatctataagcttttcgttggatctaatttgttaatgcacagagaatttgagcacattttctaatctattgcagaattattttcaatacactctttggactcagctcaagttattggatggcattaacctcaagaggtttgcttggtctgatgtgtggtatacttggcccaattaaggtacctgtgtccacatgagaatgcttcacttttgtctattaaaaccttcgaccatgttcttgcagcattattttctaatttctgtgttccaggcctatgctacagaagtgtgccgaaaagaacacggtcaccttggactatcccttgtaagatcttggaccattactatttcaaaattttcgttgtctcccaactttgttaggcccccaatgtaatgttcactggttgatattgctggctaatctgtcaggtttcttcctcacgtggcataggccttattgtgggaccagctattggtggttatcttgcacaggtaatattttattttaatatttgaagaaatcatgatgtaattaacttgtaactatgtcaagattattggcccttgtattccaatcatgactcttgctaaccatagtcgcaaatttcacaaattataatactttaatgcggtgtatctaaagtttggagttctcttgtcatatacattaataattatactcgtcatgcctcaaaaatttgtgaagaacatgaaaacacacatgttgattatattgctgcatcgaggataaagtgcgatagtttcatttttcttttattggcatgcaactctacttattttgcttgtgcctttctgttataccagcctgcagataaatatccaagcatattctctgagaagtctatatttgggaggtagcatctgctttctagatccatcttgtattggttgtttcttacactactaatttttaacgtgcaatgttttaggtttccgtattttctcccctgcttatgtatatccctccttgccattgttgctctacttgcttccttctggctcccggtgagcatttttcttatatccctatgatacaacatttcttttagcaaacatcattataataactgctttcattaaatatttgataattgataactctggtgaaatcccattttgacactggaatcatagttcttcatgatgatccataaattcatttagaatctgctgctcagttgcaattgcaacattagtattgatgtgtaccctgagaactttgcacaaaaaccttaatgtcactgcacaaaatttgacatttacgtcatgttacaggaaactttgcataagcacactcaggatatggttttagaggattcaatttctgtagaagaaggtctttctggtccaactgctgaagaaaatagtgctggatgtctaaatttattcacaaactggccactgatgtctgctatcattgcatactgcatattctctcttcaggatgtggcttatgctgaggtaatattctacagtgtcattggagttgccttttgttattatttagaatttcatgcatcttttttttaatgtcatatttgatttttgcaccacccctcctttttctgttattactggatttcatttgggaaaacacaaattgcaggtattttctctatgggctgtcagcgacaggaagtatggtggattaagcttttcttcccaagatgtgggtagtgtccttgcattctcaggtacagtaagcacaacaggaaacctcccactaatatggagttttgaatttacaggcagacttataagattgttcatcgagatttgaaattttgaacaccgtggacatgtggatgtgatagggatctaaagaaagcactagccccatgaccccacatgctatggctaatgcatatgataatgtaaaattgtaaattaccataataaatatataatatggatatagatcttttcttattgttaggtctagtttgatgtgatcaattgcactttctcaatttgaagtattaattcttgctaaaaccaaatcttaatctgaagtatggtatgaacttgcttaaaactcaattattcgtattccatgcaatgtctggtatattgagtactgacttaacttattatcaggtctcttcctcctggtattccaaattttggtttacccgtcagtggcaaaatcagtagagcccatcacgcttgtccgtatagtggcagtaagactatctctctttttttgggtcagaatttagatcagctcagttctactgtaacggttcaactcatatgatacttctgaattgcagatattgactataccacttctttctagctatccatttatggccggattgtcagggtccattcttcaattgatagttaactgtgcatcttttctgaagaatgcttttgcagtgagtgcaaacgtcttgtgttgtttagaatggatactcgtttggacaagcgactcgttgtttattcatttttttgaaacaattacttcaagtgtggtcctgtttattgtatatcactcttttatatttcacctctcgacacatccatattagttttgacaaaattcaactcatgctcttctaaaattttttcaggttactaccatcactgtattcaacatcttaatgaatgatgctgtggtaagttcttcaagttccaaataatgtgtaccgggtagttatataaaaaatatattctatttttcggttattatacgtggtaatttatagtttctaattttgtttttctaaccatgaaaatacaaataacaggctcaggacgtta

SEQ ID NO: 13724 - DNA, 7595 bp, Oryza sativa
  unsure (1)..(7595): unsure at all n locations
tgacatgtgggtccaagtcctagcctatatgttagtgggacgtcaataacaaataatggaccattgaaccacgtgaaattttcagtgtgaaataaggaatttccctagttttcttggacaaacaacagtgtccttacaatttcttagatagttatatttccttttggttaatcagtttaattacaatgacaatgaaacacaattttagttttttgtttgttgtgatcaactcccaatatttttgttttgccacatattattagtagtattaattcatcaagatatacagccaggattcacactttgcaaactgtgggtaccagctttttattatacatatatgttttttcaggagaaataccgcatcgtaatgctaattactcttttcccttatagatttgcatgggctcaaaggcgtcagacagcttcatttctcccaggtattacatgcatggtatattactagtgaattaacacgaagatacaactttgctatatcctatccctgttaataccaatgcaattagcactttatcagaattttcttaaaataatatatgggagagccaccttatcatgtcaataagttggaaagttatgataccagaatagaaagaatgcagttctgaatgttggcaatgaactcgccagatatcaacacctttagaacagataataactatgaatgtggtacatatataagaataagttatctaccattagttcttttaattatttttgcccctctcaatgccatgaatatctgaattgaatgatcaaactagagaaatttaagcttgcgtgtctgttttaagaataactagatattgtttgtctaaaactaatgggatagagtctcttaatgttaggtaccagcgaagttcatatcttcatttttgaagtaagatcgtaaatacagtaggttcttagttaaaaatttagagtaagatgtctcatctctgtcttttgcgatgttcatttgatatttaaaataggcaacatcgtagactaaaaaaagagtaaatttcacaaaactacaagtactttggctaaattattacaaaactacatatttaaggtgaaatatcgaaaaactacagatttagtaacagagttatcacaaaactacaggattaagataaatttaatcacaaaactttaacatcataactcaaacatagcattagtgcttaaggatttaaactctaaaatctgtagttttgtgatagttttattattaaatttgtagtttgcgatatttagccttaaacctgtagttttgtgatacattaacttaaatttgtagttttgtaataatttaatcaaagtatctatagttttatgaaatttactcagaaaaaaaatccagaaatatgctgatttcaggatcactattcactattaagcccgaccttaggatctcttctgataccccccttaatttcaactaagcttatgtatgcgtttgaaaagattaagccaggtgggttggcttgttgaaatgcaactacgaagaggatttcctaagcattgaaacgttgttgtatcccattgattcgttgtaaagctctaattctgttggcacctgctctctgtttttgcaggcgaccacctggtattcttcatgctgaacgtcttcacagtcatcggtcttgtgagcactttcaggccgttttacgctagaagaagcacgaagcacgatcccattactacttagcactaaccattctactcaggacctgaggtctgatgtagacccccatttttataacaggaatcactcgtgttaatagtaccatttccctggatcaagtagtctggtactcacgattacattgccgaaatatcaagtgcgcatacaaagatggtctagcgcgaattattacatcataggcccgcaggcagtcttagaacataggaccaaacggtctacaatacatgatgtaacagaaatagattaggcagcggaatataggcagcggcgacactattgccataggcaacgaccgtaaataagacctacgaagcgtcgttatcctccgcatcctcctgaagataagcatagggatcctcctcgacttcattgccatccactgattaaattttgcaatagcaagagtgagtaccaaccgtactcagcaagtcaccataacaacaatgcatatgatagtggtattcaaagtatggccattggtttatttgcataaagctagtttaaccattcttttcacaagcctattatctagcatagactagtccagttttaattccagtatttattacacagcagcggttatgttcactatccattgtcttcccaaagatggcttcccgttactggccgtaatggttttctggggtttactccttctcgtctctcgagaagttgatccgccagtacaaaatcatcatgcatatcccatcccaatcaatttaagaatttagagtctagccaagtgtaatacatgtcccggtgctcattatccgtgagcacggctattcgaatatatttggtttactcacactgcagtggatgtacactttaccctactccgcgacttgcccaacacatgagcctacgtcccaacgaatgagacttgccacggcaaagcctttcaataacctcacgttggcagtactcgctccatgaatttacatcttcatgcactctaggcatcataagtttctagtagtgagaggagttctggcgctcccgggaagggaagactcacacatgcattaagttttagttaagttaagtttacacatggtagtcctaccgatggcgacaccactgtaagcactcgcccctcgcggtcccatcaatggctgccccaccgtaggccctgcccccacacacatcaagaataaccactatgcagggatactgcctccgctcggctatgtactccgctaggtctatacacatgcgagaagtacggttgtatgagggtcgtttcatgcttaacttcatggctcagtccttaactgaccagggacggcactagccttttccggacaccacccaagtaccccagccgccctagtcgaaaacagtgtttaattttatttctcctttcacaattcatgtcatccttgtcatggcaatgtggcgctcatgtctccacatgccgcatctcaactaccttccctaaggtagttgcccaagcatgtagcacttgataaatatgagaatgcatgattctaattagcaggactaagcatttgtcaatattgactaagtacacacgataacagggtttacaagggtcatacagataatcaatatcaaggcatggcatatataacaagtggggcattcatattcgtatatatagcatgcaattttatttaaatcaacataattttcgcaatagtttcaacatgctcaaagattagtgatgacttgccttgatcgtagtcttgctgtccctgctcctcaatcgactcaacaattccctcggaatctaaatttacgtgcgaaagatcggatttgaattcaattaggattcaaataaattcaccaaaattcaaacagtacaaagcatattgagaaaatggtatcattagatagaccttgattttagatgaatttaggttcaagtttcattcaattccgagttaaaatgagtgagttatgagggtttaaagattcaaacttgaattaattcggaaaattgtgaaaaactactgttcctaatgatttatttttttgtccgaaacattatccaacacccacagtggctgacatgtgggccatcctcctatttcatttctggtttttttattttttttaaaggaaatcctgctgtgtcattgacaggtgggtccggccccctgttggtgaggtcaagccggacctttaacctttggtgggaccctcatgtcattgagacatttacttaaaaaccaatttaattagatttctaagcatccgggcctacatgtcataggttcacaataatatcattagtttgaggattactgtacactaatgaagtggggtccacatgtcataatctctccctctctcgttcttttctttctccccgtcgtcttcttccttccgctcgcgacggagcagaggagcggcgcgtgatgatgcgacggcccgagccggaacggctcggcgcacggtggggcgagcggtggcgcatcaccagagacccgccgccggcggcggcgaagcgcggcgatcgtccggcgcgcggcgcgacggcggtcgacggcgccgagatcccaaaatcggcggcggcacaatgaggaccaatgtgagcgtaaccaacgacgattcaaccatctagggtccacatggagcatatagaagcaaaaatctagcctaggttgtattggaacgaggtccctccatgatgagctcggccatggcgcggtggcggccggagtcggcacggttacggcggcgcacaccccaaatcgagggggccgctggcttctaggtgtccaggcaatactacaggcgcgagggcttacgacgaagtggcggaacggcggagtttgacggcgcgcggcgtggtgcaaccgaaacaggggcagacgacggtcggcgacgtttgcaggtgtttgacgctcgtcctccctcgcgtagcggctcctggctccttccaacagtagcaacagcaacgcgggcacctcctcaacacaccctgccacccacaccggccgagaggccctgcggcggcggcgcggcccccgcccaccaggtgttcgacacccggcggcggcgtgttttctttcctctgagatggagcaagagctttggggaagagagaaacagatgaggggttgatcttggataaagtcgagctaaaggcgagcttataacagcgagaggaagggcgatttcttaatggataaggataatcaatgactcggctttggttcgatctcacccaggttcggttcaatgtgcaggcgtggcatgattgcctacgcggtagtatgcaggagaggtatcgctagctggacaaaggggcaccgcattacccagcggtctcaaccgggggcgacaagatggcgacgcgacggcgacaagagcgacgacgacggatagagataacggcttggataggggcgcagggctatgccctagggtgacgcggggtcgtcgtggcggccgttatcactccatcccgagggcgacgcgcgaggggatgggatgacgcgggcacccgtggcggcgcagctttggcgcgggcttttggcggctcggtcggctgcgggcccacgcgacgtggcgcggcgcggtgcggcgcacgggcacgcctaatgcggcgcacgggtcgggacagcgggcgcgcggcaaggcagcggttggagggggcggcgtcgagcgttcagacgggttaggcacagatcgaacacctggcgcgcaatgaacagtagcaacccgagaaaaatcacaattagggttttctaatgacaatttttatggaatttttgtttagcccactacccctatttccattatagatctacccacatcatatacttctaatttcatgatttattgaacccaagaattaaggattaatattattacccttgacctatattcctttattctcaactttatagcttctaacctttgtttttctataacctcatatttgatttattacaccctatgtcaataactaatattctatttgtattatgtttttcttatttcgccatattctggattttattatttgacttccatctcaacttacttatcttatattatttaatttaaacaatatatttgcaatagagaaacgaataacaccaacatgatgcaaaagttttaaaaagttcgaaattttagtgatttttattgcctatacctccgtagtaaagtgtatatttttctgtttgccacacaaccattctgatgtactgcaaaatatgcctcgatttttttttagatcagtacttcgatttggtacgatgatcttgtgctgttgtacacatcaaacttagcctgaaggcttgtcttgtatctgtatcttgtatttggacgctacggctcaaactgccatgtgccatgactgtccattcagctctgaaattccatcgactgtgagagtttttacactgtccttaacactgtaatccatcaatttgtttggtggtccttaatctgtaacggcttttgcttggcgcgatcttttgtgggctatgtgcatcttgtacagtgctaaatgtatctagcgttgcacttcctctggttacaaaatattcactactccccccgtttcacaatgtaagactttatagcattgtccacatacatctagatgttagatgttagtgaatgtaaacacgtacatatgtctagattcattaacatctaaatgaatgtgggcaatgctagaaagtcttatattatgaaacggaggaagtagtaatattttgaacgagatttagcaaaactcttgaaacttttagaaagacctattttaaagtgaagggtgttatttggatttttgtgatagtttggagtgtaaaatggagttactgtacatgttagattttataaacttattattcaaatataaaattgatggtcatttttaaaagcttaatcgaatttcatcctaataaacattaaatattaacaaccaaggaagtagcagcatcttcgtgacccctgaggatgttttcagacaggatggttttaatgaaatccatggatttcattttaagaagaaaatatcgggcagggcgtccgtattcaattttctttttactgcaataaccattacaaattcaaaccattttgtaatcatcaaaaaacaaaaattacttatagatgtaaaaaaatagtcatgaaaacaacccattcggattaagcccaatattacacctgtgctcgtatttatagctaattatttttttagtggtaggcaacatatatgtacacagcgagacgtctacagtgacttcgttgatctcaagataagcatgcctagtattttggagatgttcatagactcatagggtaggatatatttgcgcgttcatagaatgagtgtgcgcgttacgagcatatgcatttatatcgtgttctgttttttttacatgaaaacaggggtagagagtacgcatagcagtttgctctcaatgtcgtccggtcttacccttgcggtcgttttttccataaattttcctcccccgcttcccttctcttcccttttttcgctcctcctccactcgcgctccgcctctctctctctctccatcgatccaagcccccccccccccccccccagatccccctcgccgcctcgccaccgcgtcggccatggcggaccagctcaccgacgaccagatcgccgagttcaaggaggccttcagcctcttcgacaaggacggcgacggtatctcctgctccctccttccctctctctctgtaccttctgtttttgaactctgttatgctctgcgtgatccggtagcgcgtgcgtgtgcgctgatgcgatggcggtggagtggagtcggtttcgcggcctcgcgggtgcgcgagaaggtggggatccggtcgccgggggggggggggggggggcctnttccggcggggggggggggggggg

SEQ ID NO: 13725 - DNA, 2306 bp, Oryza sativa
tagtagatcggctggttgtggaatggctgtttggttatcccatgagagtttgttaatcagagtgatcgagttgaattgcgaaattcgcgttttaaatacccaagttctgttggaaatggcgtcgagtcgcccggtaagttggtgcggctgtggctataatgggcatagacgcacagtgtgcccacggattgatggtagcgaggcgcgaggcgcgaggcgtggtgaatttcatccctgttgcatggttgctggggctgctgactggaccatggtgtgttgctatctgctagtcactgcttgctaggcatggctatggcagcatccaagctgtggcttcacccgtgcctcctgccgccaagcagaaggtgcaaccactgctctggtcgagctggcagtctggctctgatgtggcatggtgagaccactcgccatgtacctgtgttgggcagggcctaagatgcaaagtgctgcaggtgttaggtctataggaagaaagcatatacggggtttttgagctagcacattaggtagtgcatgcattggcgtgctgttcataaagggactctactaccgttttagattttatttgggcttccttttcttctcaatggatgtccatgggcataagggtaatgctgtagcatgaatgcatgattaatgattaaattttattttgcagaattattaagatagatgggtacaccaggtttcagacttgtaatgtcctttttttttttctgaaagtcacatgggagttggtatttattttctcctatcatgctatatatgtatcaccagtaagaatttttatgatagcatagagagtgcatgtgatgtatggaatagttaatcatctcactatttagtagtatttgttaaacgagtggagccaaggtgacattgtgcacgaagtaaaaacagcttatagctgtcagacaaaacttagttgcttgctgcagtttcttatatttcccagcaaaggttgggactatgcaaagcagcgcgaaggtcctagtggttatgacacctcatacgttcggttatccacagtgattttatctaataatcagtatgtataggttttaaaagtgattccagatgtcctgtaagttataggggtgccactgtgccagtatgtctctaatattgttttaaacaggctagttcttcacactgtaggtaaggttgattacgggtgttttagtttatctcatgttcctattgtgggaagagaagctaacacatgttcatgttcttgagtaaatcctagtttaaacttgcacatgtgtttgtttttctttttttgattccatatttccatgcgttgagataaaggcatagagtaagggataatgtgagaacaattgtgggcccagccattactttgtttttggccttttgcgcaattggagcttatgctaatttcatgaatatattctagttcacttgcatggcaaatctataaagactgtacatcactacatccttatgttgtacaggtagttaggccttaagacaaactcatattgtactagaatcagatgtgcaaatgtcacttcatgatgcatgtttgttccaaatattatcccatcactggcaagatgccaggattcatgtagtgttatgtagcacgataactcccttctttttttttttgacaatgtgcacgattactatgagaattcacaaaccctaaattcacgattactaaccctaaattcttatttattgttcggcttcatatccatctttgttttactagatacacttttatgttatttataaaaacttggttcaattacatgagcagctgagcgccacttatgtcatgccaaaaataatgttcaaatctagagatgatgggtctcttcaaaaaaaaaatctagagatgatgggattattattttgtttaaattttatgaaagctctgtaggaaatcaatatttgtaattacttgcctgttatatacctactttaacaaaaagggaccttgtatgcggagttggggactgctttgatttgataaacacaccattattatctttctcattaaactgtacattaattataagtgccctagaggtaaattgtttgaactgtatttgtgtcttctttcacatctttacatgacattaataattttttttactgaatcattcattaattattatttactgaagtgccctagaggtaaattgtttgaactgtatttgtgtcttctttcaccatcttatcttgatgacatgtaatatgtaactaactgagtaatggctgcgttctggacaggctgcatcaccaccaaggag

SEQ ID NO: 13726 - DNA, 2206 bp, Oryza sativa
  unsure (1)..(2206): unsure at all n locations
ttattgctgatattaatcagagtttccaacgggaggagagatttgtttttgtttcaaaagctaactgcagatcttatgattgagtaccaggtcgaaagtgtgagtttgccctttattatcctctcttttcccccgttcttgccttttactttttgaaaggttcatcgatagcaattttatttgtcttgtcaatttagtacgatcatgtacctgttgcagcctttgaaatataaaactccatcatctgtattaaattcaaaaaggagaggcaacttaagaaatccattattattgggatgtctagttttgtgagaacatatgggggaaaacgacagttaaagatttttctctgatctttcaaaattggattatatggatttttgtttgtccagaagagggggagaaatctaaaaaagaggattattcaacgaggaattcgtcaaaaattgcagttctgtcctgtcgactggatctttctgtgtggttctgagcctattgctttttcaacaaaacagataacttttcaatggtcaaacgtttctgattcctttaatcttaaacaaatcagaggaaataaatgccagattattattcaaatcaggtaagattattattcacgcaaaggtctggcttccaccgtgccaaacttcttttttgacaaaacaaaagagccaaaaaagttactatattagtttgtttacagtaagtggttcatacttcatactacatttatattacccatttttctctaattcacttacgcgctaaaaacagttctctcttttagtttgtaataatgtagtgtttatttccacacacaaacaccaaaatcgaccctcgntctattgagaatccgcgagtacaatttgctttcttgcaccaaattttgtcaattttgggtacacatttttgtcaattttgagccttcactaaatacaaattcgactagtggatttttttccaaccgattattcctttgaatgattatgcctaatgggcatttatcctcccctctctgcagaaggaaaagggaacaagaggaagagagcatcttagcagcaaaagtagatgcccattaggccattagcatatcatttcatgatgaccctttcagagaaaaaaaaattacacaattgatcaaacttttacagctttgacactgccagcacatccacctagctagattaagttcagacatctccatctttttctttccctctctctttgtgccactctatatcagaagatggacagagattcagatcaagaactgcatcaacctgtgcagcttttacacagtgtgcatgatgaattcagctccagggttccagcataatggtcatctcatggctaaagcaaagaatcccatctactactgttcaactgtagctcccatgctgcatgtgccagccttcgttaattttacctgaattccatgagctacccgtgccacaatctctcaactcggcttcctatctaacctgccctagttggcttctactagtctacaagataccatatcatatagccctactttgttaaatttcattaggatttttcagacttacgtggaagatagatacttactacaaagacaatggaatggatcaccatgagttagaagtcaaaatcctgaggcaatgagacctgaaaaattcagacattaggtattttctcccccttttacaccccatccctcgaaagcgacccatatttgcttgaggaagaagagatatgcacacaacaaaattggcacggattaatcttacaattgttgtgacaatagcattcatgttatgtagggaactaaaaataaataaacactagctaagctaaaacagtgaacccaccgaatcaatctttttcggaggaatgtcactttttgaacggtccagatcgagaaatcctgatcgtttcctcaagagttatatgatcattctctacaattggcatgcctctaaaatcagtaacaagaaacaaatcatgatttgaaaaatatcagtttatgtcaaaaatgtttttatttgaatttgatagacgaggatttgaacccgggtagttgggttgtgcttgtgcaccgctcccctctgacccggagtgctccgtgcactcgatcttgctcgtccgcaccctcctcctcctcacgtgcaggcgcgacgcggcccacgacacgacgcgcctgtacagcgtcccggcgaggccgtgc

SEQ ID NO: 13727 - DNA, 16387 bp, Oryza sativa
gccaccgccatcgccgccgcacacaagcctggccacgtagacgttgccatggctgcccttcccgacgaggttcttggctgcgaatccccccgtcgccgcctccacctcctcgaacgagaactccctcatggccgccgccgccgccgccgccgccggcgagcaagctctactctacacctcgatctcctcttggtgcaatgcaaatggtgtggtgcaatggcgaaatggaaggaggagagaagagcttggagcttaggagaaatggagagcaatgtaaagcagcagcagcagcaagtaggcaaaggaataaagagcaaaaaaggaggaggccaagaagaaaggcaaatgcatggatggatcatcaaaggtaaagttggtggctgcaattttcagagagagaaaggtaaaagaaactccaaactctagctagagagagagagttaaagaagaaactccaaattctagagagagaaaggtaggcagataaaatttaaaaaaaaagaaatttggataggtatatatagagagagaaacaaagaggtagtagtactagtagtatatagtattatgattatgtttttgcttggtctcctaaaagaagaaaatttgtcttctcaaggagaaagaaaggtactgtagaaaaacaaagttaaatcaacagaagcaaaaaatggcttacctgctgtctctttctttcttcctcaatctctattagtattatataattataattactgttgtttatactcttaagcagagaaaaaggcggcatatgcacacacacggtgcattggggttcggatcgatcgttggagtggttggagagagagagagagagagagagagagagagagagagagatgcaagatactcacggcaagcgaacaaatcggcaacagagaatgtcgatttgtcaggaggggaatgtggagtggtggactggttggggctggggtttcatccgttcctgtggacgcgtccgtcgtccttgcctgcttggacgccaacacctggccggactggggtaggattagttcttttttttttttcgttcggtagtactagttcccaactcatcctccccattttctacgcgcacgcttttcaaactgctaaattgtgtgttttttgcaaaaaatttctatacgaaagatgcttaaaaaatcatattaatttattttttttaaaaaaaatagctaaaacttaattaatcacgcactaaaacgttgcttcgttttatgtgccaaggagtgagggttgccccgaacagagttgtgtacaatgtggttgctgtgatatgctgggttttcaatagtggaaatttaaaatgagacttaataaattgtcacaaaatttctttaaaaagtttaaatataactacggtatatttatagcgtaattatactgtagctataatgtagttacaattaatcccttcacatgcgtagatccctcatgcacaaatctcgatacgatttgatggttacaattctttttttttttgggagggggattgggggaaaatcgtcgttttctttagcaattctcatataaatttgggctacaaagattgtaatgtgaaggtatttgcctatttgagataatgatagagaccaacggcaaatctctacccttgttgagttctatcgaaagttactgcaacaaaatatgtgggtaacattcgtggccacaagcattttgatcctcgtggatgaaatcatgccccttgaacataagctacgggtatatggtagcagtgttgtaattggtttcagagcatgcatgtgtgtgtgaaggttaaaaaaagaagtaaaagtcaatttatatgagaaacaaggccgatgtatcgctcttttgtttccaaagacatgttattaaatttaaaacttgcttgagaattcaaggcaacattttagatttagttttgggccaactacaaaaatgtaaatgtaaagagtataaggatttcattcatgttgtatgctgacagttggagacaacaattatgtacattttcatcaattttggatgaagatttagcaataggattactatttgaaaataaattgtacatccaaccttattgttggtgccttttttatataacgtggcgtctctttattttttgctagataatattatattttggttttaagctaagaatctcttctttatataaagctaatgctcactaaatatctaaagctcaacatgccagcatagtatttattagaactcctaaaacctacatgcaagcatattacatcaacccattaagcacacaaagctcgaatgcaaacatatactccctctgttttaggttataagacgttttgattttggttaaagttaaactgctttaaatttaaccaaatttaaccaagtatgtagaaaaaagtaataacattttcaaccaagacaaatttattatgaaaatatatttaattattgatttgattaaactaatttagtattataaatattaatatatttgcctataaacttagtcaaacttgaaacaatttgactttgaccaaagtgacaatgtcttataatctgaaacagagaaaatagtaattataattacaatttatttcattctgaaactaagtatacacatactaaatcatcattctcaaatcattttcataatatttcattctaaatcatttcatcatttctccaatatctaacatatattccgcagcaaagcgcgaagcatcatctagttttataataaatggctgtagtttctattaaagtgaaggactagatcgattcaatctattataaaagaaacttgcttgagaattgttttgtcgccataattagtctcttgctcctgcatatataccccctatctatgttcttggctttcatgctgtcatgcaccatgcatgtcggtgctctcatttgttcgtcgtcaaatcatcaaaccggttgaacatctcgatcatggcggcagtcgcgttgaagacgaccggccaaaagtttctctcctgccattgattttaattttcatcaccagcaagcaagaattaatgaaccctagctaataacacgcgtgcagaatatatatattgaccattaacgaatgagactatccattttagtggcccctgccatggcggcaaggaattacgaaatgatcaatcacctgattattatatttatcatatactacagatcatgtacctaacctaccttgaaaatagaacacttgtacatgcacttttcaccagatgacctataggtattaatttgttagtatagtatacagtatacaatgtgctacttaaactaagttgccagattaaactaattaaataccggtcgccggagaacgctgacacgagcaactcaaattattccgcggcatgtcttattgcgtgatgcgtagcagtacgtacagctggatatggatatgtacagtttgcttgttcagactgacgatcgatcgactagttatttgaattgccatagtgaagaaggttgttctccatatcaaaagggttttaatttgcactcgattgtgtgatgatcaggtttaccaaaccgtgtgtggttatcatgtacggtaacctttatgtttttgaaaccacggtatatctcgttatatgcgccaaaccggagcggtaatcccatatcaaacggtttggtaaacaccgatgatgctttgccttctcttcattgcttccacactccatccatcagcgagctgtagtagcatagaggaattgaccctcgaccattcgtatagttactccaaaacgtatatacgaattcgttgatactccaaaacgcatataatttttcatttgtgggtatatatatatatatatatatatatatatatatatatatatatatatatatatatggtgtttaggaaggagggactaaactttagtcgctctcataaaaattttagtccctatgggagggacttaatatttttgtgagagggactaagtctctcttttccaaacaccaccataattactcgcattctgttgacaatcaaatttggcactcgaaaaggtgccaacacgttcaacttttaatgtgcaaaagcacaactatatatacatgtgcgtgtgcttctaatgaaaattctttacaagtgtcaagagtgtaaatgtggtgtacgtgtagtacggtgtatttttttacaatgaaaataacatctggcctctgcatcaactaataatataataatgattagtttcatgtgtccgatgaatagtttaggagaaaaaaacatttacaatttgctaataaaactgttacatgcatgtaaagagagcagcaagagaaaaaaacgagagggcgcatgtgaatatagtaggcgaatgcaacataatgtgcgtggagcgtccaattatatgtgaaatcatgtgatgattaatttttaaagatgagtgtttgttgaaaataccatgtatagtgttttcggtcggtgaacaatgcggtcggcactgggagaccactcgttagaccgggttgaccgacgatcataccgacagactctaagggcacccgcaatggttatctataggctctctacaagagatccatgtcagcatattttcctacttggaagagattaaatgaagagagagagcaaagctatctactaacctggagatagtctatagagaaatacgaggcaatggattagagagctatagatacccatgtagacataccattgaagtggtttactattaatctagtctattgctgagatgtacatgttttacagatatcaccttactttaccattacgggtgctctaagagggagtcggtttcgggttgtttcgtgtaaattatagattgcttcattatataacttttagacggttttctattcatatgtgatactattgtatgctgatatgagtcaagttggtgcgaacttgcacttggatgtagagtttctttgttgttcatgtgcatgcgttgcttgaggcaatgagagtatagccaatgatggatcgagactaagcttgggaaaagttgaagttcagacgatcaaggatatcatgcaaggatgctcaggatagagaataatgtacgtggaagtgaatgttttcatatggaaagtggagtcaaattttaattggagtccaagtttgggaagattagagtatagagttgtatggggatgttatttccctagttattttgttggggtcctatatgattaggagtcctagttctagttggattcgtggctagggacaaccatgttttgagtataaatagtacaggggttgaggctagaagtatacatctatatcaactttttgggagagaaaaaaaataggtttcgcttcgacgcttgaattctagttcgtgagtttagagatgaatgctttagatgcactttatgagatgcaataaagttgatccatcttcaagagcatctttggtgtgtttttctctgaaccccgacggtttaattaaccaacggcataggagcggtcagactagcgggaagaccgatgggtggtaggcggtctaaccgatggcatcactgcggtctaaccggcggctagggttcggcctaactagcttttatctggaagtttgactggtgcatctccattagattcgagggtaacctttatttgcactaaaagttcgatttttggtgttcctaccattcactctttctctagtagacttgattacttgtgtttaatcatacattatactcttcctaggtaagggcatgctcgatctgaagcattctccatataatttttgtgcatcttaattagtgcagagggaccagaacgatacatacttccattaccttaaaagatatccgctgttagctagcttgtccagcggtacactggacagtacacacatccattgtgtttgatgtactcctaatttgtacagagaccgaaagtgatacttggaggtacttccattatcaaaaaatatatatcattgttagcttgcttgaccagggggcatgcacaaagctcggggctcgcaagcctgctcgagcacgactcattttataggctcgagctctagacgagccaagcctaaatgtgccaattctcgtgagctttgttgagtcgagctagagcttatgtcgagcctaattaacagtacataatatttttttattatttattttttaaactagtagatcaaataccatttatataaatgtatccatgcaatgaaataggttgttttggtgttgtatatttatcttatttctttttctcctcattcattaatatgattaaataaaagttagttatttttattgatagaatatgtagcactacttatgacctaaactcaattgtcgagttttagcatgtctagaagctcgaacggttacacagactcagctcgaacttttgtctagctcaagcctagagagatgagctagttcgagtttaagcaggtgagctcgatcgttcgagctcggcttattgatagccctagctctcacattgatttttttataaaagaaatggatgatgagcactccctctcctagacctaaggtgtggcacactggcaatggggttatcatcattaggccaagctagtgtgtgtcgttgctgcccggttacgagtcgacggggccaatgattctgtcttccactgtacgccgcgcgctacgctagctaaccttacctttggagcgcacgcgaccgagaggattgcacgccactagcggtcatcgagagatggagaggaaaaatattccttgcatttggcgcgcgcgtgtttgttgcgtatagcatgcagtgcgtcgttgtcatggaccgcgagcatacgaggggagtgcgtctacgtctacgacgcgtgcgggggtagctgccaaattagacaagccaacataataattagccaaacaaaacaaattaggccgtgtttagttgcaaagttttttttttcaaacttccaactttttcatcacattaaaactttcttacacacaaactttcaacttttctgtcacatcgtttcaatttcttttaattttagtgtgaactaaacacagcctcagtgtgagtgtgtgttccggtgtttttgtttagtcttgtcttgctccgtcaggcaagctagctgaggtttatttatagggcaagcggattagctagcgtgcgagagatttgtcagtcaggtatccgctggtcgatctcgtgggcatcatcgtcagtggttagttgcagcaatgctggtgatgtgatcacacacgctatatatatatatatatatgtgtgtgtgtatgtatgtccgggttgtttgttttgttttgctgtgtgaatacgtacgtacgtgtctgtacgctttgttgtttaattcaattttatttgatctttccattttcttaaaaaaattaattgttttgatgaacgtgatggttaatgaatcgaccactcaatttaccacacctatccctcaaacttacaaaatgcagaaaaaaaatcacagcatgatcatgatctcacgttgaatcaattaattttcagttcctcgaaattagtagtatttgaatttacatatctataaagtgatatatcacatattaatctatcttgttaaaaaatttaatagctatttagatgacattaaaaaagacgagaggttatacatatcctctcaagattttattatcatttcccgattttcatggtgtgcagctgcatagtatgtttgacattatctatcttacatgcggaaaaacatgggatcatacagagtgtaatactagtactactatagtattattttctccgtttcacaatgtaagtcattctattattttacacattcataataatatgaatgtgtaaaatgctagaatgacttacattgtgaaacagagggagtagcatatatatgtactgtatgaaacaagatcaatcatgctatgtcatttgatattcaggtgagttattatccaagactttggcttcgatcagttgacagggttcttgccgagattgaaggtgatatatatcagatccgatgtatgcgatcggagatggtgatgtggatcatagatagagataaattagtacgggagaaaaaaactattcactattattgttcacttgttcagcctgttcattggttgacttcattcacacagccttcgctggcacgctttaattttcttctcttcttctttttcccgtttgcaagcttgggcttggcaggctggacttgggccaagaatctcgtaaccctgacaaaacacaaatggaagttcactttaggtaccttaatttgtcgcctgagtctgaaattcgtccctaaaccgaaataataggtgtagcacatcccccaactcacaatactgtgttaattttggtcctggcagtatggtggccggttttggctgacgtgacggctgagtcaatcatgaaacccaaatgtcaggacgccttacctaaataaaaaataaacaaaaacttgtggaccctacctttaagtgacaatctcctttctctatatgtatctctcaaccttttcttggcgacataggtgggagcaggggggcggcgcgccgactgggcattggtggcacggtggaaccacaaggcgcaactggcggtgtggaggagggcgtcggtagtgtgggagaggacgacgggcggcaagaaaggagcagggtggcagcgagcagtaggagaggagggcatcagcggcgtaagagagggagacgggcgacaagagaggagctgagcggcggcaggcgatgagagaagagatgggcggtggcggcgaccgatggaagagggcgacagacgacaagagaggagttgagtggctgtggcaagagaggagcagggtgcgggggagagaagcagtcgttggaaaattgttgttgacatcgccttctcaggggtcttctccggatggcggtagaaagacgctgccggtgccagtgcgatggcaggggagagaagcagttgtcggtcctcatccatgccgccgccaactttgccgcgacccatcgatcctcctcaagccttgccgccaccgccgccacctccactatgacagagagagaccccttcccatcgccttctcatcctatgctagagcggccgccaccactgtagtgccacccgtggcccctcctcctcatccttttcattgtcagtgggggctaagcgcacccttggggagtggtggggcggtggagaaggtgctaccttaacgctgctgtcatcattgacgatttgacatcacgctctgcagagttcgccccctccactcaatttccacggtgacagcattcaggcattggttggctaggacaaaggaagagagagaaagagagcggggaaggaagagaggggggaggggaagatgttgtttcaccgacattggggcctacaaaggttttttattttttttgtttttgctactatgccgcattagcgccacatcaaccgaaaccgtcatctaaatcacgttgggatcttatttgcactagttttaggagttgagggacatttcatattctgcggtgcaggaacgaatttcagactcggggacaaatggagggaccaaaatgaacttattaattacagattgacaaaacacaagatttgcctgtatctttcggaatacactgcgcaggattgggaattccagagaagttttagagaaaaggttgcttgttgtgcgacgcctcgaatcattcttctccctcgcctccaagccatcttaccatctcgacaactccgatccagggaaaagtgaatttcgtgaacaaatagcccaagatgttagtacaaccggaagcccagtatcgaagaaacttacgttgtatgggccaacatttcaagaaatataaacatataaattacaaattttgtcagtaaaatttggagggtcaaactttggtctcatgcaaaattttcacatcgtacactccttgacaaaaagaagaagaagaagacacccatatgaattctacgagaaaacaaattcgcataaattttaagatgtgtcagctcagtcttttggagatgtttttagatgtacgtagagaaaaaagtgagtgtgctttttagaaaaaaaattcgcggaaatttccttcacaaaattttgtcgaaaattcatcgaaaaaataatataaaatgattcgctgcaacttccatcttattctatgagaaaccgacttgatctaagccatgtgaatgcgatggcacattcatccggccccacatgtcagcgagccctagaagcgtccccccaacttcccatgcgtgtcccctcgtcttctcttctcctctctttcttccgcgccccgctccgttcgattcgattcgatttccgcccaaaatttcccaaattcccctccgattcgccgaaagcccaaccgcctctctctctctctctctctctctctctctctccattctctctcgccgccgcgccgcgccgcgccgctcgccgaccggatcccatccatggcgtccccctccctcgccgccgccgcggcctccccgctgacgtccctcgaccttgccaccagccccgccaccgcctcccgccccgccgccgccgccgcgtccgcgctccgcaagcgcccggtcctcctgctcgaccagcgccaccacccctccaccccgaatctcgactcctccgccgccgcggctgcggctgcggcggcggcgggggtggcgcaggcgcagccgccgcccccgcgacgcaagaaggcgggacacacgtcgtcgtcgacgcggccgaggtggcagaccgcgctcagcgtcgccgccaagaacgcggtgctcctcgccgtgctgctctacgtcggcgacctcgcctggcgcgcggcgcgcccggccccgccgcggccggtcgaccaggccgcgatggccggttacgacgcccgcgtcgcggacgtcgaggcgtccctcgcccgcgccttccggatgctgcaggtgcagctcgaggccgtcgaccgcaagatcgacggcgaggtcggcgccgtccgcggggagctcgccgcgctgctggaggagaagaggctggagctcgagggccagctcaagcgcctcgacgccagggccgacgacctgagcgacgcgctcggcgcgctcaagcggatggagttcctcaggaaggacgagttcgacaagttctggaacgaggtgaaagagagcctgggttcgggccccggcaccgaggttgacctcgatcaagttcgtgcattggccagagagatcaccatgggggagattgagaagcacgcggctgatgggattggtagggtagactacgctgtggcatcggctggggggaaagtcgtccgccattcggatgcttatgatgctgggaaacgtggtggtttcttttcttcattgcttagtggagatactgctgctagcccaaaaaagatccttcagccaagctttggagagcccgggcagtgctttccactgcaggggagcagcgggtttgtggagatcaagctgcggaaggggattgtccctgatgcaattacacttgaacatgtttcaaaggtaactttcttggtgattcgtttacggaattatatcatatttgcttccttgcgccttggttaattacttctctagcgcacaataaaattctgtgactatgtctgtctaaaaccaaatcatgtttgacctgaagggatgaccgatgagtagaggtgtgtcatttgttgggtaggtcttatgcataagcttgtagcattttagttcatagtagttagtgggggtgacaacaattttaagcaagacccttctttagcaaaccattatagagaatcacttacttttgtatcgctactagcattattgagcttgtatgttttgtctgcaactaattataattctatatgacatttgtttgtagttaccgaatcatcttaagcattacgtagtgtacccaccaaataggactcatatgacaacaatactgctgcttctatgaattctctctttgctgtatgttcagtggtaattggaaagacacacttttaactttaacttctatgtgatatgaagctgaatgcattctgatcccgcttgtgttatatgtctctctttttaatggtcaatggtaggcttcagttgctcatgaacaagcaatcttttttactaccttttgaatattattttagaacataaccttccgaattgtgagtcgacttttttctaatttggttgtaaaacattacaatacatctgatgattaagcaactgcaaagaaactcatatcttcccttgaattgctaagatggttgatcacttcttgtcatatgccggacttaaacctatgatgctgtcttttatttttcctgtttaatattttatgggcatcatttactttaattttttggttatctcaagttataacctgtagtttattattggaagcctgataacttgataagttataaccttgtaccgcctatttttatgtttgcgtagaacatgctccaattgaagtctcgttatacagttctgcagaatggatttcttactaaatacttgattttgcacactgagaggttttcctgtcacaaaaactattctcagatatttactgattaacttctgtcacatgacatgcaggatgtagcatatgatatgtcgactgcgccaaaggactgccgggtttctgggtggtatcaagaggcacataatgaggcgtattcaggtcatgctgcaagcgcaaagatgtatgtcttgactgaattcacatatgatctagacaagaagaatgtccagacattcgacattacagcaccagatgttggtatcatcaacatggtccgactggacttcacttcaaaccatggaagctccgcgctaacctgcattttccgcatccgggtccatggtcatgagccggtctcaccaggaatgtcagtttctcagtcctgatatgggaaaatgctttggttctgtctcttgttagtgttttggtttagggatctccttgtgcccttgctagttttcagcgtaggatgttatcatgtacactctgtaaaggtaatgattgttttgctgcaatcgtctagcccaatgacatcttttagatactaagagttagacattatgtttgttccatcaatggatggcaattgtggttagtaagatttatttgcgtatctgttgatggttgtttgggcttgatcattttgaaggtaaaacaaccaaagatttcttgcaattctacctggaattcttgtccactttcaaattgggaactgcctgatgctgggattgagtgaaatcatcctcaaatgttcttgttaacatgttcaccgaatctttgtctcacctctgagcttggaggggagtgaatcatctagttgggtgtagttaatagccgcattgttttcacagtccagtgttctcaaatctgaaatcgagacctgagatcgtaattttcatattccaataaatattaattactgtatttggtgatgatgtttgataatatttgattctattttcgcatccgggatttcttattttgattccaattccagaaaaatacatatataaacgaaaacagtaggctgtagtgcagtaggagtagtttccgtcctttttcgagctgttttcgcctctacttgcaaggatttgcagatgctgttgtttaaggtgccgtggaatggatttgccgacacaagggcgataccatacttttacttggaaccatttgaaatatttgacatcgaaaatcttctaaacaaggcttatatcttgtaagagaaaaatgatgggttctagtggtgatcggaaaactagcactttcaatcgcatatctcttctcttctctactacttaaaaaatacaaaaaatttacttcgtccgtcaaaacaaaaaaatagcaaaaaaaataaaataaaataaaagtccgactcccctaagatccaatccccccttaaaaacaaaaaaaaaagtccaactcccctgcataactgccctccggcatgaaaaacggagcgatccattagcacgtgattaattaagtactccctccgttttataatgtaagtcattctaacatttcccacattcatattgatgttaatgaatctatacatatatatctatttagattcaataacatcaaccctaacatcaaaacattgtgaaacggaggaagtatttgctatttttttttcaaaatggatccatatgattttcgtatataagctttttgcaaaaaaaagaagcgtttagtagtttaaaaagcgtgcgctacttaaaaaattgaaaaagtttccttcgtccgtcaaaacaaaaaaaagcgaaaaaaataacaaaaaaaagttcgactagatccgataccccttaaaaatggaaaaaaaaagttcgactcccctgcattcgtttccctaggctggccctccggcatagaaaacggaacgatctattagcgcgtgataaattaagcatttgctaattttttttttcaaaaatggatcaatacgatttttaagcaacttttgtatataaactttttgcaaaaacaaacaaaccatttagcagtttaaaaaacgtgcgcgtgaaaaacaagggagaggggtcgggaacaagcgaaaacgaacgcatcctaagtagatccgattcccccgtttagtagtttaaaaagtgtgcactacttaaaaaattgaagatgtttttgccggtactttggtaagtcatccgtgtatgagtcggtttttaagttcgattgcttttggaaatacatattgtatttaagtcggtttttaagtttgttcgcttttggaaacatagaaagagtcgtataagaattctcttttaaaaaaactcgcatggtaacttaagacgatcggacttctaattatagctcatgaatttctaataaaatatatatccaagtgaattcctacagtgaatttcaccttaactagaccgtataacaacaataaaattaaaatagcattcacccattgcaacgcacgggcatttttttctagtaaatataaaaattgaagatgtttttgacggtattttggtacgtcatccgtgtatgagtcggtttgtaagttcgtttgcttttagaaatacatattcatgtttaagtcggtttttaagatcgttcgcttttgataatacggaaggaataatataagaaatctgtttaaaaaaactcgcatgctaacttgagataatcggattcctaactacatctcattattttctaaaaaaatatatatccaagcgaactcctatagtgaattttatcttaactaaaccatataagattaaaatagatttcacccgttgcaactcacatgcatttttctataataaaataataaaaagaaaatcagaagctttatatttaaaaagtaaaaaaagagagaaaaaactaagaaaatagtcaatgacaaatacactcctttgtttctctccttccattgggagaaatttcagtatttaccatccaatacgatgacctttaaggagctgccacacaatacgctggcctttcaaaatttaccaccaggcacgcgaaattcttcatttggagccactccgtccgcctgcctcgccgtccatccgcgcgactgtctccgagctaggtggcgtcgtcgcccaggcacggtcgtcgtcacctcgcatcccgcccccgccgccgtccccatccccaagctcgttcagcaccgtcgccaccgccgtccccaacctccatcgccaccattcccatccccaagctcgttcagcgttgttgccatgctcgcgccccatcgccgccgtccctgagctcgtctgccactgtcgtcgagctcgcattccgttccgccattgctgccatgcccgagctcgcgtccggtcgccgccgtagtcacccccaagctcgcgttccgctgccgccgccgtcgccccagagctcacgttccgctgtcgccgccgtcacccccgagctttccgctgtcgccgccatgcccaagctctcatccgatcattgtcgccgtcgcccctgagttcgtgttctgctgttgaaccgccatgcccgcaaactccgtccccgtctaccatctagatgtcgacaaaaccatgtgctcctccgtccctatcgaaggtgcaacgtccctcgccggcaaccgcggccggagttagctcagggatgatggtcaagccttgagacgacggccgacaagctcggagacgaagacaaagacggacgacgcggacaagcagacgaaatggcaggaaatgaagaatttcgcgtgtctagtgatagatcttgaaaagccaacgtattgagtggcaatttcttaaaggtcatcgtattggatggttaatactgaaatttctcttccatcggtcccctccttttcctctccgtttccggcttccggc

SEQ ID NO: 13728 - DNA, 6003 bp, Oryza sativa
  unsure (1)..(6003): unsure at all n locations
cccccccccccccccccccccccaacacacacacacacagcgcctcgcgcgcgcttttccgccgccggcgacctcgccggagccgcgcgggttctgtgtacgcccaccccctccctccgtctcccaccccccgccctagccatcttcccttgcgcggcgggcaacctcgcgcgcgcacggccagcagcgagcgagcaggtttggggggggagaggcgacgcggccgcgacctcgttccaccgcgccggcctccgtcttggctttgttcgaatcgaatcgaaggtatccgttcttctctctcgtagccctcctcctcctcctcgccacctcttgagccgggcgtgccgtagtggccgaggtggagatccaatacgaacttgatttcgtttcctccaattaacccttatccatttgtaatccatttgtttgaggatttctttgatgtgtagtgcggcgctcgcagcaatttcctccaattaaccgatgtattgtcatcaccaatgaacaaacacgctaggaaatttgatatacttttggaatgcttgtgttggttcttgcactagacctgacctatgccatgcggtatatctttattttgttgaagctgtgatgctttttgtatctgaacaaatcttccttctgcgtcgcagagatggccggaaaagggagctacgttccgcctcagtacattccattatatggcctggatactgaggaggatcgcgtttctgcggaggagaatgatgccgcgcgccacaagttaacccgggatcctacacaatggtcttcaggcatctgtgcttgttttgatgatccacagagctgtatgctactctctgacctgtgactccttgatttcagaaggaaagataaaaggtgctatttggttgcatgttaggatatggataagaaaataagcattgaacatagtttcctagttagtgttatcgctatgttattattgggtttatcattccacgaagcatgtcatgtgtgaagcactgaagccgtgaaggataagttggttgggtatgacatccaatattttgtactgtcaatttgccaaactggtatttatgccaatggaggcctgaaatgcaaagtagccaaccacctaatagttctgcttcattatacttaagtcttgagtggccattacagtattggtttaatttttagcacattcagggatattgcaagaagtataattaatccaataagcaagttttatcagcattctgatttctgaaaaggtcccttcactttgaagaaaacagaactatattcttatagcctcaaatttcctgatgatttttgtaggttttattggtgcaacttgtccttgcttcctttttggaaggaatgcacagttcttgggatctggaactcttgctggatcatgcactacacattgcatgctttggggccttctcacaagtctctgctgtgtgtttactgggggccttgtattggcagttccaggatctgctgttgcttgttatgcttgtggatatcgacaagcactaagagcaaaatacaatcttccggtacgagcttgaaacttactcttttctggtctttgacatttctcggatgttactggttacatgttttagatttagtagtcaatagaggcagttttttcacgacatattgatataaatggatgatatttccttactgcacaatttaatcaatagtgggatttatggtgaaaattcttcatagttgaactttagttgaaactgaaatctaccttacatatatgtaaggactgcatataaggcaatccttccactgttgctattagtctagcaatttgagctctgccatggtgtcttgcctaccaaagtatgtttcttttgcaagcagtacagtagtaagtgaatagaatctttaactgtcaattgaaacatgcatttggttgctggtttcagtgtcttgtgtgtaatttgattcagctacaaaggtcatgaccaaattgttaatctcaataggagccaatctaggcttccacatgactatgatttcttgatgtgttgtcgatgcattgttcataaatctacagtaaaacatagtaaatttatattttagttgcatgtatctggaactggatgctttgaaagcttacaagagcaagagctgggataaagggatctgtatgcaactggctatatttgataggatactggagtacatcactagggctgtatggttgttgagtcatggcaaatctagtttactgattctaacatgttcatttcaaatatattttcttttgcaggaagcaccatgtggcgatttaacaacgcacttattctgtcacctgtgtgctatatgtcaagagtacagggagatccgcgagaggacagacagcggctcctccgctccgaccgtcacgccacctgcaatacagacaatggatgagccttgaatggaaatatgaaatattgatgaacgcctctctatctgaattctgacgaatctttggttgttgctgcttgcgagtgtttgttatatcttctttgattgtgcttccacgggtactactacgaggctggttccgtagagttgttgtaaagatgatttttcgacaaatgagcaaatcacagtttgcaggtgtagctgtgtcattgaactgtagcacgattgttacatgtaacatttatcttttcacatattggaatatgatggcaaaggtaaagaacacacttgttgtccattgcctcagtttctttctcatattctgaggcttgtaatgtcttaatataatgatccgtagtctcctaatggctaatgttaaaccaacctgaggcccctgtggaacaaaagttcatattgtcttccgttttgaattatttccttagtgtgaaatccattcgtccaacaagggctaaaaactgaattgtacagatcatttgaaccatctatcgaatttaccaaatcactgattacaaacaaatagtacaaagtttgcatgagagttacaaactgaaattatttcggcaaatacagattcacaaatcacaactgggcaaataattttgttcctaaatcccttatttattcagcgagaggattgaccacatgcccaagaaacagtacggcgccggtgagctcctcgacgacggcgaacaagaacggccggtcggcgacgaagtccaccggcggcagtgagctccccttttgcatcataaccacggcggtggaggcggcggccacggtgccgagctcgtccacctcgatggtggcctgatgatacacttcggcgatgaagagaccgtccccgccggtcaccatgccggagaagtcgccgccggcgaaagctcgggtcacgcccagcttccgcatgtcggacttcgcctcgaacttgaacgagaacttgaacttggggaccatgagccgcctcaccggagcctccgccgccggcgtgtgcttcttgatgaactccggcgtggtcacggccatatcgtagagatcggcgagcttgagcgcgccgtcgccgtcggggaggagcaggagcatgtagaatgcggctcggggcacgccgtcgccaccgccgccgccgccgacgttcttgtaggggagcttgagcgccgtgaagccggggaaggcggcgacgtggcgctcgaaggggatctccgtcgtcatgaacggcgcgcgcacggcgccgccgtcgaggaggtggaacggcgcgtggaaggtcgccgacgggtggaacggcagcgaccacgtccccttgaagtggaccgcgttggcgaggacgaccaccgtggaggagtcgacggagttgggagggaggacgtcgcggatgagcccctccgtcgcgtcggacacgaaggcgttgactcgctcccgcgcctgctcgggctgggtggcgaagtcggcgggctcggcgacggcggcgtagcgcgacgcggcggcgtccgcgaactccggcgtgagcgcgcggccgcggtccacccacacgccgcaggcgaaggacgtgttcggcaggtggcggagcctcgcgacgagccgcgtcgtcggcgagcggtgaagctcggcgagcgacggcgagccgaggaagcccaggagctcgcgctgcgtctcgccccgcgcgccgtcggccaccagcgcgagcgccgcgtggaaggacagcggcgagacgatgaagttgcgcccctggccgccgcctgccgccgccgccctgcggccgacctccctcgcgagcggcaggcacgacaccttcgcctcctccgccatcgcaggaggagccatgacgtcgctccgcacaccaccatcgcctcccgtcgctcgaccagagaacggctcaccggcggcgagcgccgccatgggcacgcggtcccaggaggagaaaggacgaggaggaggcggtggcgcaaactctggcgcgtcgtggcgctgcaccacatgctcgtcccggttcgcccatgggtgcggcgccgcgaacgcgagcccgagccaaggccggccgccggaacggaagctcaggacctgaccggcgccctgctcgccgctgccgacgaggaggctcgccgcgcctgcgcgtgcggctccggcctccgcgccacggtaagggtggtggcgccggtcgtggccgtcacggcggtgagctgcggcgtcgtggcccatgagaaggcggcgatggaagtgaaacaagctttaagggaaactgttttaaacacttgggtagatgtccactcgtttcttgtatgtcatctaaatggttataaaaaattttcaaaaaaactaacatgataggttaatatgtaatatatcacttcacaaatatgcaaattcaaattcgacttctacaaattataacaaaaataataaatttgactgtgaatatacgtacactagttagagttttatttgttatttttgttacaacatgtagaaatcgaatttgaacttgtatatttgcaaagtgatatattacatattaatctatcttatatttttttaaaaaaattagtggtttcgtgagctagtgaacaaagcttggctctcaagtcaacgaccaggtcacgctttgacttggagagagttgactacaagttgactagctacgcgcagttgcttggaatcgcgactacaagattcatctacaggaagcacatgagctataaaagtgatactcgagctacaaaggcttaaattttgatttccacaacattacacgtccatctgtttgttcagacatctccttttaagttggctctttttgagacggagggaataagtgaatacatttttaatgacaacctgtgaagtagaagctcaccattaacttttgtttcttttggtccctccgtacttataaagaaagtcgtttaggacaatgtttaagtcaaacattggaaatataaatcatgaataactcttaagttgttaagtttaaaaatataaaaattatatgaatagatttgtcttgaaaaatattttcataaaagtatacatatatcactttttaataaatatttttatagaaacaagaagttaaagttgtgttttggagaccgtgtcgctgtcctaaacgactttctttatgagtacggagggagtacttcacgagactcgaatgattgacaacgtctatagcaattaatcggagtactgatagttaattaactatgtacacttttcatcctataatataaagcataattaaagttgacaatcttttaaaactaatttttaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13729 - DNA, 1697 bp, Oryza sativa
  unsure (1)..(1697): unsure at all n locations
tttgcaggcggccccccgcacagtgttaaactgcccttcctaagggcggcaagggggccgcctgcaaaatggtagtagccggccgttaggaatgagctaacggctgtttgccacatcacaaaaatcgccctttgggagggcgatttttcccaaagggcggcgggcgactaattttgtaaaattttgaaacacaaaattagttttgtaaatattttaataaaaaaataaaaataaaaaaaattctccaagatgcaacgcactggcctgcctagttatgtgcatgctgtgtgggccgtaactcactctctccggaaggcccaaaccgcagctcaacgcttctctcctctctctctctctgcagcgcttccacgctgcactgccgtctgcagctgtgctcaggaggataaaattgcggaggggatccacagttccagccgcgtgtgacagcggcgtgcggttgccgcggcgtgctgctcgagccgctttacgactgatccgagcagctttttccggcgatcatgtcggacgcgcccgccaccggcggtggatttcccgcgcaggaataccccaccatcgaccccacctcgttcgacgtggtcctctgcggcaccggcctcccggagtccgtcctcgccgccgcctgagcgcgcgcagggaagacggtcctccacgtcgaccccaaccctttntacggctccctcttctcctccctccctctcccttccctcccctccttcctctccccctccccctccgacgaccccgccccctccccttccccctcctccgccgccgccgtcgatctccgccgccgcagcccgtactcggaggtggagacctcgggggcggtgcccgagccgtccaggcgcttcaccgccgacctggtgggccccaggctgctctactgcgccgacgaggccgtcgacctcctcctcaggtcagggggaagccaccatgtggagttcaagagcgtggaggggggaaccctcctctactgggacggcgatctctacccggtgccggactcgaggcaggccatcttcaaggacaccaccctccagctcagggagaagaacctactcttcaggttcttcaagcttgtgcaggcccacattgccgcgtcggctgccggcgccgccgcggcgggggaaggcgaggcctccggtaggctgcccgatgaggacctggacctccccttcgtcgaattcctcaagaggcagaatctttcgcccaagatgagagcgtaaggaggccagcctgaagctggttttagtgtactctatttttagcattggtgtctaagattagctttatgtgccttgttttcagggttgtcttgtatgcaattgccatggcggattatgatcaggatggtgtggagtcttgtgagaggttgttaacaacgagagagggagtcaagacaattgctctttactcctcatctattgggaggtcacttagctgcttgaacctttttcttgtgtatactttggagagacatttcttttatgaattgagcaatccacattcatatagccttgaatgagacatatagtctatgagtggggtcttaagataagtttctcgctgtgtccctaacattttatatctgtttatttcaattttaacaggtttgctaatgcagagggggctttcatttatcgtatgtataggcatggtgagttgcctcaagcttt

SEQ ID NO: 13730 - DNA, 541 bp, Oryza sativa
tatatagactattgctacaccaccggtaacttctgaacaatacaaagctttaacatatcatatgcacaaacatctcgatcagtacaacatgcacctgccattaagccaaaaaaaacacacgaatgcccaaaccctagaaccctgtgggaggaagggtgaagattggggggggagaacgggtggcttaccatcgagagcgcgggcgggtcacttgcgacggacttggagaaggcggcgcacaggtagggaccttcccgacggcacaccggactcaggaggagtcggcgcgcaggtcagaggaggtggagtcaaaagcggtaagagaggaccgctccggagacggaggaggcgagctttggggggtgggggggcgagaagagctaggtacggggcggaggctcgccggaggcagctctgagcggcgtcgagttcgtcggagtagccggcggcggcggcggcgtgtcggctgggggatttcacgagtcgcgggggaggggggaggggggagagcgtcgagcggtccgggtcggtggatggaaaa

SEQ ID NO: 13731 - DNA, 656 bp, Oryza sativa
aataggtttagggagttttgaatgagattccaccatgtccaagctcaaccagtcacctaatcatcattcttacatattttagttgttacccacagtctaatttatagaaagggattctatgttagatctaagcatagataagcccaacctagagcaactagtaagtccatcatatagggaaccatactagtcattttatcattttactaaggttgacaagagcatgggtagcaattcaataacatggctatataacgaggatcacaggaatattaactattaaataaataatagtgaacgttatataatttataaaagtgatgcatatagaagtaaaacaacatagttttttttgcaaaaatgggattcaatatgttcaaggaatatggtatgacttgccttgctcgaagagaaggtcttctgacaacttgacctgcacttcgggaacttccgaaacgacgacagctacacgaaaaaaaaacagggctacaaatctaagaaagaaacgataacaatacataacaacatcaaacaccggttccttaagttataacaaaaattaaacaatttgaacgagtcaattaggagctcgtatggccgagaaacgaccaaccgaattttaagtgcaattaaaatggatatttcagagttgttta

SEQ ID NO: 13732 - DNA, 719 bp, Oryza sativa
attcctgcagcccctcctgctctgaaatgtttaatgttggttagttcatttgaatgaactaacgtcatacaaaaagaaacagagggagtattataaaaatttagttagcgaggctgtaatgtaacttggagacgaaaaagatgaaaacatcagttaatttatgccaggagggctatttgaaacttgcttttactatacacctaaagaacatcagcagtgcaattgaaattcacgaagattggcgaggagcatatttgttacactaatgctataaacccttgtaaaagtatttcagtgttatctcattcaaacaaaaaaacattttttttcttcagaagatgaagtgtgttgcctgtgaaatgtttcttcatggccacactgacatgtttgttctgtaggaagtattttgccgactacctgttccatatgttaatgaagacttcaagattgattcaaccatcagggatttcactgcagctgtctgcaaaccaccacactttacgtttatcagacgcagtatccttaagtaacagttatagaatgaagcctttagctattacattttctataatgaccttcgtctttgtctgcttttcatctctacatatcctatttgttttcttgatttttaaaagatgtatatttaatcaagaaaaaacgtcctgattctcgcgcggaagctgggtgcacaaactgcagtgctgattctacgtgcaaag

SEQ ID NO: 13733 - DNA, 4149 bp, Oryza sativa
  unsure (1)..(4149): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggacacttggaaacattcgtcttgttggtgagctacttaagcaaaaaatggtccctgagaagatagtacatcacattgttcaggtgcgcatgcaatctttcgcgtttagttgaatataccatcaaatgaaaatcattaagtcaagaatacgcatgtgccagaagtgcacctaatcgggatgttaagactgactttttatcagtttgtttgaacacccttcatttgatgacacaagacatccttgtttgcactttacagacctattgatttacctatcaactaaatattttcttacccattttctgtaaacaggagctattaggttctgaaagcaacagatgccctgctgaggaaaatgtggaggccatctgtcagttcttcaacacaattggtaaacagttggatgagaatccaaagtctcgacgatttaatgacgtatacttcaaccggctgaaggatctaacaactaattctcagttggcatcacgattgaggttcatggcacgcgatgtccttgatcttcgttcaaaccaatgggtgcctcgacgtgaagaggtacaggtcctcaacttctctttatatttgtattactctccagaatttttatctgcccagtactctctactagttgctaatagctatgcagtggttattaataacagaaatgaaaccaaattagattactaagaaccttcatatatatggtgagatactatgttgagtcttttgaatgcattgttttttggaaattgcccaagtattgccctggtaatatatacatggttacaccacaagagttagtcatgatggtctgtttcacacgcttacaatacttctacctgacattagttcacttcaagtcctatgtaccttttgcaatacaccgagtggcactcattctagtagtcactgagcatgataaacatttagatcttggattctgttttactgtttctatcaaagcaatatgatattattttgctatatgaattgctctgagattctgttaattctttctcagatgaaagctaagaaaatcagtgaaattcatagagaggcagaaaacaatcttggattgcgtccagggtcgactgcaagcataagaactggccgtactggtactggaggtggaggacccctttcaccaggagctttttctatgaaccaacctggtatagttggcatgttgcctggtatgcctggagcgagaaagatgcctggaatgccagggctaggtagtgatgactgggaagttccgcattctagatcaaagcccagagctgatccagttcggaacctcaccccatcattggccaataagccatcacctaataattccagactgcttcctcaaggcagtgcagcattaattagtggcaagacgagtgcacttgtgggcagtggtggcccactatcccatggtctggttgtcacaccatctcaaactacaggaccaccaaaatcactcatcccagctccatctgtagatcctatagttgagcaaccagctgctgcccccaagccaagctctacagagcttcagaagaagaccatatctcttcttaaggagtatttccacatacttcttctacatgaagcacaacagtgcattgaggagctgaagagtcctgattactacccagaagttgttaaagaagccatcaatcttgctcttgataaaggcaccaattccatcgatcctcttttgaggctgttggagcatctctacaacaagaatgttttcaaagcgactgacttggaaactggatgcttgctttacagttctcttcttgatgagcttgctattgaccttccaaaagctccagtacattttggtgaagttattgggcggctggtcttgtcacattgcctgagcatagaagtcgttgaggatactctaaagaaaattgaggacagtttctttcgtgctgcagtgtttgaagctatgatgaaaatcatgaaagcaaatccatcaggtcaggctatcttgggctcacatgttgctaagatcgacgcgtgcagcaaacttctatcctcggaataaatatttgtcgcaagtttgactaggccaacttctaccttattactgatgtcctaactgggaatgttacattggttatttgttactcggtagttggcaggttttgccctttcagttcgagaaactacaacactgaagttgaggaacagctttttgtgagctgtatttttttgcaaggtcagatgactgataatgaagtaaagaaaagctatagatttagctctgataacaccgtaacaatacctcgatggtggtttacgcggctactcctcttgtaacaggtactgctgcgtgttggcaagcatacttgttagcgttgggtacaactgagttcataatttagtcgaaagttgagatctgatgtaattcttccagccaatctcatgacaatttattcgagatttgtttggttcaatttaacctgtcaatgcagtcttatcttctcatctgaggctgtgaggtaggatatgggaattcgtactgtttgcatttcgcgctcttgcgtgtcatgaatctgatggcctcattgtttcgcttatttatgaaataagccaaacgatatatttgtaaacgaaagtagtttatgaataaagcaaatgttgaaaaatagacttcaatgaaaaaaaatctcaaaattagctctaaatttaaggttgaaaatttaaattttgactgataagtataaatgaaaagatgaggtcacgagtgactagaggcaaatgttgttacggcgtaatgcagacggtagcagttttttttttcttttaagaaaaaaccggcctctacatctggaacagatgcatacggctaatctttgtttgaaatgtgcattgtctcaatttccttagtagaatcatatagtttctgtcaattcccttagtagaatcatatagtttctgtctagtggattaatgtagtttcagcctagtagatccatatagtttcaggctttatggcaaacaagacttttaatttcttattatacacatatgaacgtacattttttttcgagactaccaagttttagatcttagatcgtctcgacacgtgcagacctttaggtaaaactacgtttggctataactctggattttttacaaagtgaaaattttacttcacaaatcacaagagtacttatgttctataaaaaacaaatctaaaataaaatgtgtcacattctatattagattcttttttttattgaacgaagggagtactcatctaacgttacaaaaccacataatactgttgcacaaccactagcaggcggcaggtttggcattgggcgacaaaagaccattgcaagaactttagagcatgatgtatgtccatatcgaatgtagagatcatgttttaatctattgcaacaaactttacacgtcatacatagatatatagatatatattgataattcctaatataatatactcccttcgtcccagaatatacaacctagaaccggattagaagcatcctagtactataaatctggatagggggcatgttcagattcatagtactaagatacgtcacatccgatcttaaattgctatattttgggacggagggagacagggagcattatctttatgattgtagtattatgttgcctatcagtatgttaaaaagaatggcaccattctcttttctctttcccaatcttttacgccattaaaaatcatgttggtattttctttaagatgataacgtcacaccattacttatgccttacagcaagtataatagtgagctactccctccatctacttttgatagtcatatttcatcttggcacacagaccaatatttcatcttgccttagagcaagtataatagtaattctacttatcatccatttaaacatgctactagtcatt

SEQ ID NO: 13734 - DNA, 5108 bp, Oryza sativa
ccgggggcctatggactactgcgagcacaaaacaagaataaaagaaaaaaaaaatctcaacgcatgatattgtacgacacaacattatctcaacaagctacattaagcatggcaacaagcactaatcacaagttcataattcatcatccatttgcaaacaagtgtaaatagaagagtatgtactaaaacatatctcaactccttaagattcaggctttgtacttgggtttctactactagagccccggttgaagtaactcttcaaatctgcaaaacaaattacacaaatgcaatttcagaaacaaatttgtacactttgaatttgcaaattgtaatattcttaaattgtcaacaatatgtacctctttgtgatgccaatgccttccctttcctctttctatccattttctgctgatgacttggcttgcttgctatgcttggtgttggtgctgcactgctgctggctggctagttggcagaggttagtggctggctggctgctgtgcgcctgtgctggcgatggcgccctctgccctgcctgcgatacatggctgcacccctggctggctggtcacttcctgatagctcgcagtcgccgcctgccgcagtgccatgctgtgctggcgcctggtgcggatgccgccgctctgcgcccgccgctcgggagcctggcggcctcgcccctcctcgcctccaccttccctctcgtgcgccgactccgctccagcaggcagcagccgcaccgccgatggggattagggtcgggatgaggattgccggattggagaatcgatggaggtgaaggagatgggggaatttgggtctagggtttaatagtcaaaagaaacatttacatgaaacaagcccagcttggcctgctacctgttggtgagcgtacgtgcggatgcacccacgcagcgcctcgcgccctttcatgttgctcatccaaagcggcgttgccgcgctctttgcggctcggcgccctgctgtccggagaaagtgtggggggtggggggtttatcgggtggcgtgaggtatagcgagcgccacacctcgccctaccgagccctccgccactgcttaaatactataatctttaagcaaagatatgtggtttgtgctactgatggtatttattttttatttataagcagtacattggatagggttgttgtattatcagggaatcactgtctttagataataaagctttctggttgacataattgtgatgctgaccatgctatcatattactatttagtataacgactcctcgcttttgtagtactagcctgatatatttcaggtaatggatactctggaaatatttaccttttcaggaatttgttgaacactctgtagttatggcatgtttgcagtatcatcaaattgcaccattctttcttgttacttgaagcatgcattgaatctttttttttcttttggtatttgtgcaggctgggaggcacaccattattctgatgcaaccatcccaaaacagggcttctagaacatttatggattataattcaattaaccatgcattggatggtacgtacggttttgaaagcttaactaatgatgcaatgcttagataatagcttagatattttttttatatggtcctagtgagtacgatatgatcttgcaattttatgaattcacttttctcatgtgatcgatttgtttagaaaaattaacttgaaagttcaataccatataaactgcaaacgtccaaatttgcatatagtgcattagagacattatcaggatttatggcactagactctcctcttacatattatttgttgaaggctgtttttcagaaaggagagagggatgttcttcagctgcacattatcaattttttttggtattctgtttaaaacattgttttatttatgatctgctatgtgcccgtttgatgcatgacatgtatccattctactctgttataatcggaactatttcatttcttcaaatgtgcttcttgatttattttacttttgctctttgtaaattactcaccacagctctcttctgaaatgacaggactgtgtggtctttatgaaaggaaaattagggacataaacccaatggtaccaaacataacatatgatatcactgacctctataacttcattgatggcctagctgacatcagtgcactagtgtgagtaaaataacttttaaagaattggatcagaatcgtgcaatgttaatttatgtgtatagttttcaaagtaaaaaacaatcagctactatttttttctgcatttgcagttatgatcactcaattcaggcatttctgccatatgatcgacagtggataaagcaaaagttgttccaacacttgaagaagctagctcagcggtagtgagtggtttcagttcgatatctctcaccagcgagaagagatgtggccatggttgtcagaggtgttacctgtaaaacaatgagagtttcacattgtgtgctcatattctgacaaaacttaaatttcaatgggttgcctctggtacccaatatatcagttaaacttatctgctgtgtctctttgtgaataaaagaaggatttggctgtatactccttttcaaaatataagacattttgtttcgttaggataaatatttgaccaaaaaatactttattaggatataagttttgtgacatgaatttattatattagtcttcaaaagttcgtacttatgcttatgcttcatttatcgcataaatgatgtccgagtagagcgattgttattcaaaccttaccctaacggaacaaaatacgtcatatatttttgaaatggagggagttttgcttttatctgtccgttgccttattgctcttgttcaaacatagcagtagttccttttgtgcctatcatggtttacgattgtacttcccacaatcccacgtccacacaacttgacctaatgtattatatttcaaaaatgaatgttgattcaaagtgtggtgcgcctgtctaatctctctattctacgaatcctttgctcaagatttacaccgcgtttttttacacggatttacatcgtgtttgctccaatactacctaccataagaacagaataaatatatacatagacaggctgatacgggatggaatgctcataacttagcgcattagtgcatctgcaccaatttgacagtgtgatataatttcattgttcattaaaatgtaaacatttatttggtgacaaatgcctatgacaggtaagtcataactgatatttgctaagataaatccgattgttggcacaagcacaacctagatatccaggcgttacagtgactaaagactattaagtgtgagcatgcaagtacaattgatgaggaaaaaaaatcccggcaataacaggacaagcggccatctacttgtatgaatccatagttcatggaggcatcttcaaaatgaagacatctgatatcagatcaaacaaaaccaattgaagccggaaattttttttgccgcttcagttgacagaattggctatggcgtcgtcagtgctacttcaagattttcaaaccagaatcagtgcctgaatggcagctgatcactgccaacggacaaagccttaaccacgatgcctaccagttggatgaacaccccccctaaccccaaaactagccttgaccccaatctcaattgttggtgatggaacaaagccatgggatttcatcattttgaaatatttattggcttcttccgtgaaacccccttcgagaaggcctgctataatcctctcaaaatgataagccttcaataatttcttcttctcctctaaaatcttgagggatttgcgggttctctcttcctgttgtgactttgcgtacatatcagcaaggaaaacatgcatttccaggggttcctctccagcctttctaatcttctgcacaacttgttcagcctcctgcactagctgcaacctagacaaccaatccagcaagacaaggtttgttttaactccaggtttaagtccatccttctctaacttcaacaggaagctcagagcgtggtccagttggttcttcatcatgtaggcaaccatcataccagcaacgcaacgatcatctggttcatgtccagaactcctcatctgctcaaacagggtatatgcttggccaacgtgaccaccccgtccatatgcttctataagtgatgtgtataactctggcgtgagctggaatccagcaagtaacatcgatgttttcaccctttcggctccatctatcatgccacgctgagcaaatgccaggattacatccatgaatagttcctttgtgggtttgatcgatctctccatttcacgtaacaaattttctgcttgttttggttctccagacttaagatgagctctgatcattgacgtgaaaagcttcatatctggtgggaagccttcccccttaaggaattgaaatgcctgattggcttgttcaagattccccaccttgcaatacatgtggactaaagtgatggatgtgacgacatcaggtgcaataccattctctttcattttacctagaatcctttctgcgtcttccacatgatttgctttagagtgaagatcgattaacttagagtaatcacgaatggttgcaccaaaggattcatcagccagcagaatttcagcaacctgtaaattacaacacagcatacatgtgaaactacaaaagagatttcaatgtaagtggatggctgaaggctttctaaactcagtggcagttggccaactttacaaaatgcaaagtactccctcaatttaaaaataatggatttaaatgccaattgtccacaaattgaagtttcatttccatgtgaactagcctgaccacgttaaatacagctgaaatagtcataggttacagagaaaagttggtgcagaacaactatctcaatcatgggaaagctggacatgtaatagcagtctatctgattatgctagtagctaaaacttaggatttcaatgggagacgaatgcaacatttgcactattcctaaataggcaacaatcatgaacaaatatcagataacacatcttattgtttaaaatcttcaacaaaacgctgaacaaaattagtggtca

SEQ ID NO: 13735 - DNA, 1691 bp, Oryza sativa
aggagtagcgggctatatatttgtagccagctgtagcacggattcaaagacagtgtgtgtatgacaagtgggaccaggtattaatagtgtagtatataactattgtatgaataagctattggattggctatagttgaattggagctagtagttggctatcctattaaacttgctcaaatgatgatcttttgagtgatcaaaaggacacttggtggctacatgtaaatgttgctgtttattgaaggacgaatataaatttgtcaaaaaaattcatcttatttcgtccgaaaagaaaattatcctttgatatgttgcaaatcaagtgagagcagcgctaaaaaaaagaatggcagtaaaagtactaaaggtgtgatgataaaattattagtacatgactcaacctaacatacttcaaatcttcacgtgtaaaaaaaacacaaatgggtacactttgaatttgaatttagtaaggttagaaatttataataaagtgagtatagtttaaatggttagattccttgtgatcaagctagcttacccaaattcgagccatatactaaacatgaatgcttgtatttacggttaaatattttcattaataggtgatatacctgtcaacatcgaggcatttgtggtgacttcgtcaatatcaaaatatgccgtttaatctttcggatgtgcttctaggtgtaggatgctagtaagtctttatcaatctcaagatatactagtcagtctttcggatgtgctccgagcacccgcgtttgtaggtgaagtaaaaaaacaaattcatatcaagtgaagggtctattcgcaagtttgagagaaacgaattccgaattttcaagcggaccactctgcaaaagcagcacggggaaaattttcactcacgaaaaaattttcacccccaaaaaaacgttgcgaggcgcggccgcgcgggggctccccccttcttccccaattcagacctccattccccccattcccttctcccccttctgcacgactccacccacctccaatgccctccaaaccctagcccataacccctcccgcctcgctgccatgccagatctgagcaccgtctgcctccccctctcgccgcaacccccctccaccgccgccgccgccggcggggagctagcaggcgagcagcccgccgccgccgccgtcaccaccgccgcggcggcggtgtctgcgtcggcagaggcggaggcggcgggggaagcagaatccgcctccggtggcgacggcgcgcccgttctcccggtggaatgccgatggagcggccgagttcgcagcttcgcgggcgctggcgagggcgcgggcgcggccgctgtccccgcgtgccccgccccgcgccgcgggggcgggaaaaagccgtcctccgcgccgtcgccttcgtccacggtggcgaccgcgccggctcatccatcgggtcggccgttcgaggagtacgttaaggagtggaaggcgaagaaggcggcgctcggcgtgccggccggacgctgcgagctgcctttcctaaccggcacgcctaaggcggtgcgcgtttttcttttgctcgtaatgatatgctttgatgtagtaacagatgcttgagcttacttagaacttttgtttgaacaaactgaactgtctcttcgtgggcatgacgagtgaaattatgactttagaagtgatctagtggt

SEQ ID NO: 13736 - DNA, 2906 bp, Oryza sativa
tgaatgtcgattatttctaagattattcatcctggagaagaaataaagtgttcggttagtagatgtggagaattgttccacctgacttgtgcagcagaagataccacaaatttcattgctgaaagcttcaaatgccctcaacatgtaagctccgatcttatgaactggagtgtgctctagtatgtgctaagtctctcgtgcacataagggagcatgtaagattttactaaagaaccactctaaataaaaatccactgctgaaatttgtaggcttctctggccatcttatttaatttcataacatggatagttgttactttcatgcaatgtacagacagtacagctgtgcattatttattgttttgaggccaagggatgcagtatatactatcacacctacgggtaatacatactcccaccatcctaaaatatagctacttttagcattcaataattgtcccaaaatatagctacctttgtacctactctctcatctcaaccaatcacaaccatctctcatttaatgtcttcacctacttcctcatctcaaccaatcacaaccatccctcagtttattttacttttctgcttgatacccatgcccaactctagatgtcattatattttgggacggaaggagtatattaatactgagtcaaattctgtgtagttttaattgtataaatctatcacatgttcatggccagctgggcagtacaaatttatgcaatatgtgtgggggaaggaacatatatttaaaagtgaagacttaattatgatcttctaactttgagctggtcttgtttgtagaacattttttaaaatatcctattttagccctaaacattcaattttgctctattttgtccttttaatggagaaaacttcaatctaatgggtcccaagtcaccgaccatgcatcacatattcacatgtgttcacaccacatgccaaggcatggaaggctattttttcaactaagagcacaggagattttttttttctttttcaaatgaggttgtaatttaaggtgctggagaataccttccaaatgttcatgtcctaaaacaaatcagagctcactggtagctgcccaaacaaaagtaatttgtgaagttaaaagtagagtattggacatttatcaattgtccttctagaagcttccctagagtgttttgtctgtagccaaggagagttgctgcagtccatggtgctgttatgttataaacctcttttctctctctgtttttttttggtgttatgtttcacttcttgctcttggattaatagtgatagttttacttgaacttgcattaatttaattttatctccaatcagggctgtatggtctgtaagcaaaagatgtttttttggcgttgtggacggtgtacggttgcagcacatacaaaatgtgcaccatggccagtaattcatttaaaagatgaccaaggaagtgctatctgttggaggcatccctctgattggctccttcaaaatgaggtctatccttttacccttaagattgaccactttatgttgctagatgccccccaaaaaaaaatctagtacaatatgatatgttctcaagattcaagaaaaaaatgggtgtaagattaaaactaaattgttggaacatacttttttctccttgggtgatgttcattttcatttttttatctgtgcaacaaagctattttgttttactgtatgctgcattattttaatgtcgatgacaattactgctttggatggatatcaaattgtctttatatataattattttctcacttgtgctcagtgaatgtaagacatgttttccaagtttctttcttgtcgctttaacctctcttctgttttaactcatcttatcctgcttatataatattgtttgatcttgctagaagttatttacagtattagttctttttctagaagtgttaatgcttttttataagtgaaaagtcttaatcttctttttttctccatcttatcataacattgctggtattcgctgggttcctaggctaagcaagctagtgcaatcacacatgaatgcatcaaagtccttttggtgcagctgtgacactgaactatcacgatccttattcatctttcactgattcgtttccggaattgttttgacttcatcttctctataatttttgtactcctttcaactacatgaaatgattgtgacactatggttccgttcttattagtaaggttcatgtgtagcatcattttttctattacttgcttttaaccagaggttaacaaacttgtttcatggtttcaagcccaatgctgatgtctccattacattcaaaattttatcctaatttggattgtgggaaattaataaaaccataaaaggttgctgtttaagctaattcttttgaagaatacttcaaatagtcatttcatatgccttcttgtaatatttgtaatgtttgaagtgtctgacaggactactttgtttaatggtggcagaatgctgacttgacgaacagcatagaggttagtgttttgtatgatataactccattcttgctatattctcttctatatttgtttcaattgcttttagataaagccattgtgcacatttcatagctagtcaccttggaatacctggatggttcaattataggcttctgggcatgtttctcttgtttttttggaattctgctaaagtagtgctccccctatgtcacaagacaaatggtattttgggatgtgaatttttgcttctttttttttacttcggctgatatttgtgcagctatatataggatgccacatatttttatgttcatttgtaattttagtacaatatactcctgctctgaaatgtttaatgttggttagttcatttgaatgaactaacgtcatacagggctgcagga

SEQ ID NO: 13737 - DNA, 18820 bp, Oryza sativa
ggcaccaatgtcctcttctaacaaaacagggtgcatgtctcagcatgtagctatgtcctctgttctttttacctgtatttttgtacattatgtatgctgggaatttaatgccaaatttatcaatatcattatcatataatgaactagtcttaaaatgttgaccatgcattcaaggactagtaagactggataccatttttccaatttgttttaatcaaatgtagcctgacatttgtttcttcaaaatatcattacgttacgtatgtgtgaaggttgccgttgttgttttcctatataaatctttatctgcttttgatagctgtactgctgtagctaatgctactgtagctgagggtgctttagcatcttttttgccactcatttcaaccactctcttctgccatccaaaaattgccactctctcgttaccactcttctgttgcctttttacatgtttctctgagttctaattttttcctgcactttatcaggggcctttacatgagttgttccaagaattgccactgctcagatatgtgtacgaacaagccattccgcaaggataaaaaaataaaagctgtcaaggtaattatgtcctgcaatttttttcttgatttcgttaaggacatcaattaccattacattcttccttacctgtgtaactctttcggcatacatataaagttgcatgctgtgatattatctgccgtaacttttcaaatttgtcaagttcctcatttgtcgaagagcctgtgcttttagctacaagttgtatcatcatggaacaactaacttactgattacattatttgaattttacctaaacttggaactgagcttcaaacgttgatgatatctaataacagaagtattgtgccaacgactcaaaagtattcaagtccacaaacctcctttgtattgttctttaatgtaaaatggcatatggctatgatagtgctgtttgaagttgtcatgccatcaaatgtagattactttcaccttctgttgacacctccgggcaccatcattcttcatttgttagggagaataagtctgtaactgcagcaactacttttctgtacagacaaaacgttgtggatggggtgctatttcattggagccattggaaaaaggtgattttataattgagtatgttggtgaaggtacaagttactctaccatttaaacttatattatacaaattagcatattctttagtaaactgtatgcatgtcattgtggagtcacattatgccattacagtacaatccaaatttcttgacatgaatatttcctgaagataaatttgaagcaacttattggtagttagcatgaaaaagcctgtttagtcattgcatctgtttaacagaaaaggtacctcagctttagatgaaaacttattatattaatctgaaaattggataacgagtgtacattttgttcccactctattttataacataacatagctacgaagcctacaattatgaacaatggcagttcttgttgccacttattcttgtgaccttagctctttgtggtttttattttattactccctctgtcctaatatgtagctatttctagcagtcaaagtgcatcctaaaatgtagctatttctctacctaccttttcatctcaacccatcataaccattctccatttaatttcttcacctacttcctctgctcaaccaatcgcaacctttccccatttaattcaacctacttctcaagaaatgcttccattttgggacagagtatgtctccttcactgttttttagttgagttttatggcgctgtgggatagcatcgtattatatctttctgggtttgattcaaaggctcttagctattctctctataactaattacaacaacttaatgctatgctcatctgttcttttcaaatgcttttctaatgtgttttaaacattattccagtcatcaatgatgcaacatgtgaacaaaggctttgggacatgaaacggcgaggtgataaaaatttctacatgtgtgaaatcagcaaagattttacaatagatgcaacatttaaaggaaacacatcacgttttctgaaccacagttgtgatcccaactgtaaattagaaaaatggtaatgccatctttttggaacagaaaagctctgtactcggtgtttgtgaacagtatgaaatgattaatgttcctgattgtctatgtggcttgtccaggcaagttgatggtgagacaagagttggtgttttcgcctctcgttccatccaagttggagaacacttaacttatgactacaggtatgtgcaaacaatagtttttcaaactatatttttaaggatcctaagtattcttactgaaaaaggtataatgaatacattcttttgatatggagatatagttcctgcatagagaaactgctttcctgcaatcagctatggttaaccatgatttgaaatatatgcatatctagtggagtatatgtacatatgtaaattctggtgtgtgaactagaacctttgtactattattgtgtggcatgtagcttttacatccacattatgggctctgtgaatgactcggcaagaaagagagaaaattacctcgttttttgcacgcatgcttcccaaactaataaacgggcttttttggtgcaaagaacatatatacgaaagttacttttaaaaccatattaatccattttcaagtttaaataattaatactcaattagttgtatgctaatggctcacctcgttttgagtatcttctccttatcttttctcctccactcaaacgttgttcacttgcttcccacttcctcttctagatggtgaatttccaaatcatgcttcggtagcagaaacaccacgatttttttctgttattttcttatgaaaccaattagcatttgtattagattaaaataccgttattatgtgggagcgttgaaacggtgactattctcccagcccacacgaagaaagatttttttttcttccaggagtcttgtgaataataatgattttctatgagcaacagtaacaatagttcacgttccttttcaggtttgtgcatttcggggagaaggttaaatgctattgcggggcacaaaattgtcaaggttacctgggcaaccaaataaagaatcctacgcagcgtgctctcgcaattgcagcattggagaacgagtggcttgaatctttgaagatacaacaggacacctctgcttcaagacacaaaccgatgacacatttgttaccttggaccaactgtatagaggtaccatttaacttgagaagcaaacggaaaatacaccggatatgctggggatgcaaaaggaggagatcagccgttgccgttacatctccaacaagcatacaagcgtcagttactgaagctgctgctgctgctgctgctgcatccctgcccgctttgccatgaagtggcaatagctgaagtcgcttctcatctgtataatataggatgacacatttctcacatgaaattgatttttgaacgacgattcttttgcattgctcctccccaccaccaccaaaactccctgttgtaatttgttacaatattcatttgattacatagtttgtttaatttacagttgttcgctgagaatactcgactatctcatgtaatcaatgttgtgctccaactctcgattgcctcagccctcaagttgaggcgagtacatgagggctattattgtcttagagaatcttatactattattttgacacattccttctggctagtgacaaaatatcagaaacacggagaaggcactggtacagaagagtatatcagatttcaacattcattcactcaacatttctagattgacactgaagcatttcttcgtggaaagtaactgcatttgaaatagatcaaatcaacaaagcaggggtacctgtctcagtccctgttgcagaaccacttgggtcactgataggtgcagaacagtgataggtgcagaacagaagtcatatttgccaattgccgtagtgttcgtacacagaatcaaatcagcgtacaaagtgctcaattcattgcctgatagcaacaaatgcagtctcaatcgactcgaatcagattcccatgcaaatccaatacgcaagatgttttgacggtccaatagacatgccaagaagtacctatcatccatcacacaagggaagaaaaacaagcatcttgacaaagaaataatgtgccgcctcccgcctcccaccatcaccagaatactaccacacaaccggaacaaacaaagggagtgacaatgccgacattattataaaatgacttgtattatattcccaacattaaagtttgatattcggatacattttgctcactgtggcagacaaagcagaccacctagagcccttttattcagaatatatgcaagataataaagaacattggtcatagcatatactagtactatatgaatagtctggctggctgcttcacaaagtaacagagtgatcgctactggagttttgagtattctttaatcttcagtgcgcttccctcatcagcagctcctcatcttcttaccctctgtgccatctatctcctcgacagcatcgtcttcccagtagagagcctccattttaccagctttctccgtgttttcatcagcaaagcaatgcagaacagatcgtggcgacccggtggcgatttcagcagtagcagtgaagctctggtaaatgagcaaacccccagaaggcagctcctgctcaaccatgttgctgcaagaataggccccgacatccagccccttggcccaggtccctgcatggttgcggccaccaaagatggtaaccgcaacagagaactccaacgggccaaagcatctcaacaccctcttgacaaggtcaccataggcaagggaagcagggttgaagcccatgacctcgtagctggcatagctgaagccatcctcaggagtcacatgaatggttgagaaagcagggccgtggatggcattcatggagtagccgcagggctcgaaatcgaagtcgcagacttccatctctgggatgatgtcagagatacctgagagcttggtcatttccttagcatatgttgtgtgtccatcagcagaagtcttgaagaagacagaagctttcttcttgtccagcccagtcatgcacatctcaagagtgaccacaggttgctccgggtgctgggtggcatagtagacatgccacttctgccctggctttgcaggatctccaatcacgtatgcgttgccaccagatttgagaccgccgaagtagcggttcaggactgcaacctcctcagagaagttcttgtgtggagagggctgtgcttcaggaaaaatgaatgtcccacgagagtacttcacagcttcaagtggcagagatagctcttcagcaagctcaagaatcctcggaatggcgagcaggagcttggtagtcccacaggtcttgatcacaatcttgtatgggtacacaaagaggctcgattcagaaaggacatacgagtcgaagacctcattggagagctcagacacaatggtgcacctcgccagatcaagaacagagtcaatctgagcacgtgacagtgcacgcaaccccctgccattggggtcagcaaagacaggcgcctcggagaaagtgatctcgaggcgtttctcatatccctcaaacccgatcgccgagaccggtggagagtcagcaactgacaggactgccattgtttcgaaggacgatgccagagatgaggaagaaaggaagcaggactgatgaccttcccggtcactgggaagcagctagccagagagatgtaagaaagcccaaaacgagaattcagaggagtaactaaactactaggtcaaggtagccaagggggctatcaagagggcttcctcgcgcactgcaagagatgaaaacaatttaacaccgtgagcaaccaatcaaccgccaattagagaaacaaactagtgttcagttgattcgatacatacgttggagtaagcagcagagcggaacttcttgatgccgccggcaggtcggaggtcctcaatgctgtagccgaggggagcttcgtacatcagggaggaacgactactgctagacttctttttgccacccttggactccattagtgcatcaatttgttgactgcagagaagaattaaaaggatcgatgagaatctgcaagactaggcaatgcaacagattgtctgatcgtcaaagtttcaattactaaagagatacattcatgtttcatcaaccgtatgaactggagggaaatttcagtaattcgttctgactatgactattatttgcaaaagcataagaaatttcagactcaaatagcagattgtcttgtcatcaaaatcttcgttgcttttgagacacattcatatttatcaaccatatgaactacacaaaaaaatcaccaattcttttggactattatttgcataagcataagaaaattcagactcgaatcatataaccaaagtcttaattcctttacattcatgtttcatcagacatatgaactggagcgggacaattatttgcatataacataaaaattcagactcaattgaagaatatttcaatcagccacctgtggctaacagaagagatgagatcgaaaatttcgactaagttttgacatacgaatctattacgatatagataacttatcatacatcgagcacaaggggatctactcagcaaaaaatcataaacagaataacacgatatagatcagaaaagaaaaatatgaattcagaattaccattcacaagactgagtgattaaagattatattttgacgccaacaaaggaaaatacttctcctaccattcgtaccgaaaataactacttttcatagatcatctaacatactagatcaaacaaacaaacgaagtactagacagaacatcaagaacaggtcgcgcgagatcttgcaattccttaaacaaaggaaaatacctttcctaccatccgtaccgaaaacaacaactagtcttcacagatcatcaagactatagatcaaacataaaacaaacgaagtaactaggcagaagaacaccaagaagaacaaacaggtcgcgcgagatcttacaatttcctcggaaataaagttacgattccccgctcctcctcgtcgcagatcgatctcgaaccttcagggagaagaaaaagatctccccctccggaaaatcggcagcgctcctctccctctctctcctctcggtttctctcgaccacgagacggggaagagaaacaaagtgtatgggaataccaaaacgaaaccaaccaaaagatgaggctgagaaggggaggccttcccttcgccgtgtatttatagtggggtggtggtggaggccgcgggggaggaggtctcgcgtgcaaaggcgtggttcactggacccgcgccgccatgtggggcccacctcgcgtgccgattccaccgccgtgggggcagggggaacccggggtgggctgtggaccgcgtgcacggagttttcctttttttttttcttcttttcttctcttgccttccaggctggctgggctggcgggctgattctggacggctccctctctcggtgggtatgacaggtggggcccgcacgaggtgctgggcgggacgcgtggacaggggcgcgtggaaacgctcgcgacctcgcgttcgctggatgcgtcgacgagtcgtgggggaaaagaattgatgcttttttttttctttttttgcgcggctatttcggaggagtccgtagtataaaacgtgttgctggatgacgtgcttatcttttttttagagagagagagagggagagagaattttttttttgttagagctatatgacgtgcttatcttcatccatatcttttttatggtgctgctgcgtcatttgaaaaaaaaaatatgcgtttgctttctttttatttaatttatatcgatttgagtcatcgaataaaaagacgaaaaagcaagtttcctggaacgacccagctttcggccggtctcgaaacttgcgttgcacggatcatgccgtcagtaagtaacggaggcattaggtaacatcggcttgacatcgtgaacacgctttctaaactgttaaatgtgctgctgcgtcatttgaaaaaaaaaatcatgcgtttgctttctttttatttaatttatatcgatttgagccatcgaagaaaaagacgaaaaagcaagtttcctagaacgacccagctttcggccggtctcgaaacttgcgttgcacggatcatgccgtcagtaagtaacggaggcgttaggtaacatcggcttgacatcgtgaacacgctttctaaactgttaaatggaatcatttctatccaaattttctataataaagtggctttacaaaatcatattaacttatttgaattttctattttttattaatatttaattaatcatgtgctaattagtcatcagttcgaaactatggtttgaaaccgcacgcgacctaacaaggaataagttcattttgagcttctttggcacagctccagctcatgcgcatctctcctaaaactcagttaaacagtttcagctccacctaaaatggtagtgtaactggggtggagctgggtggagcgctatcacaaaatgaactagagaggtggaggtgggtttaggctgctccacaactccacagcaaacttaactccttaagctaaatttaggaattggagttttgccaaacaggccctttaggtcccttatgttgacattgtaaacagcaataccaaaagttttgaacccccccccccaccaacttgtaaaatcggttaaattaggccctccgacggtatagatggctggtttcgctgatatgacaaattgatccgatccacttgtgctgactaggcgtttgcatgggaaaaaaaaacaaaaatgatcccacatatcatgctcactcttctctcatcctctcccccgcccccaattttctccccatctactgcaagcaagcaagttttaagcagtttacaggttttgttatagcttgtaggcttcaccaacaccgcacacgacgagtgtcatggtcagtttggtcccgaggacgacacgcacgatcaaggggatgccgacgcatgccgcagtggcagcgcaagcggtcaaacccagacacgtcacgagggtggggggagaaggtggaggtggatgcgttgtgatcggcgaaaaggggatggagcacgacggtagactgcgaggtggcatggccgaggatgacgaggacgcatccgttctcacgggaataggaggagtgcatcatggcacgacacggaagtcgtaggcaatttggttctagagtatggcggcctgccatgctttgcgtggtagtgggctcgcgttgttcctgccatggactccctcatcgcgagcagatagaaagaagagtttgtgtgtcgttattgaggcggcgatcgcgataccagcatccaggctcgattggcttggcggcgtgatccttctagctgccgtttgccagagatggagagaaaaaggcgagagaggagggggaagagtgagaatgacatgtggggctcatttttcctcatgtaagcgtttagttagcacaagtgggtcgggtcaacccacctgaaagtgcatctaggacccctcatttattttggtgttaatgacaacacaattagagggtaactaatgctttttgttgagatgtatgcaaggatgaaaaaggagtggatgtcaacacaataagtattgcggcatcttttgtggtaattgtcttctaatccatgtatatcttgtgttcttgagtattaggatgtcgtactattaagagggatgccacatgcatataattggtagaacactagtgctcaaaatcatttatttgaagtattcctgttttatgtctgtcggactatccgatgttgatcagactatccgatgctcagactatccgaaatttcacagaactttgctcactgtcttgggtctaagtgttggctaaaaaatatcggactatccgatataaggtcggactatccaatacgtcggactatctgaaatttctcagaacttcactctctgttttgaattgctttttattccttttgagtgagttttaaatcagactatccgatgtaatcggagtatccgatgatccagagactccgaaattcaatggaacttgagtctctgtgagaggatgaaattcttggttcaaaataacggaatatctgatatgacatcggactatccgatcgatcggattgtccgaaattctccagaatttcgttctctgtctctggcctgcttgggggtcaaaaacatcggactatccgatgtcacctcggactttccaaggtgggatgaaaagattctctcccaacggccacattttgagggcttctataaataccccccacctaacccttttctagggttacccaactcatttcattctcattcactttgggttgagcttggtgctaaggtgctttggatctttgagctctttctccctctctcaaatccctccttgttctttgtgtggtggatcttggtggttgtggatttggggtttgagggcctagtgtgtgtttcactcgatcttgagcactagggttgaccaagagttgtgtggtgtttgttactcttggatgttgaggactcctagacggctaggtgtcactcccgagccaccgatctacgtgtggttggccgggagaagtttgtgaaggccggatctcgcctccacaaggaaagagataccccttagtggaaggaggagtgcttagtgcaacctcttgaggaaagggttagcaaagacccggctcttagtgagctcctcaacggagagtagaatcccctcaaggatttgaactccgggaacaactcggtgaatttcattgttggtgatatctcttctcccattatttagctttgcttttgtgccgctatagatctagtcgctgtttgcgccatactcttgtttgtgcactagatcttcttgtagtgttcttttagtggatcagacagtctgatccaacatcagactatctgatattttcggatagtctgactgttgatcagactttccgaccctaactcagttttagtttccgcataaagttttaaattatcctattcaccccccctctagacctaattgaccctttcaattggtatcagagcataatctcctaattaggcttaaccgcttggaagcataagatgaagatgcatttgaagtctattaacccatctatttggagaatagtcgaaaaaggttatgttttgcagaatcccgaagatcccaccaaggaggacgacgagaatgagcacaagaacgctcaagccgccaatgcaatacttagtgccttgagtggaagtgagttcaaccgtgtggatggcattgagagtgccaaagtgatttgggacacgcttcagaacttgcatgaaagcacggatagtgttcgtgagtccaaggtttagatcctcaaggggcaatttgagagatttgtgatgttggatggtgagagcccaagtgacatgtatgaccggttgagcaagattgtcaatgagatcaagggacttggctccaaggacatgaccgatgaggttgtggtcaagaagatggtttgagcaatcactccaaggaactctaccttggttaccatcatttgtgagcgtccggactacaagactctcacacctcatgatttgcttggacacattcttgcccatgacatgcttgtgcaagactccaaggaggtcatccaatacatcaaccaaagctcaacgacaagcatcaagaagtaagacttggcattgaaggcaaaggaagaagaagaagatagccacaagagcaagagcaaggaggagatcgatgatgaagaaatggctctcttcgtcaagaagtttggcaagttcatgaggcgaagcggcttcttcaagggaaattcttccaagcatcactccaacaagtcaagtggaagacattctgcaagagtgtgctacgtgtgcaaagagcccgggcacttcattgcggattgccctcacctcaaggatggttcccacatcaaggaagataagaagaagggtgagaagaaggatgagaagaaggagaagtataagcatagcaagcgggaacattatggccaagctcaccttgggatgattttcggctccgactccgagtcaagctcaagttatgaagaaggagtcgccacattcgccgtcaagccttcatcaccgccaagactcttcgactactcaagtgatgaggatgctcccatttgcctcatggcaaaggagcctaaggtaccttctcctcccaaatcatttaatgttgatcttgttagtgatgaggaggatgaggttgaggatgaggttatggatgacaaattgttcaagtccataactaaggaatctctaccacacttgagtgagttgcttgggagaattgaggaccaatatgcaactcttgagaggcaagaggctttgctcattcatgagaaagagcgatctcatgaactcaagagtgagcttgctaaggagagagagaaaaatgaggctttggcacggctttacaagcaaaccaaagagtctcatgctaatcttgaggtggcgaacgctcaacttcaagagagagtggatggcttggacaaagcatacctctctcttgaagagaagttcgaaaccttaaagaatagtgtctctctccctagcgaaccgtcttgttccaaaattgttccaagcaatgaatcatgtgtgagatgcaaagatattgatattgaagcttgtgctactaactctatttctttgagtgctttgcaaaagcaaaatgagaagcttatgggacttcttcacaatggcctacttaagtgccatatggatagtaaggccctaaaggagtacctaggctatcaaagggacaacttcaaccatgagggtcttgggtatgttcctccaccaaaaggaaaggtggacaagagtatgatgataaagaggccccaaggttttagcaattttgttaaggcaaaaagtatccttcctaatgattctgcttcacattgttcttttgatgcatcttatgttcttaggaagaatgctagtggtcgtgttgttgctaagtatgtaggaccaagggacaaaaatttttccatcaagagagttctttgggtgcctaaggcacttgtcactaacatgagaggacccaaacaagtgtgggtacctaaaactagaaattgatctcttgtaggaatatctctccggtggaagaagttgggtgatcgatagtggatgcacaaatcacatgaccggagaagaatcaatgttttgctcccttgatcctaatggctcttcgcaagagaacatagtcttcggggacgatggaaagggaaaagtaatgggattgggtaagattgcaatctccaatgacctttccatttctaacgtcctcttggtaaagagaatgtctcttactttcgtgttttcggtagtaagtgctacattcttaataagaaggctagatcctcaaagtttgctcctaaagttgatgaggggttcttgcttgggtatgtgtcaaatgaatgcgcataccgcgttttcaacaaaacctccggtattgttgagatcgcgcgtgatgtgacatttgacgaaactaacggctctcaagtagagcaagttgactcacatgtgttaggtgaagaggaggaccctagcgaagcaatcaaaagattggctcttggagacgtgcgtcctagggagccacaacaaggggtctcttcctcaacacaagtggagccacctacatcaacccaagccgacaatccctccacttcaagcttggatcaaggtgaagaaggcgagcaagtgccactctctccgataaatctagctcacccaaaaatccaccaaagtatccaacgagatcaccccaccgacaacatcttaggagacatcaacaagggagtatccactctttgcaaatttttgtgagcattactcgtttgtatcttctattgaacctctaagggtggaagaagctcttaatgatccggattgggtgatggcgatgcaagaggagttgaacaatttcacccggaatgaagtgtggactttggtggagcgacctcggcaaaatgtgattagcacaaagtggatcttccgcaataagcaagacgaggccggggtcgtgataaggaacaaggcgaggttagtggcgcaagggttcacccaaatcgaaggattagatttcagtgaaacatttgcgccgatagctagacttgagtcaattcgcatattgcttgcttttgctactaacctcaattttaagctatatcaaatggatgtcaaaagcgccttcctcaacgggcctatcaacgagttggtatacgtggagcaaccaccgggcttcgaggatccaaaatatcccaaccacgtatacaagcttcacaaggcactctacgggcttaagcaagcccctagagcttggtatgagtgtctttgcaatttttttgtgaaaaatggctttgagatcgggaaagccgattcaactctttttactaaaaggcatgataatgatatttttgtgtaccaaatatatgtcgatgacatcatatttggttctactaacaagtcttttagtgaagagtttagtaggatgatgaccaaacgttttgagatgtccatgatgggtgaattaaagttcttcctcggccttcaaatcaagcaactaaaggaaggaaccttcatttgccaaacaaagtatttgaaggacatgctcaagaaatttggaatggagaatgcgaagcaatccacactcccatgccatcaaatggccacctcgacctcaacgagcaaggtaaagacgtcgaccaaaaggtataccgttccatcattggctcacttctttacctttgtgcatctaggcccaatattatgcttagtgtgtgcatatgtgcaagatttcaagccgctccgaaggagtgtcaccttgtggccgtgaagagaattcttagatatttagtgcacacacctaatcttggtctttggtatcctaagggagcgaggtttgatctcattggttatgccgatgcggattatgccgggtgcaaagtggataggaaaagcacatcgggttcttgcaaattcttgggtaggtcccttgtttcttggtcttccaagaagcaaaactccgtcgccctatccaccgccgaagcggaatacgtttcggcggggagttgttgtgctcaacttctttggatgaagcaaaccttgagagactatggcctaaatgtgtccaaaatcccactcttgtgtgacaatgagagcgccattaagttagccaataaccccgtccaacattcccgaaccaaacatatagatattcgccaccatttcttgagagaccattccacaagaggcgacatagatatccaacatgtgagaaccgacaaacaattggcggatatcttcaccaagtctctagatgaagctaggttttgtgagttgagaagtgagctaaacatcttggattctcggaatgtggcttgatcttttgcatgcatttgtttttcatttactagaataggtttgcttgctacatcatgacaaagtgaacattcaattcatgaataaacactagtcataatctatgtggataacttgaatctatgtgtacggggatctcattctctaatgaatcttggtccttgcacaatttgctatagattcgtacattccctctctcgagggtgcctagtttttctttcttttgctgcatttgtccaagtaatagtctagccatcgagttcatcctatcaaaatgttgttgaaaaattcttccttgagccatcctttattgtctctgccacaaaggatgtcggactgtctgacatcaagtcagactatccgaccataatcggacagtccgatttcaaatcggactattcgacgtggggccaagggcaaggggacttaacctccctaggggtaactctttcttaccccttcagtcatttgtctcagtcgtttctctctccacccctcttctccactccaaaccctagttctaggccaccaaaaatcttcgtttcggagtctccgattgctattccttcgctttagggtggtttccctccctcaactccttccaaatcactggttccccagtgattctcttggtggttcttgaggtatttccttgtttttcctcgatctccctcatgatgtattatttcaagatttccttcggcgaatcttcttgttttagtgtctagatctagtacctacaagatcctttgattctattggatattcttgtgtgaatcgagatttgttggtctagggcaaaaggtcgtcggattgtctgatatgccgtcggatagtccgatgtacatcggatagtccgacgtcaaatcagactatccgaccttcttttggcccagtccaaatttctccttgcttcacatttaagtattcttcttccacttcttcttaatctttatcctctgttctaaatcagtgtatcctcatgatcaggggtcagttcaagaatcaactttactctcgccgtgggtcaatgagttctcaaggtcgctctccctcttccaaggctcgtcatgctatacggcgtatgtccgaatcccgcaaagatgccattgacgcgcaagctcaagcctctgaccaagcagctcaagtggctaatgtggagtgtggtgctcctcttcctcttcgccgcagccgagtcagtggagaaggatcaagtgcacctgctagcaaagtaaggagaggcaatcctacggattcttctgagccgggtcacggtagtggttctcatgcaccatcctttgaggaagagattcagttagaagaggacattgccgctcagcaagctgctcaggaagaagggcctttctttatcactgctccctctagagatcctaattatcatcgaagagtcgtaaggtggaaccgcaagtggactgaagtggagaaagagtgtaagaaagatccctacaaatttcaacagttgtccactgatcctcggttttggaacctttttcagcaggattactatgagatagtgattgcacctaagaagggggctattcttatgcagtgggttgattggaagtatatggaggagttgcatgatccaattattgatgaagtcattgaagcttgtgctcggcaaaacttgaaggaactcatgggcttgcaatacccatggtgcaaggaaatcatcgcacaattctatgccacagtttactttgagcccaacaaagaaaagactattcattggatgatagatggcatcatatactcagtgtcatatgccaagtttgctgccattttggggtttccggctccaatcgtgtcaagattcatgatgagaagcccatggacacaaattctcttcacttcttgtaccaagatgtggactatgagttaggcaccatcaaaggtctccttcccttctatgcctatctcaataagctcttgcgcaaaactcttaatcccaaggaaggtgatgctagcaacgtccttgcctatacaagaaatttgctttacaagatgaaggctcacccacagctctttgacgcctttgacttcatctttgaagaaatccggcttatctctatgatgcctaagcgaggacttagctatgggccttacattacgaagatgattgagattgtgtccaagaagaagtttcacaaggaggtggcacataccggttaccaagtccgtcccatcaaggctgctgttgtgccggctggacgaaccactcgtgcttcttctcgtgccggtcactccgctaccgtcaccaagccggactccaactcgtccttgaggttcttcaagtccatcttcaacttatgcaagaccatctcagttcggcaagccaaggaacgcagagcaaggaagaaggacactcgacggctcaagaacctccttcgcaacgcccatttgccgtgttctcccgatggttctgaggttgaggacagtggggaggatgtgattgaggacccttttgcagctgaggcaagctcctctcatgcggatcgtggcaaggctcctatggaggaagaagaagaggagaaggaaggtaatctatctcctttcgtgatggctagtcgaatcttgggcttttgtgtcttgttatgtgcaattatctattatccatgctcaaatgtgtgaaatatcttgtcattggcatatgcatgaggttatattgtcatttctaatctagtgcatagattgagggggagctctcctatttcatttctagcatatctttagggggagctccaccaaaatcctaatcttttattacttctaagtgtgttgtcatcaatcaccaaaaaggggagattgaaagtgcatctaggacccctcatttattttggtgttaatgacaacacaattagagggtaactaatgctttttgttgagatgtatgcaaggatgaaaaaggagtggatgtcaacacaataagtattgcggcatcttttgtggtaattgtcttctaatccatgtatatcttgtgttcttgagtattaggatgtcatactattaagagggatgccacatgcatataattggtagaacactagtgctcaaaatcatttatttgaagtgttcctgttttatgtctgtcggactatccgatgctcagactatccgaaatttcacagaactttgctcactgtcttgggtctgagtgttggctaaaaaatatcggactatccgatataaggtcggactatccgatacgtcggactatctgaaatttctcaaaa

SEQ ID NO: 13738 - DNA, 12773 bp, Oryza sativa
tcgatcttgagcactagggttgaccaagagttgtgtggtgtttgttactcttggatgttgaggactcctagacggctaggtgtcactcccgagccaccgatctacgtgtggttggccgggagaagtttgtgaaggccggatctcgcctccacaaggaaagagataccctttagtggaaggaggagtgcttagtgcaacctcttgaggaaagggttagcaaagacccggctcttagtgagctcctcaacggagagtagaatcccctcaaggatttgaactccgggaacaactcggtgaatttcattgttggtgatatctcttctcccattatttagctttgcttttgtgctgctatagatctagtcactgtttgcgccatactcttgtttgtgcactagatcttcttgtagtgttcttttagtggatcagacagtctgatccaacatcagactatctgatattttcggatagtctgactgtggatcagactttccgaccctaactcagttttagcttccgcataaagttttaaattatcctattcacccccccccccctctaggcctaattgaccctttcactaccacatcatcaaaaccatccatctatacctctgaaggaactaattcaacccggttttgtaagttgggtggtcaagatttatgatattgcggttaaagaatgtgatttaaactcgacattcagatgaggagcataaagtgaacttattccgcctaacaagtccaatggcatatcaagcccaccaacacacgtatccaagaaaaaagcccaccaacatagcgggatggaccatcgctccttctgggcttattgggctatacccaatgggctcttctggtctgtaagcccatcagctacaagaatccaacccccataggcctaaagccatggaggctggccgcggcccacgccagtttcgcccaccaagcaccgccgcggccgcggccgcctcctcggcgtcccgccgttgcgccgcgcgacgccggcgggtaaccgggcgccccgcctccccggagatgatggccgaggtgcgtacgcgatcctttccagaagcttccgttccatctgtggagtcccacaccgcccgctccatcccatttggtacccgccggctcgccgccattgttgcccctaactaaatccgagaaccggggggatcattctggaagtcttggtcctgcgttgtcaggggtcatcagcgacgcggaggctgcgaagagggggatgattattgcaggagggtgtggtcgtgtgcggtttatcgatctgcggcggtaagtaggttaaatttagtactaggaaattggattgcctcatcctgtggttgcatcattgccccctgggaggctgggaattttgcgcctctctcattttacactcaagtgcctgcgcacaaatcttgtcagggaaaagctatagtaaaattccatgtcgttgggtgcaaggaagaagcaataatctatttagattgatatggcagtgaagcttctgatctagtttattaactatagtgtaatctctctatgaatgggtctaagttggaaggtttcagttgaaaattggaatattcaagttgaaagttttgaagtttgtgctagaagctatttttagatacggaaatccatcggttggctaaattagtgaatattctgcttcctaagttgaaatagggatatttaatagtttgaatgctcagtttaaagtgttaaagtttgttttgcaagctcagcttactagctgaaagtttcacatgttatatagccttataggtattctttcagttctttagaaattttcactagttggtaatagttctcttttggtattgacataatagaacaatgataattccttcactaagttgattattctgattcgcattatatgtcatggcagtttattatttaagagtagtctgaagcttttgaagtatttcgaaatgaaattgcaaatgctctatgctttgttctctatctgttttaacatttcagactgaattgcgtttcttagggcctgtttgggggagctttagattctgagaagcagctgtttggtagccagcttctgagaatctggaaaagctctgaaacccagcttctccagcttctggcatcttagttcatttttcagaatctgtaactacagattctcagaagctgtaactgataagcaagacataggccctgtaactacagattctcagaagctgtggactgtttggggcagcttctaacagaagtagcttttgggaaaagctgcagctgggagaagctcccccaaacagggcctatgtcttgcttatcagttcagtttgttcttctcaatgtttccggttgcaggtaatttctggttatggcagtttagtgtcatcatgattactgcctacagtgcacttcaatatttaccactgcatgtctttcctaattcacaccagtggaaaaataaatttacctatgataaattgattagtgaattgaaatctggtgtctattttttagtgtggttaatttgataggcctatcctaatacattgggcctatgtctttttaatgaacaggaatctggtatccaagtgtgcttaattaaacaaaccaatcctaatacattccattgatgacccatttactctttctgaaactttactggcacatataaacacttcatttcatttcccccactttttacatcacccttcatgaccatgttctcattcatacaacatcttattctgttgtattatctattctcaatattgctaataagttccttcttttttaaaatcttcagatttaactgaaaacagcacctgctgacctctgctttctgacaacaaactaaaaccaggcactgttttactggctatattgagtaccacatgtatagtttgccacagtgaggccttagcagtttctctgtgtttcgtacttcaactttttttatttgaaaataatatatgtccttactttcttttctataatgaagtttgttggcttcaagtgttttgagtgccaaaggggacgatacactggtgcctctgagaaatttgtgaagtactacagatcactttaccatggagaatgggtgagtacactgctaccacttgccattttaaactgttgtggcaaacgacaacttattcagctagtatcaggataatctcttttttttcacatgcattatttctgaatgcaaaacatgtcagatatcgacttgggtacacaataccaatgataaggccatgtaaaactaacaagcatagttgtttccacttaccaattaacacatgacttgatatcagaaatttgttaaaaaataatggtgtttccttctgttgatcttcatgttattcagttagtgtgatgcttaagagcggatgtattagtgtcttctcaaaactctttgttgattaaacctcactggatgaatagtttgctggtgtccggtggcttagggctactttggtttgctaccataccaaattttgccctaccaaaatttggtagggtaacaaatcaagtactgtttagttttaaaaaaaaataaatcaagtactgcactaccaaaacgttggggttttgttcacatagttgtctctcatagtcacattttggcatcaaatcaattctactcttctcaactttcctctaccaaaaatttggtagtcccaaacttgcccaagcattgggctttgcactactaaaaattttagcaggtcctcaaaccaaaccagccattagttttctgcaatcagcattcattgacctggcccggacagttttctgcaattagtttatcatcgtcagctatttttatctccttgaaaatattctcctcggtgactgtgtctttgcacctttaatagtcaatgtgcgggtatgtacttgcacatgcgaatagtggcttgagcatgcacatctaatataggcacttacagtgtacacatttaccctctcttcctttattattgacctacgcattcctgtccttttattttcttccccatgcacattaaaactatgtaatgtaatgtcattctcctagaatattacgatttgatcatttgaataaaccaagatgccacacatccgtcctccagatttcttgattgcagttgattcactagtactcgcgaccttttttatcctccaatgcattattgagttcaccccaaaagaaaaaattgctgggcatcatccatgccgataacagttaacacatagaggaaaatcaagttaacaactttgctgctgagcagtctgcaattaattggtaatcaaacagcggtttgatgatgggagaaaaagaaaatgtttgaaggctagtaatgaatctttttgcttttattccagaagctaatacgaggtaatggtgaaacgtttgtttgtgtccatttatagaaactcatttaaacaatgttgacatgataaatattggaaaagattcgaacatgctcaggaaattgtattaactttgaccaagtgtttcactttccagcatgaacactgaaatttttgacatgacctgttttcacttaaaaaaacatataacagtctagcctgagaaaatcatgttttgttgatctggtgtgcttctgactgtgttattaaaactggaagcaatatctctgaactttcaatttggtttgtaaagaatttgactgtttactggaggaggtcgaggaatgggatgaataaaggtagaaaaggacgtgtccctttcccggaccgctgtaaaccttaccctccctgcataatcaactcgttgatcaagctacactgttccattctggatttagtgcgtcgatgcttttgtcctgtgttcttcatagagtcgctgcaaaactgttagtgatgctttcctttatgttggcctaataattggctacagttacttcacatgtggttttctttggacctcactttattcgcatattgctgaattgcatttgcattatttcaagcgtgcaactgtttcatcctgtactataaccctttatgtcatcaagaagcactgtactgtaattgttgggaattgtaggacaatgattacgtattgtctactctctccgtcccaaaaaaggcaaactctgagtttccgtgccaaagtttgactgtccgttttatataaaaaaattttataattagtattttcattgttgttagatgataaaacatgattaatactttatgcgtgacttatctttttaattttttttataattttttcaaataagacgaacgttcaaacgttagacacggaaaccagggtttgtttttttttgggacggagtgagtatgaatgtagtagtgcaccattgtattcatcatggtgagttttgaaaacgagcttcttgcttgctgtaagtatagattttcttgaaagaaagagtcgtacgtctccaatatatatagaaagtttacggattcacgactagggatgagaaggctcccgtgtgccagaaacacctggtaacatgcaaaaaacacacacggtaacaaacatacagcggcttcattgatttaccgtgcgcacttcttgggtgttctatgattttgaacacgagatggccagaaccatctatatatagtgtttagatatagcagatttctatgggtgtgtttagttcacgtcaaaattagaagtttggttgaaattaaaacgatgtgacagaaaagttggaagtttgtgtgagtaagaaagttttgatgtgatggaaaagttgaaagtttgaagaaaaagtgggaactaaaccaggcctatatatggtgtttgtaattaataatcacttcatgctgttctccaattcaatgagctgagagttatgaatttatacaaatgtctcgtagttataggtgaagatatctatctatcttttggtgcatatatgcacaatcttttagtttgtgtagtcaacagtatggaaaatattttcccttccacgataacatatgagcaatgtcagctaccaaagtgttatatcctgttaaactaaagagccttgtcaactagtatggagtatatctgaaacttaattatctgcttacatttaaattacaacttcaaattaagacgttgctgattgagaaacacctggcaaatcaatagggaatattaaggttgttttcctttgagggggacgttgggaactcttccttctcagcacttaaaacgaaacgatagattagcacataattaattaagtgttagctaaaaacttaaaaatggattaatatgattttgaaaaagtccaaatacaccctacattttagatgaaagtttatttagcactttggactttgaaaccggacattcaaccccctaaattttacaatattgtaccatttatataacctcctaattaagatggttttgcatagtggtttttatctaatttgcatataaattggataaattggatgagtttgatcacatggcatagacattatatattggacacatatattaaaatctccactattttttttccttttacccattttagaaaattttgtataaaacttactatttagcagtttgagaagcatgcacgtaaaaatgaaggagtagaagttttaaggacaaatgttacaactcacagaaaatttatcattagtttctttaaacatactttggattttgatttcacatttcaagatggtgtagagcaccataatctgaataatctcaaatgttacaactcatgtgttgattcatatttgatgtacaaaccaatatgctactttctctatcttgaaatacttgtcattttaggcagtttagcatgtattaaagtttaagaaaaaataacatagtctccctcattaaatgataatacagtatatggttattagaagtggtgtggtagttagaggtataatagtgagaaatttgaatggaagatgattggataagaagtattttaaaataaatcttgaatgttagaaagataactattttagaatggagaaagtatgtttttgggcggtggtcatgtgttagctttaatttatcttctcgatcaattcatgtatggatagataacttacggcaaattttgctacaggacatcacgactttgcggttttagcccacggacaccgcacgaagtgacttttgggaaagacattctcaaaagttggatatttgctggtggacaccgcacccattaaaataataattttcaggtgaggaggagagagaaatcgcgtgaaatgtcaaaagtgcccttgggcccacatgtcagatctgctattcctctttctcagacagtagcaacagggaacggccgtggcgccgacggcggaggaggccatcacgcacgccacgtacggccgctgctactactccagccgcgtcgtgttccgcatgcaggcccgcctcatggcgttcgcctccgaggccttccgcaaggtgctcatcccgggatataggtaaactccacgaacaacccaaaaacttccaaacgattagccattctcgccgaaattgagctcgtggttggcgccggaattcaatcgaacaggttcctgccaaccaagaacaggatgtcatggggcatggacagggagatcaagcgcggcctggtccggctcatcggccgacgcagtggcggcgacagcggcgaggaagacgagaccaccactgagctcaaagacaagcaggacaacggcttcaacacccgggccattgtgctgctcgccgtgcacccagactggcaggaccgcacccgtggctctctccaaggcggagcagtggggggtttccgtccgctcgggcgacacagcaggtgtcgctgcggcgtccctgcacgcgttcctcctcgccgcggcctccgctcgggcaacgcggcggccatccccgcacgcgttactcctcgtcgccttcgcagcgaaggtggcgctttggctagagtgtgagagggagtttgttgagggagaaagaatatgacaagtgggcccaggggtattttagaccttttacagtgttcatctctcctattgacccaaaaattaatattttaatgtatgcggtgtccatcggcaaataaccacattttaagagtgtcttcccccaaaagtgacttcgtgcggtgtccgtggctaaaaccgcaaagtcgcgatgtcttgtagcaaaatttgccataacttaggggttatctagatctaggggtgtaaagttttggcgtgtcacatcgaatattatatagcatatcgcatggggtgtttgggcactaataagaaaactaattacataatccgtcagtaaaccacaagataaatatattaagcctaattaatacatcattagcaaatgtttactagcgcaacattgtcaaatcataaagcaattagatttaaaagattcggttcgcaaattagtcgcaatctttacaattagttaattttttagctttaatttaatattatatataggtgttcaaacgattgatgtgacatgatgtaaagtttagaatgagaaggacctcaatttattttgagaatgattatcctcgtgcggaagagcaaggagcactggagcagtagaaggcactttacagaaaccctatatgttgaccaaggcattctcaagcaggtgcatttatttgtcggcatatgctacgtactacctccgtcccatataacttgtctttttgaatttttgtttgtcaatgtttgatcattcgtcttattcaaaaaattttagaattattatttattttgtttatcatttgctttattatcaaaagtactttatatatgacttatctttttttatatttacactaatttttcaaataaaacgaatggtcaaacgttacaaataaaaagtcaaaaacgtcacctattataggacggagggagtaccccaattgttcgaaatccaatgcgatgagatgagataccctgttcatctatgatctatcgctggagggaactgtaggataccgaatctttcgttgctagctagccgtcgggccgtccgtccggtgcaaacgctgtaggctgtagcagggtgacatcccccggtttctctctttttcatctcatgcatatgccgcagcgatggtgcatgcatgcaggccggctagctagcttgtcaacaatcgtcaatcctactgttatagtgcgttgctaacctaaacgcaccggccacacacagacaacgggccctctcgagtggcaagtggcgcgccgcgcgtcgacgactaagcttgtcaccatgtgcgtgccgtcgccgcgcgcgcatgcatgccgcccggggggccatggcagcgtatcggacgatctatcatatgggagcggatccaagaagaaatagtagaagaggactgaacaaactgtataatgaagacgctcgattgcgagaatcgaatccaacccaagaaaaagtagtaagagaactgaacaaactatataaatgcgctcgatcgccagaatcgaatccaagaaaaaaaagagcaagagaactgaacaaactatataaagacgcttgaccaccagaatatatcgaacctaagcaaaatagtaacggtgatctgaataaactatataaagctacaagccctcgaaaattttaaaagagcccagtcccatgatcccgccatcacgggtagtgggggctcgagcaccccgggcatccccacgacagatcggcccctgttgatcatcgatcgagctatcgatatgcaagtggccgcgaggcgtacggccggactggtgatgacgtcgtcggctcgtcgccgcgcgcgcgcgccgcggcgcgacgataatcgatattggtcagcttagctatacgcaggatcgatcgatcgatcgatctgtgtcgcgcgcacgtacggtgtgtcggccgggcagggagcaggagggccgggcgcgcggcgagccgcgcgagagcgtttcggatggatccgatcgcccccggcctgccgcgcgccaccgatcgatcagccggcggcgcgcccgggaagggatggctgctgctggcgccgtgtcgcgcgcgtacgtacgtgcgttctgcgttcagttgtgggtgtcgcgcggcgcccgcgcgcctgcgcatccgcgatgaaatcgcacgtacgtagcgtggtacgacgcgcggggatttgaatgcggggttaattcgcgatcggtgtcgggccggtatatgttaatttgtgtgggcagacgcggtaatataacgctactaccccgcatctaccgtatatatatacgaccggtagatgtatgcagttcgatcgtaggaccacacccacgtacgtgtacgtgcatatatactcgatggagggtcctggatgtttcagtgcacgtaaatagtgtccgtgcagactgcagagccagcgcgaccagtgaaaattcgttcattttttttgtgtgttgaaacgacggctgtgttcgcggttcatgcatggtccgtctcgcattttcgacgcagcaaatgcgaacagatcagagaggatccggagaacaaattaacatcactctcacagtctcacggacgaaacaacacacagcataatatatatagcaagagattttgcacgtccaactgtccaagcgcgtgacggcatcaacaaaaaataaagagagaatcagaaacaccaacatgtactgatgtacacactgtgaatacacaggaacaagggttaaagagagagagagagagagagagagagagagagagagagagagagagagagagagaggacatatcacaagcacaaggtattaaacaccacaagcgttgccctttgcttactagcatggcatatcttctttccctgttagttaggatcaataaaacaaggagcatatatatatagagagagatcaatcaccacgcaaggaactactgacgagtgacgaccatacaactaattgattcataactcaaaagatatatcagaaacatagaccaactcactacatagccatctataataacaaaagtagtacatctaaagtaccttagcacacaagtcacaagctcaagagggatagacggggacaaagaagatgggaggagtgatagacgcgagaggacgagaaatgttggcaaggatattacgagaaaagtgaagaagagtgtttttcgatgaaaagtcttgcaaggtcaagaagacaccgcttaactatcattcatcgaaacgaaaagaatgcctctaatgcaagaagcatccgagaatagaacgagaggaggggcggtggaagaaaagctcggtggggatagggccatcacataagggcgcaccgcttgctgcaagtcttcagcctcctcttcctgatccaatggcgccccaaggaggcaagcgaggaagaaccagctgatggccggaagcttgcgcggccatggaggaagcagcagcaatggtggacgatgctgccgcttgagtcgtcacgcatggtggtggctagaggaagaagaagaaaaggggggtagcgagtggtgagagctgagaagtgtggtgaagaagggtggtgctgtctttatatagcgcgacaatgggcagtgcccgagggtcacaataaacgggtcgggaggcaaaacggaggaagcaggcgcacaaattaaataatgctagcaacatccagcaaccaaatttcatgtcagggaaaaaaaacttgaaaagcatttgttctctccctttatcattggcgatcgagcggcctagctttcatataatatggcaaacagcaaattggtatagtactcattaattccttggtctcaaatgttaattattagctagcaaattttgtaactagggatgtttactgtagtactaagagctagtagcagacttttttagagagagagagagagagagagagagagaggaaggatggaacagaatggctttacgagcatttggtcgtcctttcacctaagctagctagaaggaacgaaacatcaattgcatatgctgatacgcatgcatgaatgcatgccatgttgcattggctggcgatgcagctatagctagcagctgtggtccttttccacatgggacttgatgtggtagcataaaggtggaacagaaaggcctgatgcgatgaagcagtgcccatttatgagctccggcaacaaacccgctctttcaaaaccgcgccgctagctgcgcgctctctctctctctctcgccgctcgcgccgcggcgctgcatgcgtcgatcgaccgatcggccggccggccgcggagaggaatacagctaagctaagcgcgcgccgcgacgactgatcgactgtgtactggcactgttcgagttttatgggagagacagaatgccatggcgcgcgccggccggcaaacgttttcaattttgaggccccctgctgtagcagctgctgcatgctcctcctctcttccgttccctgcattgttttcaacttctcattgactgcagctagcatgtctgcaacaaccatgcatccagtgttcttgttttcaaaacaaaatacattactatctccgttttttttcccaataaagccgagtttagttccaaactttttcttcaaacttttaacttttctatcacatcaagggtgtgtttagttcacgttaaaattgaaaatttggttaaaattggatcgatgtgacggaaaagttgaaaaatttatatgtgtaggaaagtttggatgtgatggaaaagttagaagtttgaagaaaatttttgcaaccaaacatggcccaaaactttcctacacatacaaatttccaacttttccgtcacatctttctaatttcaacca

SEQ ID NO: 13739 - DNA, 2428 bp, Oryza sativa
tttttttaatgactcattcattagaggacgtaagtagcttttggtctccccgcgaaaaaaaaaagtagcttttggtcagttctacgaactaattaaagctctaatttttttattaagaaccaggtttgcctcggtctccattaacatgttattcaaactttttaacggtatatttcgtgcgaaaactttatacatagaagttactttataataacaaataaattcatttttcaagtttaaaataattaaaactcaatcaatcatgcactaatgactttttttttcactgtatacgtactaaatgttcatatatatttttagtgaacttaaatggggcctaattccattcgtgtagtagctcgggaagacatgttgactgttgagacatcagtaattcgctactcctgtaatcctgttctatgagctagctcgaagcccagccggacggtgttgccatacatgcaatcgaaaccgcacacgcgcagttggttggcgagacggttgctcccaacatggaactcgatccagcttagctggggaccgcgcttaatttggttggtttctagccatggccatataggttgtgtttagttcagcgcaaagtttagattttggttgaaattaaagatgatgtgactgaaaagttgtgtgtgtatgacaggttgatgtgatggaaaataactgaagtttggatccaaactttagatatatataaacacagtcatagcttaattagatcgaatgctcatgcatgaacacacatatgttggatcctactcctgcatacgcgaacagtcaatctctctgtagtacacagtggcatatactctacggatgcacgaacggttttatcatcgtatgtgcgcgcaaacagcactcattataagttcataacagtgacggatgcaggtgatcaatcgatggctgatgtcgttgtactatatggtatagtagcaagtacagtaatgtgtatacgtgcttgcatgtgatatgatggagagatcgatcgacgtacgtgccacggtgcagatcgacagtgttgacgaccaaagtttcagaccagcctcagcatgcatgatttggtgtttaattatcccttctttgttgtgtttgtgtagctgttctatcttctctatcaatgaaatgaggcaaacctttatttttgtcccattttatcagatgagaaaaatgtacttgcattgcatgtgtgtgcccttgatgcgtgtgaaagaaaaaggaataaagggtagtactgtagtaaaactactgcggagaaaaggaaagaattgttgctgcttgctgctgctgtgacttgtgactcttcaggttcagggggttgatgcgttacagcaccctgtaaggccctgcagtcatatggatggtcacccatcaggaggagggatgtgtacatgtactcctacgagatcgagagccatgcatccatatatgcatggtagtactggctatctactgccaacctagtgcatcacatctctttgctacaagctcacgcaacgagagagagagaaagaaaaaggagagagagatctttgtgatcttgtagatgtcagtgtggtgatgggaaagaactaaaggaggcccccaagtttggggagagggggtactagatgtgagggtgggttgcctgcattttgacttgcacctttttggcaacttaggtttacaaaagttacaaacgtacagcgccaacagcaagctactccagctgcaaactgcaagtaaatgcgagttgctgcgatcgtcgatctcttttccctcctccttggctactacgctgccctctgctagctatcatgagagccactgagccccctcttcaatgcccctgtaaccgcttagcatttacacactctctcgcacacatattcatacagtctcagactctctctctctctctctctctcattctctctctctctcacacactcacacacaccacacatacagaaatgcagacacagtgccagccatatgtatggcaagttgaagcttaactctctcattgtctgcctgccaatatgttgaattttcagaggtgcatgagacttcctcttcagtgcacggggacctatagtgttgtgagagtcatgtactccctccataacagaatataatatattttgagttgttgcttgcaacgtttgatcactcgtcttattcaatttttttttgcaaatataaaaaacgaaaagttgagcttaaagtactgtggataataaactaagtcacgaacaaaataaataataatttcaattttttttaataaaacgagtggtcaaacgttgcaagaaaaactcaaaatcccttataataatattatgggacggagggagtagcactgaaaatgtactaaacacggcattgaatgctgaatgtccaagacatgcttagatacggggatccacta

SEQ ID NO: 13740 - DNA, 24493 bp, Oryza sativa
tatttttaggctcaaaattcacaagtatcaatttgttagttttaataatcatattacatcttatttgtacatactatacaacttaatttcccacattaatgcggcggggtatttatctagttaactatattgtgaagctccactactagttgaactcagtgcacaaaaagcttctatattgttcacttccataaattaaatccgtaatgatatacagtacttatccccactaattagcaccaagaaaaggtactactggagaaactatttttgatcggtcggccaaatttcacaatagtcctggttctaataaaaacctgagtcccggtttaaaagctcaggggtactttttgatctttagtctcgattggtaacatcaaccgggactaaagatcatttttagtcccggttcaaaaaacggcagccagtgtcagacccttatattttctttataaagatctatttgtagtgggaaaaaagatcggcatatacggagatcgaggcgtgcgcgcgaatccgatcgaggaggcatgcgcgtgtggtttctatctcctcctctcctcactagccctatctcttcctctccttctccttccccctccccctcccccctgctcccacttctctggcaggcggcggcggccgagcggctagcacggagggcagcgcggctggctgtggcaggctgaaggcggcggccggcgcacagtggccggttgtgcctttgccggatttgggttgttattttttttagaatttgtgattcggatctaagatgtatttgatttgtgtgtgatgtgaatatgtgatgtatttgtgatgaattttgtagaacttgtgaggtaatttttttaagattttgtgatgtatttggagatgatcgatttgaggatttggaggtgacaatcgatttgggattttacgatttggggattgttgatttgggatttcacgattcggggatgggggatagagtgaaatcaatatatcaaaaacaatgaagaaaagaaaaaaaaataaaggagcaaacggacctatcctggctccatttttagtctcagttggtgttagtcccggttagtaacaccaaccgggacttaaaaatggatttttactcccggttattttacccaggattaaaaatgggcatctttagtcctgaattcgtggtcccggttgtataatcgggagtataggaggttcctaaccgggactaaagcccctttctctagtagtgatatgtgtttattacaattacaacttctcatgcatcagttctgccatctgcatatactggtatatatattgtgagtccaataaatcaatagagtatagctgattatgaacagtgctgtacatatgtacaaatttatagatccactacaagttacggagtaactactacacataattttggccatccgattttatatcaacggttcaaattgagttacggagtaactactacacataattttggccatccgattttatatcaacggttcaaattcaatgatatatagtaacaatatgaacaggactccgtactgcagtattttgctacagtgctatatatggactgtgcagtgtgtaatctagagattctagaccgtccgatttgcatccaatgatgctcactgcagctgtttaagttgcagtcagctgatccaaactagtcccatacataccaggcgaaacaaattaattgctccctttttgtagccaggtaccagctgcacgtacgttcatcatgggctcatggccgaactgtttggcgtacgttatatgtacgctgggatggtttgatagagccccaactgtacgtgctcaagacgagatatatataccgatataggctcatctggccagagttttaggtgaacgattggaaaataagtgcatgaaatacagtacagtatattcttacatgtatagtaactgggagctcaaaaagatataaagtcctcattatggaacactcatttttaatgtggattggaatgctactcctacgtacggagtaggtgtagtaatctcgacagcattatagctgttgctgtgatagctttggttttgatcagggcaggttaatttagggcgcttgcagtttgcagggttgcagctggtacggtagacagatgagattccaacgccgcgcatgcatgcaggaagacagaaagtagctgaaagtactaatgagaatctcatgcgatgcatgcgccaccaagtgtgtaggagtaataaggagggagggaggcacgtgcgacctgcgtgtggcacgtagttccatctttgtgacctgatcgagaggcgcatcgcctcatctttgtgatctatcagcatgtatactgcgatgtgcgtactcgtacagagcttggccagccagctaaaaaggctactccggtaccgctaatcatctgccgcatctgcatatgccctgcaccaccaccccctaccatgcatggtctatgctcgaatagccattttatgcgtatccgtgcatgcatgggcacccaaatggcctttgccatatgctcgcagctagcatgcacgtggaagcagatcctcccgtactcacaccgccagtccgccagtttccttgccgctagctagtagccgcggccatgcacgatcgcgcgtgtgtacagcgctagctagctagctgcgccgcgccccgcgagatgccgagattgctcgttacgtcgatcgatcgatcgcgcacatgcattctctcgcgcgctgggcgaaatcgccgcagcggcgcgccggccaaaagaggtgacaagacgacacgcgcgctcgcgcggcgcggcgcggccagcgaaagatcgggtactctacctatacacgctcgcagcctctcgcgacgtacgtacggcacgggggtcggtctggtggatggatggacgggtgcttcgctagctataggtagctgcacgcatggagatgcatgcgacgcgatgcgaaggcacggacgcgggaggagttgggagatttgattcgggggaggcgcatgcatgcacggacgcggctaccaaggaggattttgcaccgcgggcggcaaaaggctactaatactaggtgactattcctagctgtattgcctatcgagctgcgcatgtgcatacccttgcgcagtactcctactgctactacgcgttgccgcagcgagtagtgacacatccatgtccatagatccaaaaccctgccacgcccttccagagaaagatcgagcagagagcagtagtagtacttcgtttttggtggtggctgtagggtgctgcgacgacggactttgcttgtgcgccggtgcaataaccaaaagttgttgcgtctcattactgcacgtgcgtgcgtgcgtacgttcgtgggggcgtgtgcgtgcaccagcccagttggtttgttggttaggtccggtatgtaggcaggcccggccgttggggggacggacggtacgcgcacgctatcgagtttgtggtagaaagtagccggcgcccccccccccccccccatcgaatccgttcttccctacaaaggtttaaaaacacaaaagatgttattgcaattgattgttaacgatttgtgattcataaatttgggttcttcgtacggatatcctctccaaaaataatatgtattatacctttttcttttaaaaaacttgtgcacactagctgctagtgccagaatgagtagtgtgcaagctaagaaaaaagaaacaaccacaaatgtttttttgaaaaaaaaaattacctatgacgatgggggagacaatgctttcatgatgcaaagtaagcataactcaacctgggtttacaattccgatttcgtgaaatttcaacggctcgacgagactcgaaagtagaaaccatctgagagttcgaggagtttcatccaaattcaaaatagaattaataaaaaaagaaaaaaatcaaataaaatcttataaatactatgatattcatagaacctattgggataacaaaaatttaaaaaataatgtattgtgtgtattaactcaaacttatatcaggaaagaaaagaataaaaaaaataataataaaaagaaaacacttacatgtgctagattgcatgtactaggctcagttactgatcgaatttttgatgatttcgatcggaatttcgccaaaaccgaacttatcggtaaactcagggaatttgtattcaagttttggtttatgaaatttgttcggaatttaccggatttccaccggatttcacgaaattccgaattccgccagagctcgaaacggaagggcctgtcagaatcgtaaaccctgaactcaactggttgagtttctggtggtggagcctgtctattcgattctatacttgacatggtgctcgcatttagagctaattatctatctattatattattaaaactgctttgaaaggaggcaccacgttcactgtgggggctagaaattcccacattaatcggagaaaaagaaaaggagagtccaagtagaaatacaatataaaaatagctgaaattcggaattaaaaataggcaatattgaaataagagtccatataaaaacccaatacgagattaatgaaaatccggaataaaaataaaataaaatccaaaattagaaaataaaaggagagtccaactagaaataaaatctaaaaataattgaaattcgtaattaaaaataaggaatattaaaagaagagtccatataagaacccaatacgagattagttaatattcggaataaaaataataataaaatccaaaattagcaaaaagaaaaaaagagttcaagtaggaataaaatttaaaattaactaaaattcggaattacaaataatcaatattgaaagaagaatacatataagaacccgatatgagatatataagaacccgatatgagattagttaaaattcagaataaaaaataaaacaatatccaaaattagaaaaactaaaagagagttcaagtaggaatacaattttgaaacaacttaaattcaaaaataaaaaataaaaatattaaaagaacactatacggtattaataaaaatttgaaaaaaaaatctgaaattaaaaaagaaaaaaaattcaattaggaatacaatttataaataaccaaatatggtggtaaaaaataaagactattgttcgaaaagaccatctaaaacgcatgacgaagataaattaagtaacagggttataaaggagtagagtggtcgtggttgatacgacatataaaaactgttaataaaacatcaaatagaattctaataacgattaaaaggagggacgacaggcaggccatgaagcaaacgggtaaggcggttgcggggacttctagaaagtgaaaaaataaaccccattgataatcatatttgattttttaaaatttcaacgacaataaaaaggagaagcagcgggcggggtgaataggagtatagttgcagagctgccgacggttagcgggacttctataaaataaaaaataaactccaacgatagttatgttcgatttttagaatcccaatgacaataaagagtaggtggcagatgggctgtagaggcgtatagtggcatcacttgaaaggacttctaaaaattataaaacatgaaacccaacaagacataaactctaaaacctacaatgtccaatttttaaaggtttggaacttctaaaaagtaaaaaaaaaccaatgataatcatgttagatttcaaaaatctcaatgacaataaagaagggaggcagcaggcgagccataatggagtacaatggcaaagccgctgatggtttggcggaacttctagaaaataaaaaaatgaacctgaacgataattatgttcgatttttaaaatcccaatgataataaagagaaaagacaatgcacaggccgtagatagcttttaataaattttaagtaaaaccatattgaaaaatatatgtgtcgacgtttgatgtcacaattctggtatttgcatggtatggggatcgtcggtgctaggatatatgcgagactaaggtaaaagagatggagacagagattttaatatagattcgggcccctgaattgtcaggtaataaccttacatcctgttggccgaagccggtattgctcttattcttgataattataccagtacaatatttggggtagcctatctaactgttgtcgacatggcggtctgaaggtccgactcgtagtcgacaacagggtagccctcctcctcgagctcgcgcccgacggaatcagagacagtactagatccctatggccggcctctgaaggtaccggatagggtcgatccaggcgtatctctgatgtcgatatccggcggcttgtcttggcgtatgtaggcttgtatgttgtggcttctggtgggtgttgatcttctcatcgtgggtgtctccctgtcctcctagggggcttgtatttatacccataggtgtccccttgtccaagtagaactaggtaaaccaatatagatacaatccgagtattccttatcgtttccatgtagaactctggttgtctttccttatccggaactccctcgaggtcagtttccgtataagatatggtatgtggtggatcctgccgagatttagtcaactactattagatatgtggtatccataaccctgacagtagcccccgacttcgatgcaaatgaacgaattcatattctcaactgcgcgcagacattggagtaactgttatcgagctcatgtgaccgttctcggggagtttagagataacgttggacttcctttgtcagcctcgtgcgggcaccgaaagggtttgtctaagtcaatctctgatgtcgaccgagaaagtacagagcgtacgactaagtctctcgtcttgctgtaatcgagaatttagattgaagtcaagaaattttatctcggtgggtgcaccatctcttcattctgtattccttgtcgagatccagcaaccgttctcgagcgatcgagaaggcgtagagtctgcgacggagctttgtcgacatttgtcgtactcaccttagtcgatcttggtgtagaaccatagagacatggagtcttcgataatgtcgaatagaattttcctgaaatcaatactcagaaaagaatatcaaatagaaatagcccccgagcgaatgctcaaagggtgacatgttataatatgtatggtaaattgaaaatgaattaaatttaccgaccaatgttttgtgtatgagcgtcttctctcttaccgacttcgatcagtcagtttgtagagtcatacactctccctagcccccagccttgtcgtcggagaatcgttctcggaggataaggctcttggacccttgacctgccttggttgaataagcactgatcctagcccccagccgtgaagttggaaagctcagtttccgattacacggattggttaatacgcacggcgagaactcttacactaccagatcttacatggtcttttgtctctacaggatccgacaaggccttatcggctctgggcgtccccagccgaagatcctttaggttcctcggaggcattgtcaagacggcgtaaagggacaataggataggtttcaacgctaggtgtcgtcgtggtaagggatctctgggtaaaacacttggcgatattatgtacctactatcaactttgttgaggtagaggtagtaggagaaatcgctacaccgttggtcgaggaccaggcagtagtcgtaactcgaccacttgaagtggaagtagccggagaaacgctacgtcgctggtcgaggaccaggcagtagtcgtaactcgaccacttaaagtagaagtagtgggagaaacgctacatcgctggtcaaggaccaggcagtagtcgtaactcgaccacttgaagtggaagtagccggagaaacacgtcgctggtcgaggaccaggcagtagtcgcaactcgaccacttaaagtgaggcaagagagatcactatgttttactggttcgagaaccaggagtaggagtctcttaatcacctataggggcggtaaagttggtttattatatatgcatatcatgtggccagcatgactcacatacccaacttacagcatatccggatgtccgctcgcaatcatgtggggtgatcaagctgacgacgttcgcgaggaattatccgttaacaaccttttctcgagtagtccagcgatggccggtgctatgagataggtcgtcgatcttcgttggtaggttgggtgtgataactccgcatttgtcgagaatgttctcgataatggagtgtactcgactataacctactcgagtgctcaattgttcctgaaaaatattttctagaaggcaagatatatagtagataatatcgagtatgtattcaaaaaactgcatggatcttctagtattatcaggacataacgagcagatgtaattatcaggcattatgtaaaccgtaaacaagcatgatttatacataagagaacggagtgagcccccagcgttagaccatagttggcctatcgtcggaagtactcgcacaacggatattgtataagaagcatgctctagataaacataataaattattgatctgacaatactgtataaattggaaatataggtacgataaattgtgtataaaatattgcgtacctttgtagatacatgccggatgtatctacggaattagtagatcaattataaaaatcaatctactaaatacctttgttgatttgtttgaatattatgcagtcgtgctgtgtagacatgtgttgatgtgcatataccgaataggttttggaaaccgatcggcatatgtacgtacgtcaacatgtaggcctgtggatggatatctcctgagtcctgattggtcggcacggttgtcatgcatgcacgtattccgtttgcctaattccagtcctaaccggacacaagaacgaagcaaatacagattgatctgccaccaagtcgggcttggcattccttggatgggcgtcgcacttgggacagcagctgcaccgggtggaggtcggcgtctccttctcggcggcgatggtcccgatctcgtcggaggatatattccggtcggattagacctccccacagccgaagtcatcgagtagcttgttgttggagaatccatcttttgaacccatctcgtcgaaatcctgaagcaccaaaatccccctacctggcgcgccactgtcgacgtttgatgtcacaattctggtatttgcatggtatggggatcgtcggtgctaggatatatgcaagactaaggtaaaagagatggagacagggatttttatacaggttcgggcccctgaattgtcaggtaataaccctacatcctgttggtcgaagccggtattgctcttattcatggtaatcacaccagtacaatatttgaggtagcctatctaactgttgtcgacatggcggtctgaaggtccgactcgtagtcgacaacagggtagccctcctcctcgaactcgcgcccgatggaatcagagacagtgctagatccctaaggccggcctttgaaagtaccggatagggtcgatccaggcgtatctctaatgtcgatatccggcggcttgtcttggcgtatataggcttgtatgttgtggcttctggtgggtgttgatcttctcatcgtgggtgtctccctgtcctcctaaggggcttgtatttatacccatatgtgtccccttgtccaagtagaattagggaaaccaatatggatacaatccgagtagtccttgtcgtttccatgtagaactctggttgtctttccttatccggaactccctcgaggttagtttccgtataagatatggtatgtggtggatcctgccgagatttagtcaactactattaggtatgtggtatccataaccctgacaatatgatttcatttgggtgctagccgcgcaattgcacgggccaccagctagttctttcaatgataagcaacctatccatcaacagcgaagcgattgtgatgatctcgtcaatcttaagatatatcagcttagtctttcggagatgtttataggggtaagatgtgtatgtgtacgttcataggagtgagtttgtgcccgttgtgagcgcctacatttatattatgtttctcaagataagacataaaaatgtacttgggtgccattgtcactaaatatattgaccggggatgtctaattggtgagtgttcacatgtgacctagatacatgaacatgtttgacctaattaacccacatgcatggcccaccgtgggatgttatttcaaaaagtttatgcatagaaagttaatgttagaaacttttgacggatatagaaacattctacataaatttttttgaatccaaatcgaaacccgctcacgcgagcacaaccatttgcaaatcagctctttcgatattgatcgtgtgttcatccaaacaagacaatgtaaaagtttactatattcctagaaaagaaaatctgtttttatgtgagatgctgctatacaaacttatgtttttttgaaagaagaataaaaaccttgcttcgtatatattagtattaggaaaaagtacgaattacccccccgaactatcgtggttgtccgaattacccctgaaccacaaaaccggatattcttcactcccaactatgcaaaccggacgaattacctccctcaaaccaattcagagcggttttgtccaacgtggcgcatacgtggcaatccaatcagcgtttttttaataaaaaattagaggacccgcctgccatactcttcttttcttcctctatctcttctctctctcgccgctcgcgccgcgcgcacggcgttggcggcgactacccgctcagcgccaccatcatgtcggagtacgcgaacaagaggacgcgcggggccttcatcgccgccgtgttcgccatgcaagggtccgggatcctcttcgacgccatcgtcgcgctcgcggtgtcggcggggtttccgcacgcgtacccggtgtcgtcctactccgacaaccacgccgcgtccctcatcccgcaggccgactacgtgtggcgcatcatcgtcatgtttggcaccgtcccggcggcgctcacctactactggcggatgaagatgcccgagacggcgtggtacacggcgctcatcgcccgcaacacgaagcaggcggtggccgacatgtccaaggtgctgcacacccagatcgaggagagcgtgggccacgccgagacggtgagacggtggtcgtcggcggcgagacctgaggcctcttctcgcgccagttcctgcgccgccacggcctccacctcctcgccaccaccagcacgtgattcctcctcgacatcgcctcctcgacacgcagcggcggcggcgggtgacgcggcggcggctgcgggggacacgcgcggcagctcggaggacacgcgcgacgactgcggggacacgcgcggcggctcgggggacacgcgcgacggctaagaggagccacggtggcgcgtgcggtcggcacgcgagggcagcggtggccctcctcttccacctcctcctcctcctcctcctgttgctcctccggctcaagcaacctcgctgtcgcctcccgcaccgacctgctctcgcctacctgtgaccactctgacgctgcctcccgcttcctctgaagcttcgacatatccgagcacaagcaccgcgtcctcgccggcttctccaagaacacctgcgccgacacttgggccaagctcccgcttccaccttgaattaatggaggacgccgccgcgctgctctagacccggccgctgccgtccaacctgacggccaatggtatctccgcgccggtgaggcgaagagcctccaagtccggcgcagcgtcagggacggcgggaagcgaggcggagtccgtgtcgcagctcccctcgcgcacgtcaagctcccgctccgccggcgcaccgccgcggtggcggcgctggacgcggacctccccgccgaggccgtgcgccatttctccaaggtgctcgacgcgtgccgtggcgggctcccgtacccgttcgcgactgcctgcctcgtcggccgtgccgaggtgttccgttccttcgggaaggcagccgacgccatcgccgactgcaaccgcgcgctcgcgcttgacccgccgtgcgcgcctgacggagagagagaaagaaagaggaagaggggaagaggaaagggagatggaagagaatgacaggtgggccccaccatgttttaaaaaatgaaaatgctgactgggttgccacgcgtacgccacgtaggacaaaactgctctggattaggtcgaggggggtaattcgtccggtactgaaagttcggggtgagtaatgtctggttttcagatttagggggaaaattcagccgaccgcgatagttcgagaaggaaatttgtactttttccttaatattaatagagtaggagcaaagaaaagtatattagtgattattccatttatgtattggtgattccatctaatactattatgtgatatgtaattcctctgtctaaaaaaaataaactagctagtattggatgtgatattttataataatagattaattctttttaggacgaatgaagtgcagtgtacgagcagtccagcacagaagagctagcagtgctactatttcagtggaatttcagcaccgtgtgggggcggattgtcgtggcctcgtgagactcggtcgttaattcgttattgcacctggatctggggctggggagtggggaggactaggacgaggcccggctggggcctgggaacccgagcatggggtggagccaatgaggcgagcgagagaatgggtccgctcgtggtctcgtggccgtgccgtgctgagccggccagcgggccgtgggcgcatggtgagcgttggctcgatgacgcacgggcgatcctagctaggcgtcctcgtgggcagcaaacggtggggatcatctctcggccggccgccgtgtgcgtgggtgcatgcgggactgtgtggcctgtggctgtgggacgtgttcgccgtgttgggcctgggagactggcctcgtggggctaagagcgtctcagctgaacatacaaaaggcctaaacagagggactggcagagtaggcacgttgctgatcttaagagccactagaggggaagcccacgaaactactgtaacaaaccttgaattttcttggaagaagttcccattaggtaccttgtgtaatgtcgagttcaaattacatcctcaaaccataaaaccagaaacgttaaactttcatatttcaaaaccaggtcctaaagcagtacaaatgattgttttggataacgtggcatcctattcacaaaaaaaaaatacaggtcccgcatgtaagtgccttccacctttcctctctcttccacttctcccatttcctccgcagaagctcaccggcggggagaggggcggcagctgatgagcccattagcaggaggtggtagcagcaacaggagattggcgacaagggggcaccggtggtctatggtagaagaagagaagaggaaagagacgagggagctgacgcaatgcgcaacgagttgtgatgcacctccaatccgtgcacgaggcgtccaagacgctgctctgccaaagcgcgccacacaccaccacacaaaacagcgttgattcgtcttctcgactccactcaccacctccgcgcgcggcgggcgtccatggaccaccacaaccctactatctaggccaccgccaccaccgtcgggctgcgtagagatgtagacgcctacaggacctcacaacgagagtccacgtctttctgcgctagatcttcgtggagcaccggggcgacatggcgcgctgctacctcaccgtcattggggtggccctgtccgtggagtagctggacttgctcgccgccactgtgctgacactattgtgcttattcctgccagtgcaacctttgacaaggaagatgtcggggagttgattcacgcctccctcctctcgtggtggtgcataggacaccacattgccattgctaccaatgccgccgccaagcctagacttgcggatggacaagcagaaccagtgtcattgtggccttgctcccgccgctcctccccccggcctcccactattgctctttcacctggcctcctctgctccccccccactccgcccaacctcgctcctgccgcttctcctcgtggcacttctctccatccttcccgttgtgcccatcctcccgctgcaccctcccatgccggtgcttctcgttcacctcctcctcctcgtccctctcgtagtcgcaaccaacaaagggagatagagagataggaatgaaggagatgccagtgtgggttccacatgtttttttttcctggtgccgccttagccaaaaccgtctccaatactgccttagtattagatttacaccggtcttataagatgaggaacatgttatatctggtattgccatttaagaacgcgcttcaaactcaatgataacatgagggactaagtgaacttattcctttttttttcttaagaaactcatatctcacatgaaaacacacagagcccttatctcctcttcttttctttttttcctccttagtacaccagtgtgtagtacagatggaagggatcttgtattgaaaattttgttactggagctacacatactacacagtgatctttgatggaaacacacgctgctagatgctactctccggactgcaggatcaatcatacaggcggcgggggaaggtccagcaggagccagaaaccaacgcacccgtcggagttgaggttctcctggatggccaggaagtgcaggccgccacaggccttcttcgccgcctcccaggcctcggcttcctgcgtcgtcgcggcgctcttctggtacccggcgtagacgtacctggtcgagacccccgccgataggatcaggttcgccctgcccgtgtcaacctccattgagcagatctctagaccgttcatccaagctgcaaggattgaagaacacatgtttctgattaagcctctttgagtcctaacaccagtcttgaaaatatagaatggtcaatcaaacatgacagaatcaaacggacaacttgaatacaatgaacctatttaactgtcacgagaatgtactcgatatgattttttttttcttttggaagatactttcagaaattaaactgcagacagttggtcatacaatccccaattcctacaatctcgtggatcaatctaccataaaaagcagcaacaatgaggagaatggaatatcatactgaatacgctaataaagataacataaacatatatgcactagccattcatttgattcttgtaagctgtcattcattttatttttccaaagttgaaaacatgattcttacactagtgtcatttttcgatacacaagtaaacaaccatgaactatgattgtacaaaaaaattaactcggaagataccctacgcatcctcaattttgagtagcgtgctgcaacatcaaattaacttgcacttgctgaattcaggtttcagtaaagtaaagatccatcatacacttgacattcaatttagcccctagaccacactacacatctcattggtcatgggagaaacgtaccagctagaggcttggctcgcgaagattccacggcaaccccaggtatcaaggtgttctcatcgagctcgaaccccaggaggtccaagtcgagccccgccccaaacgcatacctcctctccagcgactccacctcctccctcacagctgaacaatcacacaacaatctgaaaacaatcagctcgatcgcaacaagagaacatgtggatcacactagcaagcacacaaaacagcaccaattttttgatggaattaatggatcagcgaatttgccaatactgcactgaccggagaaggggagctgcacgaacgcccacttgtcgccgaagagattctccggcaagctggtggggaaggggttgtcgagggtgagcagcggcttggtgccggactggaagcccgggtggcggctgtacaccgtctcgtagcgctcctccagccagaggaggagggagacgcagcggcggctggggacggccttgacgccgagctcgttgcaggcgcgggagatgatggtctgcatctgggagcggaagaagcgggcgcggtcggggaggggcacgccgagggaggtggcgacggaggcgagcgcgtcgcggagggtgacgctgttgatggaggtgttggggaagaagcgggtgaactggagggacagcgtcgcgtcgcacaccaccagctcccacaccttcttcccgcgcgcgtccaggattgggcgcgagcagaagtccagctcccactcccggatcccctccgcgtccgcctccgggtccaggtagcacacctccgccagcgggtccatctcctcctcctccgagtcgctcttggtcacctcctcctcgtcgtcggcggtgtcggccgcggcggcggtggagctctcggaggagacggaccggcaccggcatgtccgcgacgacggcgcggccgcggcgacgacggtgcggcagcaatgggcggcgggcggaagcgcgcgcgcggagaaggtggcgcagctgggcttggagaggtgcaggctccggcgcagcgcgaggccgtggccggcgacgatggcggtggcggtcgtcatggcgcgggcggagcgcgcgcccacggccacacgcagaagctaacgttggtgggtggtggtgtcgccgcgggcttcgctcgcggcgtcggctcacgcgaggagatcttttcttccaagtatttttttcgtgggccggcctaagcccacgtaggcccaaacgaccacggcgacttggataaccacgacaccgaggagaaaaaaaaaatgaagaaagaggagagaaaaactagaggtggaagacgacggcttctcgagtccatagaaagaggggaggagagagaggcggtggtgggaagcaagaatggcgtgctctccgcgtgtgttcctctcggcgtcggctactcctcctcctccatctgctgctgcttcctcttcgtctccgttcctctccacggggcatgtgtcctcggctccgtccacgtccaggcaagcgtttctttcatatggtgtccccattgatccgcgcttgccttcttgctcgtgttcttggccacccatttctatctcttttttttttccgatgcataattcatggttcgaaggtaaaggtgctccgtgatgctacgttcgtttgtccagtaagttggggagattgttgtggtggttagtacacaagaaaatcattcgctgtcagttgttggtttgttccaactgctctgcaattcgagtgaatttagcatcagctgttccatatattgatgatatttggtacgactagtttagaacttttcattgtgatgaatttggtggccatcgtcgctggctcacttcactggatcagtctggcacagcactagccctcattttcccaaaaaaaaagaagaaaaaaaaagagagataatgtctggcactacccacaattacttttggtagcagaagaatactactcgtttttctagagtgttaaacaattcaccttcaccttttgggttgggagtgatcaaactactattggaattactattatgtgccaacggctatttctttgcttcagtttatcatctgtagtatttccaccgagttaactgatgcccaattatatgttttttccttgcttagatggactgtccaatacaagcagccaggacatacattctatcgaaggacccatgtgcaaagcttcttggcttttgctagcacagatgtatgattcaggctttctgtgtagatcatttcatttttgggggttcaaaagtacttttggtttggtaggtctacagaatgtaaaattacaaaatttattgaatatggtattggtaacttcaagtgtttttgtaggagcatgatatttagtagtggatcttgagcaggtgctgtatccctcaagaatttctgcagaaagagattcattatttttagctatagagtagatattattttgcctctaaaaatggattcaatacttcttttgaaactaatatacaatgttcttttgctttagtcaaaactttgtcattatcgtttggtatctaagacactgagttcaaatgaatcaggcatcagaaggcaaaagaagttcaggtgataatgtggtaatggttgatccactggaagctaagcgcttagcagctcaacaaatgcaacaaattcaggccagagaaaagctgaaggtgcagtatttgatatttgtcatgtacttccacagttcccaccagacctgtctcctctaaagttcaaaatattcttgttgttttctaaaccaaaattaataacaacacccccagttttataaacacttatcagcaaatttctttcttagagctggaagcagtgattgacttttccctagtcatataaggctcttagcctttttactgacttgtgctgccctatctactttttgctggaccagatctttatcttctactgtttattgatcaaaatgtggcagtgtgttctgtgttgcataattcagttatcctaaactaattattgaggaagctttaactgtgatgatgttcatgtggacgaaagttgcttttgaaatctgcaaggtttctttgctcaaatttattttcgattattcagttgcttgtcatggcattccatgaccatgcataaaagctatcatggctagtctgtaaaatccttatcagggagaaaataagtactgcacctaaaaacacatctatgtaaaccagaaatagtttcctcagtcattaccgtagattactccatgtttcctgctggagaactcgcctgtttgtattcctctctgattaaaatcaaaatgctctatgttggtgctaatgctttatgaacatcctttcaacattatgccatatcatagttgcctgctacgcagagacgtcgtcgagcagaagctattaatggtgcattggcaatgataggactgactgtaggattggtactggaaggtcagacaggaaagggtatcttggcacaggtatttcatctgaatataaagaaggcataccatcttagtaatcagagcccacaacgaatagctatgatactgtaaaaaatataccattgttacctatctaccataaagtacagcacatttataatcatctgcactttcattcctgcagctggctggatatctcacggctttgtctagtttattcgggcaatagcagatcatgattcatgagttcctttttttgcttttaacttcctcaaccaggaaagcttttgtctgaatctcatttgctggatccaaccaatttgtttatggttaatcctgtccatatttgcaatgacatgcagatttgcaggctagtgatccaattaattgtattgatctggcgcctgtcctgaaaattcatacacggtgtatcaagttaaaacattgtattctcccgcaaaaaaaaaaatcaatgctttgtattcatattcttttccatgtactcaacagcttattatgacagtgtaaagcaactgaagagtagttcaattgatcattcatactccctccgtttcacaatgtaagactttctaggattgtccacattcatatagatgctaaagaatctagacattaatatatatatagattcattagtatctatatgaatatgggcaatgctagaaagtcttacattgtgaaacggaggaagtatatgacaagatataaatcacaagctttttctttattttctttattttctgttcttttgtatctaaaccttcgagcttggaatggagaaatggctttgaatgccctaaaaaagaataagtggctttgaatcggagctggaaggttatgtttatttgctatgaagtctgggagaagtagtgaaagttgtaataatgttgctcgaagtcgacactataattttggcagctcaagcataaatttggcttctcttgtcactgattcggcatggattttggtattgtggatgtaaagttttgtttatcctctagttggctttgatcggttggtaagctgtaaaaaaaaaagaagaaacaacaaaaataaatatatgagtaaaacttttatatatttattattagctatttgaaagctaatgttggaaagtggagtacaataagaaaaataaaactaactctaaagtccagttttgaaatttaaatttggctgaagatgatagctaaccagcgagcgatgaaaaccgctatactcctattatatttttcacacatgtgtcatagtctatgttgttttcccactgaatagccgcaacatctctctctccttacccatttcttcctcatcatcttattttggcttcccaatatctatcttctatgatggttcaggttctttatgacatcctacaagcgcgaactctacttaaccccgaccgcacaaggcgatggcgcgacgcccgagcgaacacagcgcttgacgtcctcgttttgccctggcctcgtcgccatgctacaccaccacttcatcccttctcgagcaccggagaactgcattaagtatgtactccaaacatccaacatttagttgtttagttaaaagttggagaagaaaagactttaatgctcctcatttaataagagattatcgtgggtagattgagatcatgtacgatttggaagtcatacatatttttgatttggtggtccatattttgctgctaaaagatgtataaaataatatggtttgctatagcctatagtataaatcccgatcggttgaggtgaacgagattggggataagatagaaagaaaattaaataaggttggagtggaggggattagagataagatataaagaaatttaaataagaaataattgatgtgataattattaggccccgccttttttatatttatatcaagataaagactttattcattagcacgtttttcaaactgctaaacggtgtattttgtacgaaaatttttatatagaagttgagataaatctttctttaagttatagtaattaaaacttaataaatcatgggatcaatatttttaaaataagaaacgaacataaaaattcttatattcttagataaaatttagacaaaattcaaatgctgagggagaatggtttacggctggtccgggacccaccgggcaggggaacccgttgtaatccaaacagagacaaaaattttaactcgaatcccgtaaatgcccctgtccccaatccgtcaaccccctccgcctgatattacactcccccctgcccctccgcccctcctcttccgctcgctcgacggctcgagcttaaaaccctagagccgctcctcctcctcctcctcgcctaccccgaaacccaaatcccccccaaggcggacgcgcccgcaaaggcaagtactctccagatcccccgctgcttctgcttttgcgccccccttttccggtcggaaacgcgaggaatttccggatttacttcctctttttttttttgtgtgtgtgtgattgtgttcttctacttttggtttggtagagattggtggtggtgcttgttgctttcctcagcgtggtgggagtgatttgtgttgaatacctgcagggtcgagcgcgctcatggctcgcgtgtacgtggggaacctggatccgcgcgtgacggcgcgggagatcgaggacgagttccgcgtgtttggggttctgaggaggtgtgagattctgctgactctgagctaagaatcactatatatatatattttactccctgtgttgcgtatacttgtttaatgtgcctgcttgttcgtttgacttgcttagccacttgtatggatgttagtcaagcgtgtgattttgaaattggaatgctgcagctttacaatttaagttttaaatggtgggtattagctctcaaattagtaatgatagcaggggatgattgtcttgtactgtgcttttattggggtaaaattagttcattgacatatgtgaggtggagagctcggtgcaatgcaattttgctggatataattaattcctttttatataaacaagtaatctgccttacttggtcacttattgttgggcacctaagtgctctgttctactggtgggattgggaaaatatatctaatttgagtattaggatcggtctggtttgtatgtcatgcctcatactgtgggatgcaacgtatatgctagaaagtatcaggtgaacttgaagagtaattgagtttgcagtgaacaataagatatgaagaggcagatcaagtaaagttatgatgtttaacaatgtgacgcagcgttaactgtgaagtatatgaaataaagtcatgttatctcttggtctgtcagtgtacgcctgaattcctttcttaatagactggcgatatctcaatattctgaatttcttgtctgctggtctaaagagtttatcacttactcattagttgaaccactcagtggcatgtttgtatctgcatgccaaagggttatgttgaaggctgttgatgttcacatggagtagtcatggtttgtatgccataggtttttctttgtgtgtgtgtgtgtattagtttctttattgctgatttctgtcacaacattaaagatgatttttgtatcgacaaccatggaagagatatttaggttgttactcaatactaagaatggtaatgaattcatagtctatatggagcagtaatgatttcttaattatgtctgcaaatgagattatctgattcttccactttcaactgagttgtttcttctatgcagtgtatgggttgctagaaaaccaccaggttttgcctttattgactttgatgaccgcagggatgcagaagatgcaattcgtgatttagatggtaataagcgtagatatttgtctttgtagttcatgcaagatagtttcatgttatgcacttctctaatgagttatctatttcaacttctggcattacatagttttgccattaaaatggctattacattatttctttagtcaagtgagtccccatcaatttttatcttggttatagtataaataactctgtctgaatcatgattcaagcaacttataaatttaatttggataaacaatagacactgaatttatagataaaatatgttgtgtccaaacatatagttttagcttaccatcatgaatgcatcttgctatctcctgtaaactgttcggtcttagaaggacgttttgaaaataatagacaggggcaaatccatagtttcataaattctgaatctcaattcctgttcactagtagaattctaaattgaacctttacatgatatcaactaagaggtccgtcttttaacctaaccgggccttgttatttatttctagagtggtgatattagtaaatcgaggtcaaaatttgacactctacatttatattgatctgatatattgtgatatacatatattgttgcaagcacattaggcccatgttgttccaagttaagaaacttgatagatattggtacatgcctactttcttttttctctgtgacttcagttgtgcatgtagctttgtacattaaaattgtgatatcatcatatgatttgttacttgaccaagatattcttttaccctttcaattgatgtgttgtatttttccaacctacttctatgctttagctattacttaacatattattatagggttactcacaaatttaaacagtccatgaattccgcttacaatcatcctgctgatatgtgatgtgcttataggcaagaatggatggagggttgagctgtcaaccaaagctggtagtggtcgtggccgagatcgttccggtggttctgacatgaagtgctatgaatgtggcgaacctggtcattttgcacgtgaatgccgcttacggattggttctggaggccttggcagtggaagacgccgcagccgcagccgtagccggagtccaaggtaccgcggtcgtagtcgcagccgcagcccaagataccggaggagcccaagctatggtagaaggtaatgtaaagttattgtcttcaaacaggctctgtagatatgagtaatgacaaaatgatatcttggcatccctagattctttcttgttggccagccaaatcgttgttacatttgcagttttatataccaacttatatagctgcgctaccccatattcaagattgtgaaaatggagaaactaaaaggtgtgcttacataagaagcttgaagtacaagatatataagtattccaataaacttgtaactttctccctcactaaaatatttgctcaatggcactgatcagctttgtccgcacttacatttgggttcaatttcaaattcagggctatgttactaagatgcatatactgttaccatgatcactaataactattaagataactagtgtttattttttttagtttgttatttgttactgcattatagcatattg

SEQ ID NO: 13741 - DNA, 2589 bp, Oryza sativa
ttgttttaggagttacagcccacgggatcgttctccaaagaggcgcagctacagcaggtcgccaccaccagctcgtgcacgaagctacagccgatcacctccacctcctcgtgagcgaagctacagcagatcaccagcacagccagccaaccgcgaggagtccccctacgcaaataacgcgtaacccgcctagttccaatttgctggaaatgttaggggggctcggtgtgtttttgtaagcgcttgtgttatggagtcttgaaaagctatagggattgagtatgttcttcggaagcatttgtgtacccttcgggaaaaaccccgccgctgctgatacaattgttgaagcaggagcctagcgttttggtcgactgtatgactttgagaccccatgtagtccgtaagactaagttttgtaccattagatttttcacattgctggaatatttgtgctaaatactagtattattaattaatgtcttttgtaggtgctgctctttttgcttgttgcggatgccgtaatatcagaggattacacatgcttctggatgtctccactgcatctggatgcgctgtggtcaccgtgctgcgccactttccaggttcacagctcttctggagcagctcacatatactcctacaacattcactgtatcatgcatcgcgtcaccattgccatgatcacatgcgctacatgtgtaccacccccacacccggcacgggcacaccgatacggcgcttcacatggctttgtgccaaagcggtgtacgctagtaccgaggtcacatggttgcactacgcggctgcagccatcaaacttccatggcatctgcaacagaaaaggcttcaatgattccaaccctttttacgtggttcagtacatgtccgtgtcccccaatacggaagttgttgcacggtttcacctcacaggtaaataaaagacgtaacagaaactagcacgaacggaaagctgtgtaaagggtgctttgaatatgtaccactaggtcggcacgacgccatcccagcgccggtggtggacgccaccgcggccgcccatgtcgctctcaccggagagcacgaagatgcgcgatggcggcggagcatgaggcatttggtgtgaccagcagggaggacggcaggtggggaaaatcgcacctccatacccagcagaagaacaaaccacaaacacacccaaaaacagaattttgtcttcttcacattcaattttcaaaaataccaaggacctaaacaaaaagtcacaaagacacagaatacagaacggatagaccgatctgaaataacagaagaaacaattagatcaaaacaaaaaatggcagcatggcacgcggcactcaacgcaccagccaaccggaaacaaccgtcacaatgaccggcatccaaaccccaaatacatgaataattacgtaatcaaccggcgcaccggcaacgcataagcatgcaaattaggccgaggtgcacagaacagtaaaaggagacgtgtaaaacagtcagatatccaaaaaaaaaccaaaatcaggagaaaaactgtgaggttaggggagttattggttgatgattacactcgtataatagagtagtatgatgctcgaacctcctggttgatggagatatgagtactgcagttcgttcttgcacatttttctttaccatttttcggcaagcttctagtagcaagtaggaggagtactagcctttccaaaagtagaatggacagtaacattaacgcccttgaacttgaagcactgaaccatggtcacggttgcaaaaacagctactcccatggtaatgtacaagccttggttaggcagaagaggagtagtaggagtacaaggagtacaatagaatactacgtccatggatgaaaaactactgtacatattattcatgtcacacggggccatgcgtcgcacacacgcacgcatgcacgcgcgcacggggcgcgccaaaattacgacggcgcacgtcgccgactcgccgtaccgtgcgtacgtccttcctcagaacgacggcacgacgccgtccgacgcggcgagggcggagaacgccggcgagcatggcgcctcgtcgtcgtcgtcggcgtcggcggtgcgcttggcgaaccggcccttgatgcgcggccgcgtctcggcgtacgccttgcgggacgcgtaccggatggtcttgtcgaaccgccggttcttgcgcttctccctgtaccgcatcagccgcgcctccctctccttccccttgctcgccaccaccaccaccatgggcggcgccgccgagcccgccgacagcgcgtccggtacgatcgcgacctccgacgacgacaactgcggaacgcgtaggaaaccatgtcataacgccgcgccatgagcatcgacgagagctagctgtgtggtagtgaggcttacgctgtgggccatggagtgttcggggtagaaaaggctgccggcggtgaggtccagctcgggcggcgcgaccggtaccccgatggccttgattccgtccatggaccgggcgaagtccaggtcgacgccgaggtacgcgccggtgtcggcgaagaacgcgtcggcggctgcggcgcta

SEQ ID NO: 13742 - DNA, 21648 bp, Oryza sativa
  unsure (1)..(21648): unsure at all n locations
ggcgccgtgcgcccgcgcgtcgcaccgggcgcacaggaacgccccgtccgcgcggcagtagagccgcgccgcctccccgccgcacgagtcgcacgcccgcgtccccaacccccacgacgacgaggagtaccccgccgccaccgctcctcccactcccaccatcgccttgtcctccaccgcctccatttcttcttcgcttcgctttgccgctcggcgcgtggtgcgtttcactcgctcgcagctcggtttctcgcggagtttggctgtgttttttgggcgttgggcacgggggattcgactattcgcggggggttttgagggggtccgtggcacgtggagggactcccggccacgagacgcgcgcgcgagtgtggtccgaccgaccgtccgacccgcgcggtcactctccctccccccgtcggctcgcgtctcgcgcgtactctcgctcacattgcccggtgtttagccgagcagcggagagctgacggctccgcattggccgagccggcaaatcgccgtcgcagcagcagagggtcgccatctcgcgctgcttgcaaaacggcactgccagtactactgcattttcagcgcttatccgagtatacctttacgctcttgcattcgttttgatcgcgatgtgtatgagacccatagtttaaccaacggtttttaggcggcacggaatcggatcaaatcacttgctacgcaacatggccaccatgaacccatctctctgcttttcctgctactactagcacagaagcacgcaaaaaagccaagaaagaaaaagactttgtacatcgcgatgggcacgagctctctaggactgtagtacatctagccagatgccgttcacacttgcacgtccttttcctctgcgggaagagaaggaaaaaaaaaagaaaggagagcggtggttgcgccaccattgtcgcgacgcgcgcgcctgcgacgcacggggacaacggggacagagggaggggcccacccgtccgactgtcaccgtcgcctctcgcgccaggtgtcgcgcgccggttggctggtgcgctcccggcttatcgctttgcggatgaggtgatgccatgtcagcggccacggccaagccgaggccaccgtgggtggggggagtggggacgcggcaaatctcgtgcgagatctggatccttcacgtagggcttggtgcgtgctggacgctggacacttgcggcggcagcactgagctgggctgctgcctgctgctggtggccagttggcaccgcacaccaaggctagtggacatgtgtttgcgtctcccttccattctaaaataaacagactagtataaaatatgatatatttaggtgctaaaataaataagcttagtatgaaatatgatgtattcaagggctatgaatctagagagacatgctacattactagactcgtttattttaaaatagaaggagtactagacatgttaggcatgtttggattgaggttgatttttgtcctaccaattttttttggcaacttcaatagtaacgggctgttttggtttgaggcctaaattagccataccaatatttggtaatttaaatagtgtttagtgtctatttggtttaaagccaaattggcatgagtaagaaaataagccatttcaatagtgaacttaggctattttggctttaatccaaacacaactttgccttaccaaaattagtcatgccaaaacttaacaaaatttggcattgacaaaatttgataaggtctatttaggccacaaaccaaaccaacccaacatatagatgtttggtttgctaccaatttatatccacgctgctaaaagtactatactatcaatttgttagtgtcaaaaattaccaagattttagcgctaccaaaatattgattgggcaaaattggtaacaatccaaacaaacccgtctgcaacttgcgtagagtgtatatggagtactgttatacttgtgcaacttgtaattagactttggtgtgcgtattggaatatagggtcgctacttgtttggggtctatacgaattggtgagttcagcatttccggcacttgaagtgactatgatctaatccactgcaaccaagtcctcggtaggatttggtcgtcaatggcatcttgtgtgagaggttgagcttttgaagcaacccagtgtgtgtgaggaggaagcctagccacttaaaaggcataaacaacaaaatacatgtcaataatgaaatactggggaaaagagagttttttcccctcatattattcaatggctacaaaactcgtaatctcgccctgtacattgtaaattgttaatatatttgttataggagtcttcctacagtatttttccctaaaaattactgggaaatctaccaaacgagcctcaatgacaaatacggcaagtattattgaagtttaacacttttattaggattaaaataaacattttgtgaggctcatggattttatttaagtgtcagtttcttaagcatgcacccaggggcacacacttggtggtgtccgcatgtgtcttttccgtataatcgaaaaggtcatattaatgaagtttggctcttttatatgggctgttagacaattggctacattttattgttctataatagactatcttattcaacattcttaagaaatatcctaaagggaatgtttacatgaaggccacaaattgccacacccaaatgttaggcgtgtcatagtttactgggttagttagttactacttatatttggttggttgttgttgcgatcgtggagagtcacactttgttaattcacacattcggatcacatgtgtactcaatttctaggcaaacattgttaaacctgtactacagttaataaggtgtctacctcactttgtatggcatcatcttacttctggcaaagttaggcgtcagcctaattggcttggagtagccttgcatgcatctcaacagtcaagagtctgcttctcaactgttagatttaattgggtaattgatccatttaaatcaattaaatcaaataaattccaagcctcattatgctaggaattcatgtgtattcattctcttatgggatatcaatgggatgaggagttttgagaattaatccatttgattagggaattggtaacttatatcaattactcctatttgatggatggttgatggttgtatagtggaggatggttcatggctagttgatgacaattaattgctctattcctcttcctattccattggtaacctacatcaattactcctaattgatggttggttgatggttgtgtagtggaggatggttcatggctaattgatgagaattagttactatattcctcttcctattccatgatttttactcttcatcttccattcctcatataaaatgagaatggatttgatctcctaaaagagaagagagacacactttcatccattttcaacgctgttgctgctacagtaatcccatcccgacgagtgtgtgcacacgcgttgggagagtaggcctccgaaaccacgcgttgctgcgacgtttgtacggacgggcgtgcgatcaggtttttgggagcgcaaggcgcgactactcactgttcgtcaacatctacttcaccttcaccaatatgtcaaacactggagacaacggcaacactggatacaaggagaaggaggctcccgtcaacaccaacggaggcaatactgcctcaaactccagcggatgaccattcttagggtataaccttcttacattatttcaattagaagttttactgttaatattcatcgcaatgtcaacattgtgttattatatgattgttgatggttattctacattaagcatgctcatgttgattacattcaccactatcaccaaatcaaatcccattgtaaatatcatgtttattatcttgttattttggattaaaatatgccgaattatgaccaaattttcaacatcaactgagctcacatatctatgatccccacgattgttgcagtctcaaaacacaaagattacatgtgcccatgaaacaccaaccgaggtctacctctattttagcaaactgattgatcacatgtacaagaagttggcaaaagggaatccaaagcatttcacagctgctggacgcttggcactcatttcttcaatttaataatttccatgcagaacctggggggcaaagcaaaaggtaaaaaacctgaacatttctccatgattatacgtgggattcttctcagcatcccaaaatcgaaaccaattttgtggtgcttggtacacacggtttgggacttctttgagccacaaggttgaggcttaattcagagctgcccacagtttctccgtttcggtttattcagcggccatcccaaaaaggaacggtttcagttcatcacacactactcgacagccgacagtcactctcggagaagaaaggccgtgaacatgttggatagtactacttcgactaattgaccatttgctgctgccatgagaggaggacaaatcaaacggacagagtgtgacaagtcactctaaagataacagaattctaagtactagctttgctactgtatttgggcaacatggaaagggatattccacatcgttttcggcctcgagagggaaatgcggccgtttccggtagaaaatccggataagattacaccgcagcttgcagatcgcaacgggagagagaggagaggagaagaggagagaacccctgcacgcaagtgcggaggaggacgaggagaatggcgtctctatcggatcgccgacgccgacgcgtcgacgttggacagccaagtgagaaagtttaagatcttaaaaagcagttggttggtttacgagaatttaaaaaaactggaagaattaacttctggattttaacttattttgtgtattttgtaattacaacttttcaaaaaattagatgaagaactagactgtttgagagagtttgattctcaaagaagctacggctacgactgcctgtaactcccaaaacaagtcctcatctcgacctgaagccatggaccgcgaggctgagcctagtatggagattgggtccggcccaacttagaaaggttagcccaatcggtgattgggcctcgtataatgtagcggaggatagtgtttgggcctttgggcggggcccagcagatgctcctcgaaaggttcggccactctccgtccgtcttcctcgtcggcacgctgcacagtacgcgcgctgctcctaaacccaaaccctaaagccgccgattcctctcctctcctctccacaccagctcgatcgcgatcggggtcatggccgccgccaccgcggcgccgtcgatcgacgaggccaaggcgaagagcgttctccgccaggtgtccgatcccgccttcttgttgtttgttcacggcggatttctcccccttttggcgattttgtttgagcatttatttttgggggggaggtttgagcttttgatttggtttggttgtcgcaggtggagttctacttcagcgacagcaacctcccgcgcgataagttcctgagggagacggtcgagcagcgcgaagatggatgtaaatgatctctcgcgcagtacattttccacgcggattgcttttctccggcgcgatgattgagtgctgaacttagcgtcttttttttttcttctcattttgttggaaatgtgcagtggtaagcttggctttgatatgctctttcgcgcggatgaagtcgcacctcgggctggacgccgccgtgaagcccgaaactgtgccagaggagacagtgctcgcagtagcagaggtgctacgtcgttcccagatgcttcgtatctcggaggatggtgattcctctctttcctcttaattccagttattcgtgattcactagcaacgagcacaaattgctggcaattgaatttcaaaaggagttggtaaataccagtgaaacatgtgaagtgtacatttttagataacgatgtaaagtgtacatatactctgctttgtgacctgctattcaatgttgtcaataaacttttgttttccttctttagtaatgataaatatgccatgttctcaaatacagtgttagtttgggaactagagctggtctacttttatgtgagttaagtttctctagtaaattggtttcttttttatcattgctgatttgctgtatttttcaaatgcaggaaaaatggttggtcgagctagtgagctgttgaaggcagatgaaatcatcaagcaagtggactcaaggacagttgctgcgtcaccattgccttacaatgtaaagctggaagatgtccaatctttctttgcgcaatatgcaaaggtgtgtccaagtactgaacacttatagtgcacaacaagcttgcagttagtttgaaatgaaattgaaatgtaatgcaaagagaaaaggtggcatggctaggctgcataaattcgattcaaagttcaacagaacaaaggaagttttttttctcgtgaacctttttcataattaggattttgagtatcatgaacataattaccagttatgcatgctggctatctggagcttttccagtgttatgattacatgtgcaatactatactgcaaatatcaatgaattaacattttcttggtgtacttgtgtctgaattgtaggtaaatagtgtcaggctaccacgccatatctcaaacaaaaaacacttctgtggcactgccttagttgaattttcagaagaggatgaagcgaaaattgttttggagaataatttgttctttgcaggggcaaatctggaaataaaactaaagtaagccactaacatatcctttttgcatgataatcatacatgtggaatgtgcagataaaatgcttgctttagtactatcaccataaatttctatgttaattccaatatattcccctctagctgtactgccataccggtaagttgttagttatcaaacctcatttcattgccaacattgctttcttttctattaagtgcaatttgaatgaaatgtgcgaaataagctgcattaattttgtacttcttttgtttagtttggtgtcagatcatgcaagcatttccctctagcaagttccttgtcttgcatgtttacctcttttagtgatacttgaattaatgatgcctttcacatatttgcgttcattctgttgctgtatgtgacattatgtaacttataattcgttgcctgaatcatgaaggaaggaatttgatgctgaaacagaatctaaaaaagaagcatatgaaaaggcacatcctaagaaggacgagcagaatgaagggtgacatttttacaggctgtctgttcaattacttttccttcctttagagttcaaatcaagaccattttcctggaatttgtgttgcagctatcctaaaggcctaattgtggccttcaaattgaagagaatcacggttgatggtggggtgcaacaaaactgtgcagacaatgatactgccactgaagaagaaactccaaagtccatgaagaaaacatcaactggggaatctgaagagaggactaccgtgaacagtgatatggaggaacagaagtcatcagacgacatgactgaagcgaaagaagtgaatgctggggaagctacagaatctggtgacaagtgcacagttgatgccttgctagaaagtgaaaagaagggtgataatgaaacatcgatcaaagatgacagaggcctctctggcaaagcgaatagtccaatctcaagggaagatctaaaagaagcgttcaaaaaatttggaacagttcgggtattttaatccacaccactttctagctttagtttttcttggtataaacaccagtaacagttctgtttaacattatggaatgaaaattatgaaacatatagcattcttctagattcaaatatggtccacagagagctcagattttaactcatgggtcatatggcattatctttgtactttcatttgtccttaaagatctggtgggatattaagcatgacgagttgtaaaattattaagatcaattaactatggaatgggaaatgcctgaaaatgttcttgatacacaccataaaatcgtggtaatagactaatagctagtcctaattgtaaattcatatttgtaaaagtttatttatggtccttggaggagcacagttatgaggtagtggtatgacataatgttaattatctatatctttggtacctggcatggctgtggtggtgaactgttcatattgtatgtcactatgtcacaaattcacatgacactttttaattccgttttttactttcattgcacatgtttttcttcctgaagtatgtggacttcagtatcggggatgaatcgggataccttcgtttcgaggattctaaggcagctgaaaaagcccgcatgtctgctgtattagctgatgaaggtggcttgatagttaaagaccacattgttaccttggagcctgtgactggtaattgacaatttgacatgtgtttattagagtttttttaataccattactgcttgcattgtatcatgattaataaatgtagaatatccattatagaaaatttttagttccatttaatgatacttaggtggaatcgactcctattattgtttgacgctgtaaattaattcctcaaatctggatgcaattaaattggtttgtggggtcttactttttttgtttttgcaggtgaagctgagaaggattattggaatacaatacgtggcattcaagggaaatacaaggacaataggagttacaaaggaaggtattcaatgaattaacagtttaattttatttgtttatgtcctgtttggtactacgtacaatattatctctagaagtaattgcagacaattatcaggaaaggcacactacagcattcagtaattttgtggcaaattagaccgaaataactttgtgtgccttttgagaatgttatgactttttcatttgcaattttcgagctagatgacctgcgctaattgcaatttatttgtgcattgcagtattgtggttaccacaaatatgctccttaattccttgtatatatatgtcgaatagatacttccttgcacgaaaattgatcatctcgtatgcccatgtttaatgttctctgcagaatataatgtgtctttgccccttgtcatatatatgttattgctctttttctaggactggaaagagctacagaggaggaaagcagttcaatgggaagcgaggccgacattctgattcctccgaaaagggtgcgaataaaacacagaaggtcgaagctgctgcttaggctaattttaacgtcttcactcgaccgagaagtaacatgctacgcttactatcggtggtcttgtatatttattatatcagagaccatttattaccatattttgtgactgttattgtccattttttatgctaaccttgttccaaggtatacttccgtaatgattagcctttagtaacggctttgccgtttacttttgaatggctttggaggatataaccttgtatagctccaaacatgcaaacccggagctgtttcctgcagcggagcagagcagctgtcctgacaatcttcagatatcttcaccgtcctggattgattacaaaacgattatttcatcattctaattacacaaaaaaaaggtttagaaatatggctgatttcaccgttctgggatttatactttggggcctcagctcatgatcacgagcattttcgtgtaaggtttgcttttaggcttttagcttccagagaagatgnnnnnnnnnnnnnnnnnnnnaccttcaaaaaaaaattgtagtagtactctggatacataatgatctcttaaggaataataccttggaaattattgttgctaaggtccaactgcccaagcagtggaaggtctccaaagctggatggtgtgtagccaccaagattattgtggctaaggtccacataagtgaggtttcgaagcttttccatactgaatggtatactgccatggggatatattgttgtaaccaatgttcaagtcccgtaactgttgaagacttccgaaactagttggtatgtgaccttcaaagctgttctttgccagagataacagtgacaagtatgaaagatagccaatagaggatgtattggcccaacgaagttgttctgttggagatgcaggaattctagatagttagctttccaaattccaatccattcttcaattctaccagtaagattgtttctacttagctgcacatcagcgaggccccgaaagtttcctatactaggaggaactacgccggcgaggtggtttccgtccaaccatagttgttcaagactcaagagtgatataagttaccaatcgagcttggtatatccgcctctaggggtgtgtttggaaaatgggttaggagaggtgggattgagaaatcaaaatgaatgaagggataggataaaatatggtgaaatgaatggatggctaagattgaaacttaccctttgaagggtgggaaatcatatcccaaacccatttttcaaacattgcctagctgatcatgatttaggcggagcattctcagattggtacaatttccgaatgcccgcccgaattttcaactttcatcgttacttgcttcaggattgttatccccaagatctagtttggatagatttgaaagcataccaaaatgactaggaacctnnnnnnnnnnnnnnnnnnnnnatctccaacagcctctctattccactctccaagttaaattttagccattctagaaaaaaaacgtgctccaacaacctctctaaccgaatggctaagccatctggctggccaaaacctttcctccgctagccaaatttggccagccaaaagtgactagccaaccgtgggtcccacacattcctcctccccatctcctctctgcctcctccatcgcatcgtttgccgtcctccgcgctgtcgacagtcgcgcccgccgagcctcctgagccagacgacggtgccggcgtcgcgcctccgaggcacgacgacctgccgcagcagtacgccggcgatcccttgccgccaccgctgcagcagcagcagcagcagcaggaaggctccccctcgcagcacgacgactggcacttgcagcacgacagctgccccttgcagcatgacgacggcagctcaggcactgccagagcaacgccaggcagccgacgcacggcgtcgtgcaggaggagcacttggggcagcagccgccgcagctgctacagcacggcgtgcaggatgaacacgagcaccccgtgccgcagctgcagcccaaaattgaggtgaataaacagcccaaaatcttggaacaagtcaacgatctgcacgaaattcgccgttgttgcttgcctacctttccattctccattcgcaatttttgcagtgaccaacaattccaaatcgatcggaatctgatcatatccaccctagccaaccaaacgcaacaaaaatagcagagaatgagcgagatgccgccgcacaccgtgtacttgccgttcccggcacaggggcacatcacgccgatgatgaagccgccgccggctcctagtccatgcgcccctcacctcgaccagcaggggtgagagctgctgggttgatggggattggggaagaggaaacatgtagaggaagagaggggaatacgtgtgggacccactgtcaaattggagaagataaatagagatgctgttagagtaaaaaacaaatttaactctctaactttttggcaaactagctaaatgagcatttggagagtgagatttggccatgctgttggaaatgctcttagatgacaaatctatcttctttatcccgaactcccgatgcgttgcaaaaaggaaattttgatacccctttctatgttatgttaaaaataccaaaataatttaaaaaggatcaaaatacccattacaaaccaacggtttgatttgaatatactatactggtaccaccagtagtggaaagtaccgtaaaatcccccttaaagaaaggtcgagttcctcgagaaacatgaggttgccaaggaaggggctgattgtgccggacaggaacaggtactgtaggtccagctgatccacgactcgcccagggcgcttcttccggccgcatctaacgccagcccaccagcatacaggggtgcgtgcctcccacgatctgcacaccgtcgtggagcaatggacgctgccaactccgtaagacagcagcagcaaaaacgccacaagtgtagcctccttgctgtgatgcagatgcagacgatggttggccttggcacagcaggcaaggccggcctccatgaccatctgccagatgtaaagcacgaacattaacatatatttcatcgcggaaaacggaggaaaacacagtaggatcgatcgatcacctcgctgctgtttaatttggcgtttattccggcagcgaccagcggcagctagtgatcgagttggaagctcactcgcacgctcgtaggcttcgcagctgctgcaaagaggcgtagctcggtgtagccaccatcaggtatataggttctgtttggggagctttagattctaagaaacagctgtttggtagccagcttctgagaatctggaaaagctgtgaaatctagcttcttagttcatttctcagaatctgtaactacatattctcagaaactgtggactgtttggagcagcttccccaaaagagggccataaacagcttcatcgccgcactgtgacggtgtccacgtgcttcttcaccggcgacggcgaccgctgaccccagcttgacttgctgtcacgccttacagcattaggcgttggctatgacaatcttgctttaactacgaagccatcacgctttcagtggaacaagagacggccaacttgcaaattaacggactgaagaactgatgagccaccgaacctttccctccaacaagatacgaccaacttgcaaattaagaggcatttgaattactgtgtatctaggtttgccagatttcaaataaatttatccaatttgtaccacccaaattgctaccatcctcagatgataaagactgttaatatcatccgtgacagcacatgcagttgggcaatgtagatactgaatgactgtggaaaggtcgccgattgaatttgggagacccgcgtagcagattacttatagctagtgactgtatattatactctatctgtagaaagctacagttcgttaacggatcaaagaatctccaccttctgctttctttaatagaggttggcactctgtaggaaattgtacagaagggaacaaacttggccgctaatccaccattgctgtgaggacctttgacctccaaaacttcttttccaagaagatagtctaagagttgcaaggaccttgacgcccaagacttctttttcaaaaagatagtctaagagtaggatcaagatttaggttgtgttggccactgggaaccctttctcctcagcacgcaaaacagagcagcgaattaacacacaattaattaaatattagctaaaaacttgaaaaatagattaatatgaattttaaaacaactttcctatagattttttttaaaaaaacacacactgtttagcaatttgaaaacgcgcacgtgaaaaatgagaaagcagaaattgaaaagtgtagtatagaacgttgagtattagtacatgttggtgcggttaacaacgagcaagagccagaacaaggaatttatctatgttttaagagatttacaaaaataaactattgttttaaaagttttgcaaaaatatacttctcctgtcctatcaatctattatagggcagggtgtataaatcgccctacggtagagcaggctatgagcacgtcatatagtgggaggggcacgccatggcaattttatagccccacacgacagcgcgagaaagggtcacttgtaaaattaccacgacgcaccccatgcatcaccaaactattgctaatgtcacaaaactaaatcatcctacgggaggttgagaagggtccgcctacaaaattgccatagcacacccctcccaccttatggtacgtcacatagcccgcgtctacctaggacgatgtatatgccccaccctacgatagggctggaggtgtatatttttttacaaaactttaaaacggtaatttatttttaaaaatattttaattaatccggttaattttttcgtccgtcattaaaggatgggcccacgcgattttcgccggtaatgcgaatcgcgacgcgtgacggcgattttgacgctccacaaataaaaagagaaactgaaaaaaaagagagaaagctagcaagcagcccaactaaagcagcagcaggccggcccaacaaaaagcaaacgaagcctagcagtcagcccacatagcaaagcagcagcccagtacagtactgtgcgatactgtagcaaccgggaataagttcacttgaggtcccttaatttatcgccgaatatgaaatccatccctaaataaaaatgccaggtaacctcatcctttaacttacaataccttgtcaatttcgatccctcggcagtatcgtggccagttttaactaacatggcaagtgggccccacacgggtcacatgtcagtgcacaaataataccacattttgcctagcttgggcagcactagcttaaatagaaggcttgcctgaggctactacaccaaaaaaaaaggttggatccacgtctaccaagaatcatataaaaataacgagcaattttattaatttaaaaataaaaaatcacatgtattttttttaaaaaaacatgtgatcaccaacaaaatgaattatttatgacaaaataaattatttttagaaaatagaaaacaatcacatgtcttttttttaaaaaaatgtaatcaccaacagaatgaatcgtgtttacatccaatttttttctattcattgtatgatttccgtctaattttttgagtgaaaacgattatgcgattggagtgcaatgaggttgatctgatagatagcgagaaacatttcttatattattgctactctttacaatatgtaaaaaaaaggtgtttatcaatatcaagtaccaaaaaataaccatgtattgcaaccaactcataataatacatgacaaaagtaaatactttttgggtttcaaactttagtctataatacataattttattttaaagtggtaataatacttttcctataatcattcatgtcaatggatttagatcaacaaataattatgtcatgttagcatcttacttacaccggaaagattcgatttgctcctacacacccattactattgtttttgggactatctagagaactgtcgaaagttttttatggagaaaactttcaaatctaactataatataattacaatataatttcactatagctataatgtaactcatatataagtattaaaataatatatgtataatatagttacagtgcagtagttacaatgtagttataactaaaatgtaactcatttaacttttccaaaacatgcagcagatcaagtggctagcacgcatggcttccaggatggggaccctgtgttcgagcctctgcaagcacacgtgtacagatttttttttccaaatctcgcgcggatcgcatggctagaaaatcatctcgcgcggatcgtacagccagaaaatcgaatcgcacagctagaaaatcatctcgcgcggatcgtacggccagaaaatcgaaagtttttagcctccaaaactgtcgacagctagccagcaaaaccattgttttttttatgtttcacccaatgcaacgcatgggcattttgctagtaaataaataattcccagaacaaggctcccattagaaatttgaaatgtgggcatgtgggccgcggacttgagaggccgtattaacttgggctcttggattacaaatcatcccgtattgtaaaggagagatcgttggcccatattgttaaggagagatttgtctccgagccaattccagccggaaattctccctcctcatagcctcgcgcagtcgcgctagctgacggccacggcgccggcgccgaagctcgcgtgtgctacttgtttccgtaattccgtctcgcacccgctcgcgctcactgtcacatgccgttgccttcggtacgcaactgtgactcccaccctcgctaatctaatctgagttgttacttgtcagtgctccggcttgtccttgatttgtttgctgttgctgtcatcttccgtgcagtgcaggctccgtatgcggcattggtcgctccagcgtaattgtcgatggggcctcaccgaggagctcaagtttagagtggtaagtgtttttgttttttttttcagatctctgacgatttttattctattcacgtatttctctttgtgaatttcagtatcagggatggttcaggatgtcgttggtttgagggttctaatgcagctgaaaatgtccctgtatcttctttactagctgatgaatgtggcttgtctagatagtaatggctacatattgttatcacctattatattggagctagggtttgaaatttcgtttcgaaagttccgaaattttgctccccaccggaaagttcacatctcgcctgaaattttaggttttttttttttgcaaaagtttctgaatttggtcaaaaatttattcaaattctttcaaaatcagtcaaaatttcaaataattttggccaaaatttttcaaaatttccgaaatttcggtcccctagtagaaaaaccaatttcaaatcagactgaaatttcggatccctccgatacgatattattttggcccaatttttttattttcttgaattttggtaatatttgttcaaaagtttataaaattcaccatatcggcacccccatacaaataccgaaaacgaaagattgaaccctaccggtaattatatatttccttgtttgccattgatttattaaggttttattataccattttttgcttgcattagtatcatcatctcatgattgataaattaatagcatccgttctataaaacttagagttcaattcaacaaatttagtcgaacttttaaaattctaaccattaattttatcagattgttaattattgcttttctagggccataaaggtggaaatagttcaatggaagcaaggtcgacattctggttcctctgagaagggtttgaataagaagtagaaggttaacatgcttccgaggctaaaatttttcggcttcactcgatcaagaagtaacatactatgctctctctgtatgagagacagtttattatcataatgtgttctttccgttcttttttgtgtggaccttgttctgacatatggtgatcctttagtaatggctttaccattttgtttttaatgtggttctggaagatgtaaaaccctgtatagctccaaacatgcatcctgggtcctcgttttcttcagcattactgaagttctagaagtacaataggcttacgcaaacggcaagtaagaaatttttgtttaggtgtctttcaatattgggttaaatttcacgaattaaaagttaacaaatgtggatcaaattcaccattctgaccttgatgtacagtatacagctcacagtcacatgcattcccttgtatgaggtttgcttttaactaacagggagatgagccgcgggaaatttattgaaccttcaaaacaaccttgacatatatgcatattttttttcgcgaacgcacaaaagattgcacgtcaatatattagaggaatagagtttttgttacacaccgcaattggccagaccggcctatgccagggaaggggaaaaacaaagtcaaaaaaacaaggaagagaaaaaagaaaaagaaaaactcgaacgctactccaaacaacgagagggggcagagccacgctacactcccaacaagtccccaaaggaagtgatgaaccttgagttcctctcgacactcaaggctattgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaatagaaatttaatacaaatgataagttggggtttcgaatacaagcagacggacggtctagccgatacgcgcgctgcaagcgaagtagcaatggctaaactttcatctaaacaaaacccaagaaaccctgaaggggtaactagctatatataggggtgggaggacgacctaggggtgcctagggtcgtgctccaccagcttggggcgcaccccacatgggcctcacctgggccagggtcccaaatgaggttacaagcccataggcccattacaggtgtcacagcaccttgtttcttcagttgctaccgactgagatggaatttggcaatgaggcttgatgcattggaaagaggactccgagagctttccatcaagtactcacgggctgaaaacggaggtcgtatggagcttcggcggccgtttgaagtcagcagtgtagcaggtggccgaattggattttggcacttggaggactcgaacttggtatcttgttgttcatccatgatgtgagcaacggatgtatccgtagtagccatggtcacatcatcctccccttcttcacggaaaaccgtcctcggtttttccatatggtgttcttcatatagtccattcaaaataacctgtttcatccaatcaaaactagagaaactcgaaatagtgtgattagcaataacatgtttctctaaatccaaacaaatgaaaactctatgcaccaaatatattcctctatcattatatttgccaaagatatgaaaaatagcattagttagacatggcaaatcagacttagcaaataatttctccttcaaattatcgagctcacaaaaatcatcaaactgaacatagcccaaagtatttaaagaagatagcaatttacgttcctcaacttcattaacaatatgaacagcatgcttaaaatcagcacacaaagaaacactaggaatagcatgttcattcactagttgtggcatggatataagtgaagcattatcacacaactcttctttatcacaaggaacagcgagtaaatcaacttgtgacaaaggaattccagcatttggttccactaacggttgctctacttttgcatgaaaagtggacaaatttacttcgttaacaatgcactcaccttgattaatttcagtaccatttactttaccttggatgtcctctttagatgatggaggtgtctcgaacttgagtgtgaacaatggaattggtggctctttcatgtctctctcctcctttttgtgattacgcacttcctgcaaatagttagtaattggaggcaaagacatagcgtgtttctttttcatatcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaatgtaataaacaagcttgcatatcatgatagtatgaagtaacagttctggtatcttgttttaaacattgtagtttgttgaacaaaatgtcagcataatacatgggaacataaacatctctgaaatatcgtttcaggtctttccaagattgtggtattttgttatgcctacaaagatgtttccaatcattagaagcatgtttaattaaaacactagaggcacacataaccttttgtttctccgataagacatgcttttgaaattcactatcaaccgctagctcccaattaatgtaagcacgaggatcatagtttccctcgaaataaggcagtgcagatttgatcttacctagaacatcatcacttacctcataatggtcatgttgatccctcctcatgtctcgacgaagatgtcgatgttgagcacagctatccccaattatcttgcatatccctgccattgttagtagaaaacaagaaacatacacaaaaatatgcgcgttcctattaactactaggtagtggcagctcaaaaatcgcacacactcaagcttttaaccaaactcttacaagatcttaccaatgcaagtggaatggtgacatataccgactcaaccaagcaccccaatgaaggttggatgtatcgatgccttggcaaacacttgcggtaggctgtaatcaaatatgtggagctctgggtagggttaaatatgtagcaaaggaatagcaaatgctcaaatcagataatgcaaagttgaataattgttcaaagtcaagtaccgtgctggtcctaggctagaacgtactagagacaaacgataccacaagatagcactaggaacaactcatgcacaactctgatatatgaagtttagctcaaacataacagtattttctcttttctttctttcttctttcttctttctttttttttccttttcttttctgtttttttttgtgtggctttttttttctctttttttttgcacctttctgcctttttttttctcacttttttcttgatttttttaaacaaaaactgactcaaggaccttaatgtaagattacagggactcaaacataaatataaaatttacagggactcaaatataaaagtctaaacccaaaattaaaattatacaaaaaatggaatgctgaatttatgccggttccgtttttccaaacagatctcgaaaccgacaccaaacaaaaattcgccaaggtgtttgacacaactcggaaccgtggaattgagggagggggtcggactcggccaaaggggcgagtgggactcggcaaggaggtggagtggatggcagccgaatttggtgtatgggataaaaaggaaactgatttttaaccaatccaatctactatatctttccaaaacaaacttgactacttccaaaatcagatatggtaattcaccttcctcctctcgtgcacgacacaggcacggccaaaacaaacacacacaaggatcggcaaactctagatgcaactcaagaactccaaaactaaccgacagaaacttctgaaaactacaaaaatagaaccttggcaacgagccgattccgttttcgtaggtcccgacaacaacagagacacggtggcagcgacgactgtggtacaaaacgtgaccagaactcgaaactctaaacgaactagacgctaagaccagcaacacgacatgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctattgttggctcgatctttcggtgagttgtgataactacgatttgggagaaacgttgacgatccgactacaaccgtacgagacgttgtgttgcgccttagcgatcgatacacctct

SEQ ID NO: 13743 - DNA, 11444 bp, Oryza sativa
tctaaacaaaacccaagaaaccctgaaggggtaactagctatatataggggtgggaggatgacctaggggtgccaagggtcgtgctccaccagcttggggcgcaccccacatgggccccacctgggccggggtcccaaatgaggttacaagcccataggcccattacaggtgtcacagcaccttgtttcttcagttgctgccgactgagatggaatttggcaatgaggcttgatgcattggaaagaggactccgagagctttccatcaagtactcacgggctgaaaacggaggtcgtatggagcttcggcggtcgtttgaagtcagcagtgtagcaggtggccgaattggattttggcacttggaggactcgaacttgatatcttattgttcatccatgatgtgagcaacggatgtatccgtagtagccatggtcacatcaggaagcaacgcccgctaacgaccacaaccggccctccgacaggatggactctaggaccactgagaccgaagagagcacagagtcaaacaccctggaattacgttccttccatagctgccacgagacataccggtctcttaaggtatgataccttggaaattattgtcactaaggtctaaatgcttgagcttttgaagctttataaaactggatggtatgttaccatcaagattgttgtgactaaggtctagttgaacgaggtttcgaagctttcccacattgtacggtatactaccatgaagattgttgtaactaaagttgagacgatctagctgccgaagatttcctaagttggctggtatttgaccatctaagctattctttcccaaagaaaattgtatcaagttagtaagatcaccgatggatgatggtattgacccggtgaaattgttctcctggagatatagaagttctagattcctcagttttcctacccattcttcgattgtgccaataagattgtttttacttagccacaaactagttaggccatgaaggttccctatactcggtggaaccactcctacaaaatggtttacacccaaattcagatattgcagattggtggataggttaccaatcgagcttggtatatctccttttatttgattacgagctaggttgagtgcttgaagaagggtacaatttgcaaatgcgtgtaaccatttttcattgtcacttgcttcgagatggttacccgctagatacaaatcggacagatttgcaagctcactgagataactaggaacctggccatagaaattgttgtttgtcaagtctatcaaccatagccccgaagcgttgataagggaagttggtatatgaccttcaaacatattcctcgctaaggaaaggaattggagattagggagcacatcgccaatgttgggtggcagtgcttctttccctagcatgttatcactcaaccataaagtctgtagagaagacagattgaacagttcatgtggaagtcggcctgatatgttgttcataaaaatgttcaatgacaacaaatctgacaatttcccaagctcacggggaatgcttccctcgagatggtttatttgaagagagagatagtttaggccggtaatgttgccaagggtgggagggatggttcctgtgaatgaattattggaaagacataagctcgagaggttcgttagaaggcccaatttggtgggaatttcaccaacaagagaattcgaggagagatccaacacccttagtctcgaacagtttgcaagcccctctggaatagtatcacgcagtgagttatgcctaagatccaggactttcagtctgtggagatggttcagcggaggcaatttgccggagaaatggtttgaagagaagttgagtgccttgagaaacgtgaggttcccaagggaggagctgattgtgccggacagggagagtttgaagagattcagcgccgtgacgcgcccagggtgcctccggctgcagctaacgccggtccactggcagaaggggacgcttgcgttccacgagctcatcgcttgcgttggatcttccgttatatgcttcttgaaatccatcagggagagcagatcagctgtgttgttcagagttgcttcacaacggatgctgccagctccgtaagacagcagcaacagcagcaaaaacgccagaaatgcagccatattcagaggatgattttggtttcaaaagatccagaggatggttggcctcagcgccttccttatctgccaaacgtaaagcgtgaacatttcagcacaaaagtacaatacgatagcagtaatttaacactagagatgtatttccagcaggagcagacgatcgatgagacgactttgcgatgaatggttaacatgcgcgataaattgcataaataaatatcgagagatcagaatgcacctcgcccggcgtgtttgcttccgccttgttcagtgcagaggttggaaactcgcttgctcgtaggctcgtagctaacgcggcgaaaggtacgcatgcacctggcacaccctatccggtataaaaacagcttgaacgggcgggcgtacctcagcttcgcttgatatcatgccttaggctgtgtttggatgccccctttcccaacccctctccctcgttttccgcgtacacgtttttcaaactgctaaacggtgtgttttttgcaaaaagtttttatacgaaagttacataaaaaatcaaattaatccattttttgaaaaaaaaaattccaaatgggaacggcttctagcgaacacactcttagcaggtacgatagcagactatataagtcaaccgtaagcacatatcaagaagataaataagaagagataagaatagcgagctataaatttatagtcagctgtagcacatactacaaatgtaatatgtgtatgacaggtgaaaccaggtactacttgtgtaatactctctccgtcccaaaaattaagaaattttagagttggatacggttattaaaaaagtaggtagaagtaaacggtgaagggttgtgattgaatgagtagtggaggtaggtgagaaaaatgaatggtgggagagttgtgattggttggaaagagaatgttggtggagaagttgttatattttgggataaattctaagggctaaaatttgttatattttaggacagagagagtatatattttaggtaacgaattagctattaaattgactatagatgctttggagctactagtaggctatactgttaaacttgctttattacattgcaagcaatgaatttcagttcttcaaacttttatttccttttgctttttaggcaataaaccacggccgcaccgcacttctggtggaaccatcacagattcacaggtgttcaaagaagagctgacacaacttgcaacagactgcttgaaaacaaaaggtaacggaggaacttccgatgctatttaaggtgaattgaaatcatttggtacttaagaaaaattgaatgcactggataattaaaccaccaagaacataaacgatattttcataattattatttacacgtaaacttcagagtaaatttcaaaaaactaaaagatatagtgaacaaactatcacagaactatagatctaagatgatatattagaaaactgtagatttaacatcaaatttatcgtaaaactaccaatttaaggtggagtattgtaaaattaaagatttagtaatagagttatcataaagagtaattttaccatccaacatttagtaccttaagttatcataaatttttttagtacctcaagatactttttagtgtaaaatttggtatctctcaaataaaatttagtccctcaaggtagttagtaccaaaattttgtgtgcaaaatatggtacctcgaggtaccaaatgttggatggtaaaatcgctctatcacaaaattacatattttgcgttaatttaatcacaaaacttggaggcctataactcaaacataatgggcatgttcggctgcacttaactttactgttgtgtagccaacacaaacagtacgttgtgtctgcagctgcagcagcaacggctgcgtatagtggctgtaccagctagctgaacagacccaatgttagtgctaagaatttaaacgctaaaatatgtagttttgttatagttttatttttaaatatgtagttttgtgatatttagccataaatatatagttttataatatatcatcttaaatgtgtagttttggataattggttaacctctgtagttttgtgaaatttgctctaaactttatatattatatttatccattatgttattagaaactttatatattattcactatgagggcttgcaaactttcatactggccaaagcggaggaaaaatgatctttttttccatcaaatacatcatcatttagtagtttgataaacatgctaacggataacgagaaagttgctaaaactaacggcataaaacaacggggcctaaagcaacttttaatatagctaagagcagtttcatgaaaacgtcaactagttttagataatttataaacatgcataataggtttgcctattcatatggttcaaatatctatctccactactgtaataatactacaagaataggttttgtttgtccatcgacgcgcaaagtttcggtccacacttcatgtaaaaaacaccctttctggatgaacatctggttcattctttctctaagattccattacaacgcacaagcactgtataatttgttaattacttcttccgtttcatattataaaactttctagcattacctacatttatataaatgttaataaatgtgtctagattcattaacatctatataaatatgagcaatactataaagccatataatatgaaacggagcgagtaacatacaatattctttttctcctcataggcttgcctttatctcatactaataacatactcgtacgttgttaaagtgatgaaggatgataactctgctttttagtactccctgttctatattttagtatttccattcttcgtatagattcactaatatatatgtgatatacatatgaaacacatatataaatccatacataaatttatttaaatctcaaaacattttataatccaaaactgatatagtggtatagaaaaactacacggcattccctcttaaatactaaggctgtgttcggtactttgctttcccaactccccctctgaaatacgaaagttgctttaaaaaatcatattgatctataggtttttcgttttccgtgcatgggatatgggttttcaacacccgcccccgaacacagcctaagagactaatgtcacgccatttcttaagtactagttaagccactgaattgtctagatttgtcaggtttccaataaatcatccaagtggtacaacccactgtcattatcctccgatagaaagctgttaatattatccagtcgacagcatgtacagatttaaggaacgaaagttccctgatgtagagataccgaatgattgtggagaggtcgccgattgaattcgggataaaaccgcgtagcagattattactccctaatgtataacgccattaactttttaacaaacgttcgacatttcgtcttattcaaaaaatttatgtaattataatttattttattgtgacttgatttatcatcaaatgttctttaaacatgacataagtatttttatatttgcataaaaaatttgaataagacgagtagtcaaacattggttaaaaagtcaacggcgtcatacattaaaatatggatggagtgctagctagcgacaatatttgcagaaagctagctttgtctgccagtagcttcaagtttgttttcaactccgcatctatccagtcaatatgacctaggtttggaacctttgagcaactccaacagattgattatcccactcttcaaaccaaacaatataaaacataataaaaaaataaggtctcactggccatttaaatgactaagccatctcactggccaaatacccaggtgggctggtcaaatctagccagccggtttagctggccaaaccatagtatcgaagcagtgctagtgagaattttctttaaaaagataataatagtattttaataaaagaatttgtaaaagtggagatggaccgtcagaaatcataaatttagtatcatatcgaccaaccaaagtttgatatggcacatatcgaagaactacggtttgatatgtgacctctcggtatgtggttgttcgataggttgataatttgattaaaaaaataaagaatacatgtcctaagcttgtttggccggataaaataaataaatgtgcatgacgcgaccaatcgaacttgcgaagttcgatatgtcctcctcaccgaattaaggaaaaaaagaagagtgtgcatgtatgatggccaatcgaactacgatagttcgatatatcctagctactgttcagagtaggattgattgcttttatgtttttttaatcatgccaacatcacctgtcgaaccaccacagtttgaattatggttgttcgacatgtgctaaatttgttatttcatccaacaggaatttatttttatatctttttattaaaaagctattatttttgaaaaaaaaaatcagctagtgacagcactttctaagtagctacctcgctcccaccgcctcctccccatcaacagttcctccatctctccgtatccaatcttatcattgctgccaccgtcttcctcatcttgaggaagacagccccgttgtcaccctggttgtcgactcgaaggcaggacaacgagaaggaggacggcaagccggagcctcctcccgcgctcctatgttgcctcgtccccatcttcgtcgccaccatctcttgcatcatcccctacccctatcgttggaatcaaatggagatgctggcaccaacaccgccaccagcctcccctgcatcacttgtcgccaccagtgaagaaggaggcctccaacaccgctgtacaccttggcggcagtatcccttgcgccgtcatcaccgtcacccccacccacgagccttgcctcaagcagccgctgaccgttgccaccacctccctatccggtgcaacaacgtagttgccacccggccccaccggcgccaccatagtcatcaacatatgtgaccctaggccaccatcaccccaccccttcctcctcgtcgtcatccagcttccaccatctcacctctcttctcaccctcttacacggtcgatcagttgcggcggtgacggcttgggcgacaacaggacagttggttgcggcggcggcttgggcagaggaggcggaggtggggaaagaacagcaatgtcctactagtggacaaccgaaagcggaagagaattttggagggaggaaagtatatacacactgacatgtgggaccgattgttagattgaagagtgtaaatagagaagctattagagtaaaaataaaattgtttctctattcggtatgtaagctgtggctaaataaatatttggagaatcagatttggataagctgttgaataggagtatgctcttaccagcataccgaaagacgtataggaatttctcccaaaaaattgttgttatccaaatctaaccttcctagtactgaaacattgcctagggaagctgccttcaaacatgttgtaactcagcaaaattaaagcacatctgcaagaccaggactactactcacaccaactgctgagataaaatgtttacgcacacgccctgggtgattcgggctggcggtggtgtggacgcttgtgttccagcggctcaatgctccaccctactggatcactggtgatgcatcgtggatctcaactcgatcgatcccattatcccaacctcttcatgtcttccactatcttttcgagggaatcacttagccacttcgctggatgatggtgaagtggggagaggacgggagggagaagggaaagcccttctcgcaccgcacggcacgacggccttttgctgcctgctttaattcgcttttgctgttgcctctagcttagcttagcttggccgccaatcgtctcggtgaaaagagagcttgaccgctgccattgtagcggagaccaccttgcatcggtgccaggatgatgaaccattgtagggtgtgtttggctcacggttacgtatggatgggatatgaccaaacatattttattcgatatggcgatccaattttttttgtttggtttgtatggataggatgatcaaatttcttgtttggttggagggatatagcttggatgggaaaagctaaaagttagtgggacccggcccatttgtcatatatatatttttatcaaaatattatcatccgatatcttattttaaagatttaatatagcggcccgcacagattgcgcggctagcattattatattttctctcatataatagcatatatatgttttctcaacgtattatttaaatatattgaaatgacaatataattttaaattttgtactaactttacgaaactactaatgtgtaatattcatattgtattttatatacgtgttagttactcattatttttaatatcaaattttagttatttgtaaattatattcctatatgaactctagactcgtctttcaatatttctttttttttaattccaaattttcgttatctttatttctatataggctctaggctctcttcaaatattattttttttaattctgaatttttattatttctaattgtatttctatatagattctaaactcatcttttaatattctttaatttttaatttcgaatttcagttacttctaaattgtattcctgtattgactttagattcttcttcccatgtttttttaaatttcaaattttagttatttgtaaattgtatttttatacgaactctaaactctacttttaattttattatgtttattccaaattttagttagttttaaattccaatatggactctatactctacttctaatattccttatttttaattttgaatttctattatttcttaattgtatttcgatatggactttagtctcctcttccaatattccttattttgtaattctgaatttcaactatttctaaagtctatatatatatatatatatatatatatatatatatatatatatatatatatatatatatatatatatatatatatatatgacacctatttgctactatcgggagtagttactccctccgcttattggatcgggttagtggaataacccataatccgataatatttgcacaaaatattagcttgtagttagttcaaataatttctaaatcatcggttgcatgcaaaccaattttaaaaaccggtagaacgtcagctaaaaaaatggcagaacataactgttttgaaaatatcgttggcagaacataatgtgaatcgggaaaggagcagaacatggaaaaaaaaaacgcggacagaagatattctgctcatatgaaaaaaaatttaagcggacagaagatatcctgctcatccaattaggagcagaatagaactggaaagagagcagaagatcgagcagaaattctgtttgaaaggacgcagaacatcagctgtttggcggcacatgaaattgttgatgttctgctcttttcaaattgattttctgctactagccagcagaagattatgtatgcgcatcaactaaaaaattggcagagcatcaactaaaaaaaatggcagaaactaatctgcatcagagaagtatgcatgcgcatgcagcagaagctaatctcccgttccttaaactatggatatgtaatagaatagcttctggtccttcaaacgatttaatctactactagagcaaggcccgtgcagaaacgagagcagaacattcctgcttcttctgcgcttgtagcagaacatggatcgtagtttctgcttgtgcttgtatttgggtttagagatgtagcagatcatggcacacggcagaactgggagcagaacatcacttctttttttgggtttagagatggacatgcactgatttggagcagagcatgatctgctatctgatttctgaggagcagaacatgttgcagatttggtagagatgtagcagaacatggcgtacagcagcagaactgggagcagaacatgacttcttaatttcttatcgcctaattacatttacaccagcatgatagtttctggtgaaaacagaactagagccaccaccacctgatacatttgcacctgctgcaggactgcaaagttgctgcaaatgcaaaacataaagaaagcgaattaggagcagaaacgatcaagaaaggaatcgagatcaggaaaagaatccaaaagatgaaaaaaataacagatgaatatgataacaaaccttggaactggaatcctccatgccagggctttcaccgttatctgcaacacagccgccggcgaggctacaaatctgacttcagttgggttatgaaccctccaaacgcagagaacaattttagatcgataatgttctgctcttccttaacgacggaaaaaatatcctgctttctcactttggataaacaaacacaagtttcaaatttcatatctacaacaaactcgggaggcttcgttcaattgttggatctactgtagaagataaacgaccttctgttgaccaccgagaaaaataaaagctggagggagtattcgattcattagacccggtaacagtcattggcattagtagcgatcgaattgagggcgcatagggagggagtagctactcccggtagtagtatataattttcctactaccgggagtagttaccggaaatgctagctagcgattgatcgctaggggtagctagcagcgatcagattagattttctcccctccacctggttttcttttttggcaccgcattactttcctattttaataaatttatgcacctaaagtttatacaccttaagtttacacatctaaagtttagagattcaaagtttataaattaaaagtttatatatccgatttaaatttaaatttgaattcaaatatttttatatatatagtatttctatacatctaaagtttatagacccaaagtttataactcaaaagtttatatacccgattcaaatttgaatttgaaatatatccgattcaaatttgaatttgaattcaaatatcctatttaaatttaaatttgaattcaaatattttttttatatatagtatttctatacatctaaagtttatacacctaaagtttatacacctaaattttatagacctaaagtttatatatccgattcaaatttgaatttgaattcaaatatttttcatatatagtatttctatacatctaaagtttatacacctaaagtttatagacccaaagtttatagaccaaaagtttatatacccgattcacatttgaatttgaattcaaatatt

SEQ ID NO: 13744 - DNA, 5167 bp, Oryza sativa
ttcctgcagccctaacggcagtacatattatgcctattgattactaattgtagtttattatgtgtacgtacttaaataaaacgtatttcatattttgcatatctgaatttctgctcgggatagtttctgcttgtataaatgtacaacacacagccgaggtaagggatgaaactcttctgcacagaatttacggcagaacagaatttgtgcagcagaaagctataatcccgctcctgaatcaatggatagtaggataacagaatatcttctgctctttcacaaactgattccattcactattagacatacgactaggaagaaacaatggcagaacatcttttcctccccaacccataattcgtgacttctaatctgttgtgtccataagtccattcaggtcatttacaatttgtaagaacgtagaatatagagcaaggaatacaaagtgcagaataccttctgcctgttaaactgaatctcatcgtctatatgaagcttataaaacttgaaaatgagcagaaacaggaaaggaggcaggcagtatgtgagtatgtgacccgggaaaggagcagaacatcgattagaaagggagcagaaaaataatttgaacagaagcagaacatcttctgctcctccaacaaaatcatcactaagcagaagacgttaagaaggcagaaaattttctgctcgttgtagttttactcattgctagttttgcggccagtcgttgcacgcatggttatgaacggcatgtgcagcacacaaggagaacaacatcagttaggaaggaagcagaacatcgttttcgaaatagatcagaacatcaatcggcttaatataacaatctgcaacgctaacaaaaatatgcagaatataacaaaaagcaaaaactcttctcgacagaaactcgtcaagaccttctgctcggtttttaaatgcacatgcatgtgtaagaaaaaaaaaacctagattaaaacggagcagaaggttggtacgttcgatttctgctccgtacgttcgtttgtgtgctgccgatagtcaagccataatctagtatttagttatttatttgttaattgtttaattcaataaaccattacgtggactggttggttaatggatccccttcattaaatttgtttggagctccatggtgcgcgggctccatgattcaaattgcgtatatactcaattcaaatgagtatgaaatttttttaaatgtttaggtgttaacattaactactttactaactagttcaaaacaagtttgaactaaatttaaacatgtttttgttagattttgattctaggtatatagcatctaaacatataattagttaggtatgtaatattggattgtaaaataaagttaaatttgagttgttttgttgctaggtatatgtatgaatagaaaacttataactaggtatatactcacaatttgaaaattttgaaaaatttggacgaatttgtgtatttcataccatggtgcccgggcaattattatttagagtagttaaatatcatgcaaacataacatatcatttgcattttgttgtaattttagaactcaatatgcaagccatatcaaatcattatctccacatctttttcacattattcaaacatatatatatatatatatatatatatctattattttcataatgtataacatgtatttacccacctattctacaacaaaacgttgggtatcaatcagttgatttaagcctatagggcaataaattgagaacaagagaatgggaaaagacattaaaaaaagagagagaatgtaaaagactagagtgcccttgagacaccaagacacacgttgacacgtacccttgggcctaaagagagatagtacagcgataactgataagtgggcataaaaggtatatgaacgtactggtcacgcactaatggcatgttaagcatagaaacctttgagactgttataactaaggtccaagcgactgagttgacgaaggtttgccagactggatggtattttgccaccaaaattattgtggctaaggtccagctgcctgagcttaggaaggtttcccaagctgcgaggtactttgccactgagattattgtgactgaggtccaacaggacgagctgttgaagatttgccacgctagatggtacttcaccatggaggtagttgttgccgaggttcagccatacgagctgttgaagatctccaaacttggatggtatatcaccttgaagattgttgttactgagattaaagctcactagccgctgaagatttcccaagctgggtggcatcttgccttttagattattgtaactaaggtccagctgtgtgagttgttgaagatttcccatgttggacggtatgtgtcctgatagattgtttccgtccaaaagcaggtactgaaggttgacagacaggttcgaaagcttaccgagagagctaggaatttgcccagagaaattgttctctgacagatatatcaaatgtagctgtgaaatgttgccaagggatcctggtatgttaccttgaaacatgttaacacccaataagagccattggagattaggaagggcatagccaatgtttgacggcaacgatttccccagaaaattcatctccaagaatagcattcgaagagaagagagattataaagggcgcgtggaatttcacctgatatgatatttacactcaggtccaacgacgacaatttcgacaacttcccgagctcagaaggaatgtgccccgagagataattacgagaaagcacgagatccgacagctcagagaggagtcctatgccgaggggaatctggccttgaaataagtttatgctcaaatctagctgcgtcaaactggaacagtttgtaagcgtgtccggaatgatcccgtccaaaatattgttactcaggttgaggacttgcaattttcggagactgttcaggcgaggtatctgcccagagaagcgattaccagaaaggtcaagcaggtgaaggtaactcagattcccgagagaagcggcggcgagtcgaccggtcaagttctggccggcgagctcgagcgccgtgacgcgatgctcccggcggccgcatttcacgccattccaccggcagaaaggggtggttttgttccaggagctcaggacgcccgccggatcgtcgccgatggcatccttgaactcgagcagcgcgagcatgtcggagtcgtttccatggaccgccacgacgcagtggatgttgccggctgagtagcagaggagtactaacgccgcaaacaaagctacgagcatggcgagctacctgcacagtggtaaagcaagaaatacttagtacaggataaagcttttaaaaagctaccagtagcagctatattaaaaaggttatgaggatatcagcaccggcctgcacggctgcagttggtctcggttggaatctgactgtggatatgatctccgaacctctcgtgctacattttcgaaggaatcgtcgtcgcttcgtcagttgatttttctcgggctggcaccgtcgcgcacggcatggcggtctttctcgccgccttcatggcttgaccgccattgcagcggagacgaccttgaccccacaaaattttgagaaaatctcctgtaccctcgaaaattcgtttaatccccttacgtgcccataaattttatcccgttccccttgtgtgcccataaatcttgtcccgttccttatatacccctaagttcttactttgatcttctctatatccatttcgttaaatgtttttgaaattgactatattatctctctcttatacttatgtgctagtttagtgataaaaacacaattcttatatgaaaaagatctatttgtaaaaaaacaaagggaatataattatttgacaataaattttaaaaacaaatctaaaattttaaataaatttaaattaacttttatgaaactggtacactgttttcatcaaaatttgaatctaataaataaataattttggttcataatttctagctaaaactcatatggatttgtaaaaaaatgttcaacaatttaaattttcttttacatattttacaaaaaaaataattatgccccatttgattttatcatgaattacaattttttcacattgtgaattatggagtagatagcatgtaagtatgggaaatgggcgacatgatcattttagaaaaatctaacagtcaactaacggaatagggatagaagagatcaaaataaaaactcaagggcatatagagttttgagacaaaatttaggggtatagaagagattatgaaacttttcaggggtatgtagggaattttcaccaaaattttccctagcttcttccaaaattcatttctaaaccgaattaccagatataagaagtccctcaatttacaaaatcagatcacccgatgtcctaggcagtattgtgaccgattttaggtgtcttggcaagctgagtcactacgagacccatgtggaccccatatgtcattagctatcactttctttctctcccctctcccttctcttctccttgtctgtccagaacttgatccagcgtcgggccttcccggttgctaggttgcacagtccaggctcctgtgggtgtgggtggtggacgacgacgtgggagacggcaccggtgaggccatcgacgcggagagctagtgttggaggagtgcgcagtggagcggctccgctatgaaggcgtggaggaggaacatcatgatgttcgcaccgtcgacggtgacgtcggatcactacactgggtacccaaaagtactggaggactatagtgattcaaactggatatctgatactaataagataaaggccacaagtggatatgtattcacacttggatatggcgctgttttctggaagtcttgaaagcagacgatcttaacgaggtcaacaatgaaagtagaactcacagctttagatactgcaacagttgaggccgagtggcttcgttagatcctgatggacttgtcggtggttgaaaaactagtaccagcaatcctgatgaactgtgataatcaaacagtaattattaaagtaaacattcgaaggacaacatgaagtcatccaggcatgtacaagaaaactgaagtttgtcagaaagcagaaaaactccagagtgatagcattgg

SEQ ID NO: 13745 - DNA, 5453 bp, Oryza sativa
  unsure (1)..(5453): unsure at all n locations
cttttcgtaacgcagagatacctacagaacatcttagaaggaacatacctatataagtctaactgctagtcacagtctatgagatctagttgatctttatatactcatgaaaaggcttggaatatgatttatatgctccaaacaaaggggatgtaaacggcagcctagtaccagttaagagttcgagtgaaacctgatcgcacaaaactgacaattcaatgtatagtccattgttcagttgtgatctggtgtagctcttttcctaggtggaagtttaacttaacagtctccaccgaaacaatggtataacaaataggttcagttttaagaacatttcttgtgagccatgaaatttggtggggattattagaataaatgggctaggcccaatttaattcaattaaaatctcaagagcccacaagtaatgttagagacaatactgccgccttgaaaatttaggtggaagaatacggtgatattagagacaaataatacatatatattagagacaaataatacgtacgtagagagattaaaagaaagatgaataagaaatagtgtatactcatctgagtgtggatatgtgattcagaatttcatgtataaactaaaaacagtacacaccaccatccaggagatctggtggtagcggtaggccgccacggctgccttggcttgacatatatgaaatcaaatcacagctgatggtgaaattaaataacaaagctgctaagatcgagacgttttaatccttgcggcatcaactggagactgacggtgaaactaaataacaaagctgctaagatcgagacgttttaatccttgcggccggcatcaactggagaaagggagtagatcagcgcatcgctaaacacctagatctatactcattctgtcgagcggaaagggagtagatcagcgcatcgctaaatacctagacctatactcgttctgtcgagcggagccagacgatgccgtttcgtggtcctgcgacgccggcagggcagaagacagcaggccgatgtggatcacgccgtcgcttccgactcgctgtggacgccaaatcaacgatgtatcctgccctcatcgcatcgctgccaacccctccgaatatcgagctctccactgataactgatttatcgatcatccaatgagctggtatttatcgatccggttttccgattaccacgggttaattgagattacggattttttttcttgttaaaaatgaaaacgggtgactaaaatagatttttgctggcagccgacagtgccgccagcgaactaaaagccagtgaaaataatacattttcactaccggtcagccagccgccagggaaaatcgagtttaactggcgacatgttaagacaaccactagcaaaaataccatcttcgccagcggcaagttaaagatgaccgccagtgaaaacattttttagggttaaaaaaaattaaaaatcagcgccgctagtcgccacggccgcatgcactgcccattgacgaaccccaccacggcggctctcttgccactgttggtcgccgccgtcgaccctgaagaggggaggttcccctgtgccacccactatagatctagagaggagatgagctagacttccctgcgccacctcactctcccgagctcggctgttgccaccggatcagtcacccgcaggagtccccaccgctggtccgtatcctgcccgagtcgccacggccaccccatcccctttgccgccgccaatcgtcactgctgagcccggagagacgatactcccctttgtcaccccactccggaaatggagaggggaggagctaggctcccctacgccaccccactctgccgagcccgtccgccaccaccagatctgttactcacgcgcgggagttgctgccgccggtcaccgccaccacccctcctctttgctgccaccgaagccgctgctgctggacccgccgccggttgggagggatcggaggaggagaggagtaaggcggtggtgcgccggtgaggaaggagaagaggagaggtgtcgatctgaggagaggagaatgtggagtggatctgaggatttttgctgtgcgtggttttttaatgcactgtgactgattttttttatgaggcggtggattttaaaggcggtgctctttagtgaccgccagcgctggcagtcgcttaagagatccgcttgtaaaaatatcttaagtggccgccaacgaaaatcgatttttgctggcggttggtgtccgcaatccctcttaagtatctttacaagcgtgcatttattaaatccgccagtacaaataaaagggtggtgctatgaaaaatggtttctattgtagtgacggtaacaaaatacataggaaacttgattgaatactcgatcaatccatgacaatatatatcaggataacacattgacacagcgacgcccggttctttttcattaagatacatattttacctcggtttccattagcacactttttaaacagctaaatggcatgtttcgtgtgaatattttctatataaaagttgctataaaatatcaaataaattcaatttccaaatttgcaataattaaaacttaattaatcatatgctaatagctttttgtttttcatgccttacttaatattcattttcattagtatcaaacaccactcgagtccctcgcaaaccacagccctgctcaatcagttcccccgcatgtccacttacaacgcccacgttaagtggcctaggagatccgtgcggcacacctcactggtgatggtgctgctagcacgactgccatggggcatgcgatagcggcggcgtgtgagaaggataaccaagcgaaatactgcaatctgcagttgcgatggctaggggtgggcagaaaaagaccgaaccgaaaagaccgagaccgagaccgagaaattcggtcatcatttcggtcctaggtagtgaaagactgaattttgttcggtcaattcggttagtctcctcgggtaaccgaatagaccgaattatcaaaaattatctaaaaacaacctacaatccactatgtttaataggattaaactctaattttcacatccctacttcttctaggcatgcaacctaataagagtctttactcataaagtgcttacgaattttttttgtgatttttgtgttgaaaatttccattatttctttgcatatatgaaaatgttgttgaatttcggtcaggaccgagaccgaatttgttggtcttgatattttttcactgaaattcggtctttatttttcaaagaccgaaaagatcgaaagatcaaagaccgagaccgaaattttcggttagaccgaatgcccacccgtagcgatggcggtcaagttctacatggtcgaagttgtctcgacataagttatcgtacactcttgtcactcgcactcctcctgcacaatttgagcttcaatttatcgatgtctttgtggtgaaatcccgtggttctatctaatgattttatttgaatggattagggtccaatttactgacaaattaaagttttttcaccttcatgcttaagttgggaatttcagaatggtccagactgggctaccccgtccctctacacttatcgcacagatatgaccgaaaaaggactatgggagggacaattgggacaaacatcctaaggcccggtttagttctttttttttttttccaaaaacgttacattgaatcttgggacacatgcatgaagcattaaatattaataaaagaaaaaaactaattgcacagtttgcatggaaatcacgagacgaatctttttagactaattagttcatgattagctataagtactacagtaacccacatgtactaatgacggattaattaggctcaaaagattcgtctcgcggtttccaggcgagttatgaaattagtttttttattcgtgcccgaaaaccccttctgaaatcgggtcaaacgtccgatgtgacacccaaaaattttcttttcgcaaactaaacaacgcctaaatttgttaagcggctaaatatttagtactccgtagtttctaattaatccgttgcaacggacattttttcttcctcttaaagctacgggcatatttctggtcctcttaaagcaatggtcgtattttcgtcctaaaaaaaagaaagtaaaaaccttttcctctctctctctcctctcctcctcacgccgcgaacgcggatgcggccaccacctggccctgcgccggcgcggcggcggcggcggcggcggagtcctcccctcctctccctcttcccgctgtggggttcctgcaatctgcatttggtcagcaatggcggttctagccgctaggtgaggatctattcctaaatcctaaccctcccaccatgttcgtgaaagggtttttgggaaatgagcgtttaggatggtcgaattagagtactcgatttgactctggtagaaaaccctagaaagtttgcttccaaatttgctcttattttttcttgtgtgtgtgcgtgtgtgcatgtggcagaggaaatttaggaggttggatgtacccagatttggtattttctggtgctttacctacatcggtgccaaagttgtaatccaattttgaggccttcaggtgttgtggtatgctaggagcttaataaggtatctccatgtaacaggaatcatctatatgtggaatcatttgcatactgctctagcttttatgcgtcgatttaggttctgtggactagatttgaatatttgatagagtaatgtttctcttcttaaaattgtgggttcttcattgacttgattctctgccatgttagctactatttttaagtggatcagtgtgctggcctcatttgatgctctcaaagtgaatggataatacatcatatagtactaaagtcatgggcattggattggttgaagaaaataggattgtttctatgtcagagtacaaggttgcatcaattgtggtgctgtagtaatatcgagtagaaggggcttcgatagccatcatcagtgatgtgcttccaaaatggatatttcataatcttgaattctaaattgaaaattggaagtaccttatcgaaatgttaattggtcatgtcatcatagttccacaatgtttcttattatccttcttgtgcctgtgatgagactttgttctgttcattaatgtcggtggcagtgcaattgagggttgtgaaccctcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13746 - DNA, 30958 bp, Oryza sativa
  unsure (1)..(30958): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataaattctcaggattaagtctgtcatccttcaaatatagctgctgaaaaaaattgtgtgccaactcttccatttcacctatttcacatgtggccatgccatcgtttctctttagctttcttactctgttcttcctggatcgccatgaggcctttaagtggaagtatctggtgttacgatcaccttccttcagccacatgatacgtgatcgttgcttccaccagatttcctctctatgcaggagctcttctaattctttttttatttgtcggacttggacatcggaatcaagggatcccatgctcctgcactctcttaacttgtctcgtaaggcagcaatcttctttcttacattccctatcttctctttactccatctagataacttgcacattgtatttttcatcttcgcactaatgtcgcctaaatttgtgatagcgttgccatcactccatgcactttgtatgacctctgggagggatgactctctctcccagacttcttcatatctcatagtttgttgtcgttggtatcttatatgttcttccttctgcagtagcagaggtgcatgatctgaacacggggaagtaggatgtgtcacaactgcttggttgaatcaatctttccattttggcgaggcaactgctctatcaagtctcactctaacattgcggtcgcccctttgcatgttatcataagtccaaggtatcccatggaaaccaagatcatgaagatcacaatctgatagaacagatcggaactctctcatttgggtttcagatcttcggttttgtgacaagtgttcagactgccacattgcctcgttgaaatccctaatcattaaccaaggatcacttgtattttgcttgattcttcttagaagtgtccacatcaggtgtctatcttgagcctttggttcaccataaacaaaggtagctctccaaggatcctgattctgctctgtgataactgcatcgatatgtctcaaattgtaggacttgatagtcacatttacgctttcatcccagaacagggcaattcctcctccttttcctataccattgacagccagacatcctcgaaggccaatttgccatttaatattctccacaaaaccttgattctgtcgtgtttctgataaaaacaccacctttgggcgatgagtctgcaccatgcagacaagctcttgaactgctcggggtcgcccaaggccccgacagttccagcttaaaaacacattaggcccggcgatgctcctccaaggagcccgccgatgttgccaaatcagaattattacttgaaccctccatcttttgtttcttgacatctctacttgttgccccgaactcttccatcttttggatctcgtcaccagactcctgtaccccttgggtcctcttctccaccatctcagatgattccagaagcagaatatcactggttgcatctttttggtgttcctcctcaagatcaagtcttctcttgcttgaagacgaagatctggtcggtccatgattaatctttactggactcgatgcagtatccatcagctcatcgtccgtttcccatttattttctgtgggagtccaaccacgtcctccccttcccctaccagatcgtcctcctctcctccctcttcctggaccaccgttccagggagcacctctgcgaaagtcaggtgcagtcagggattcaggatattgtatagtctccgggggtgcactccatctccattgggagaattgggagaattggaatgaaaattgggagaattttcattcaaaattttaaggatttggatgtgaagtttttgaatttttagttcaagtttcagatcttcaattaaaaagtcttttgaagttcgatttgggagttcttccaattcaaaatggaagtttctatactttcggattgaaagtttttccaatccaaattaaaaatttcaggacttttgggttgaaagttaccatcagatttaaggaaaaaccacttcggaccacttgtgaagactcacgcggagtcacggttggaatcgattgatggggaacgcctgcctgccgcacgagggggtggtatgcggcttctttctctcttttttctaagtgtgcactagaatcataagtagcaaacgtgcgtcaaatagcattcccaatatgcatattcatattggctgattcagttcaatgcactacaaagaaaaaaaaaagagagcatttcaattttccgatgttggactggatgtcagcaactcgatccgctggtctggcaaatgtgggccggcacggactgggcctaaagagtggcctgtcgaaggaacggcccgtgataagatgggcctggatgccacagcggcccgagttcgacccattgttttccagtccgaatcccagtcacggagtcacctcttctgcggtattccgacttccgaagggatcggagatcggcggtgcgaactccgaatcagaatgggagtcgaattgattcgcgaggatataaggcgcgcgcgcgtggatgacgcagcccatcaattcgacgtgcgattccagcgcgcgctctcgtctccggttaattgcttcgatcgcttcgcgtcgcggcacgtacaactatctccctcttcgtgacatttcgagcagctagccatggcggcagcggttctcccttcgctgctcccgacgccgcccgcgagcaagttgccggcgctgctcccgaccccgctgaggagccagatgctgccgctgctcccgacgccgtgcctcatcatcctccccgcctccttccgcgcgccgccggtctccgatcccaagcccggccgcgccgacgccgtcgagaggtgggacgcgcgcaagaaagccggcggttcggcagcgtcgtcgtcgtcgtctagctccggcagcgcgatcccctgccgcgccgacgcttgcgaacgctgggacgcgcacaagaacaagaaagccggcggctcggcagcctcgtcgtcgacgtcgtcgagagccagcggcggtagccccgggcgcgccgactcctgcgaacgctgggacgcgcacaagacacccggcagccctgcgtcgtcgaccggcagcaacgggagcgcctgccgctccgactccgtcgagcgctgggacagcagcaagcggccgctgagccgcgcgtcgtcggccgagcgctgggacatcaacaagaagcctcgcccagaggaagactacgctctctgcagcgggaagagcaactccacaagccgcacgatgaagacgacgacgagtgcgcagatgatcagcaagcctcacacggagacagtggtgaagccgccgccggcgctgctgccgttcgctggtcctgccgcctacttctctgctccggacccgagcatgcttcccgtgcccaccttcttgttggctcgctgtcgctagagtgtgcttgctgtcgcagagaatgctctgcttgagtccgacatatgtgtgttcaggttgtagaggttggcatggttgtttgtattgtgccccaggcgcatgcttcgtgcctggttagctagaacgattttgacgatgaggctgtccttgtatgatttgtaacttccagttatattgaactattgatttgatccttctctacttagtgaatacatggaacgtgatgacgtcttcaattaaatggattgtctactagctaaaggtgtcacctgggccaacagcccaaatttactaacattcatgcttaagagttaagagaacactatttctagttcttctcttcttcctcctccctaactcctatatcataaaatcgattattttgtaagtttgtgtgtgtgtgtgtgttttttttttgttctttttgtaaacggtgttcttgggtaggtgctaatggtgggctgtggaatccggcaaagctcggcccagtatcgtgtgggcactaggccttgggctgtgatccgcgattggcgccagggcggccattttaggttagaataagtttactttgggttcctttatttgttgcccagtccgattttcgtcccttaatcacaaaaccgggtacgacggatcccccaacttacgaaaccgtttaaataaggtccctcgtcagtatttgactccggttttggctgaggtggcgccgacgtggcttcttttgactagatttttgtccaacgtgttattgacatggcgctgatgtggcaattaaatccgaaaaaacttgtgggggcccacatgtcagttgcacacacaaattaataaaaaaaggtgggcccatgtggacccaaacgtcatcctcacaacctcttctctctgtcccctctctctccctcttgtctctctcccgctcatgggcggcggagcgacgaggaggccggctggaacggcgcacggcggccgagcaacgaggaggccggctggagcgggcgacatcgtggcggcgctggggggcgggggtggacggaacgggtgccccggcgcatggcgtagaacacctcctgctcgaacgccgggtcgccgtcggcgaggagacggtggacgagcaccagcatcttgagcgtgacgcccaggcagcgcgacagcgacgcgacgcaggcgcaggagtggagcgtgagcgcaatcacctcccggacgtggtgctcatcggcggggaagccatggacggtgtgggagaggtcacgcttgacctcttgacacatggatactctcgtttaattatctcgttattacaaacatggttaattacaacttccaaataaagatcaaagcagacatattatgttaaacttgtgcctgcaaaagctgttttattcagttaggatagtactttcctttcatgcacgttatgtgttttagccttttaggctagctaatattattacttgtagtactagaacacatgcaggaaatcttagccgattgcatgctactgagctactcgatcgctcatggatcgattgagacgccagagctacaccttggtgtccgccttgccgctggtcgtcgagtcatcggtgctgccgccgtcggcgaccttgttgttcctcccctcggccatctccacgtcgtcgtcgccggcctgcttgctgcggttgctgcggcggcggcggcggcgaggaggaagacgaagatgtaggcggtgacggcggaggaggaagacgaagatgctggcggcagcggcagcggcggcggcgaggaggaagacgaagatgccggcggtggcggcgcgctgggggtggtgtcggtgtgggggatggtcccgtcgcctcgcctcgcctccttccccctgcgcacatgaagaagagaggacgatgaatatgagagagaagggagggggaagaagggaggagtagctgacatgtggggccaccattttaaaattattatttttagctgacatgtgggtcccatgttttttattattttttcgagatataattgccacgtaaacgtcacgccaatgccacgtgtgacgaatatctagtcaaacaagccacgtaggcgtcacatcagccaaaaccaccttcaaaactgctgagggatctcgtctgtacggttttcgtaagttgggggacgggtcatacccggttttgtggtcaagggacgaaaatcgtcctggtggcaaatagagggactcaaagtgaacttattccttttaggtttcggtcaatgctgtcatgttggcccgatctgtcaaaacgggccagcatcactgcgcagtgcgcacccccccttggtatttggttgctaacttaacctcacagcagattgtagtacacgttagatagcaaaagaacaagtgttcgtagtcaattagtcagtatcgggtaatttaccaacgcaaccaattcagttagaaaaatgatgtaacgtcgagctggatggaataagaataataatcacgaaagctactggtaaccgcgggactcttgtccgagctaattaagcttgatttggacagcaagagggataatattaagggactagctatatttatgacaccatattttttatcaaaaaatattcggtatgtatttacattgtaaatctctaaattacatatgtaattttagtatatttacaatgtaagtcctaaaattacatataattacatatgtaagtcttaaaattacatatgtaaatctcaaaattacatatataagtgatttgtaagtggggtgtaactagtatgtaaatttgtataaatacataattacaacaacaaaattgactgctacaaacccatagcaattccggatcaacaaataaagtaaaaaaattacaaagggataaacaggtggagaaacggatgtgcatcgtgcacacgatgtccagcacagcgcattccagccgttaaaattcgactgtactcagccacaaaatatggagacactttttcagcaaatccgtaatattaatactatatatatattcctagcttcatagctctcacattttccaatctactggaatactcgaatgatgtttgccatcagtccattttgctctcaattatttgtggaagtagggggtgaagacgggtcggtaaacagccttaaattttcacggctataattttcttgaaaatgtaaacatagttgtgctttttctagaaaactataaagaaacaaaaatagttgtgctttttctagaaaactattccgacaaaaacattttaaaagtatactcccttcgttataaaatataagaatctagaatcaaatggaacatttactattactaggaatctgaacatgtaacatgtccagattcatagtattaggaaatgttttatctggtcatatgtttttatattatgggacagagagagtagaagaagtctctgatgaaaactcattactgaacattgtgctggtttgacgatattagcaggataaatgtccgtttattattgaaaacgagtatcataattattgtgttgttctttgaattaccggagagtaagttgccacaaaataacatgatgtggacctagggggagctagagtatttaggggatgcctaggaaccagtcctatatctgacatattttttatcatgtgtacatctctcccaatataaatttagacatctatattagtttaaatttaatataaaacatagtaaattaaacaagtggcatcctctccatctcgttttagctccgcatctaggcggacctacccattaggtagggtgggctagccagaccagctatgacccgtgttgcctgacacctggaattcgtttcaatatacagtactaagttgttacattagctattgcctggcccataagtaaccgatcaaatcaatgatacgtacttcaggtcagccattaagcaatcgatcgttgcttcttctgatttttttactatgtgttccaacttttcgagtgtttgtctttatttcttgtcgcttgacactcgtattacgctagtaattatactcgtccctagatctactattcggtataattgcaaatcctttaaccagtagaattacaattgtactctctccatccacatccacaaaagttacacatattacttttgtcaccaaaatcaaaaagaaattaaatcatcttggatgttataaatttaaagagtgaatgtaaccatgcaaccaataaatatttagatgactttttgggttctaatcaaacatttaatttatctcttcatctaagtcttgaatgcataaagattataaatagaaacaacttatttggaaaaacttaaatgtgaaatatgtgtaacttttgtggatggatggaatacaaaataaagcatcacggttcacaatcaacccatgaaaacgaaaataatatttcagttgcacacactcaaacgcgcaattgggccaaacatatacaaacgggcgaatacatcatcgtctcacaaccgattcacattcagacaagccacgaaaataaaagaaaaacgaagtaacctctaccgcgcgcgaaatctcactctagcatatacaatcaaacatacatacctatacgcgtcagtacacatatatagctatacgcgtcgccgcgacgtcgatcggccggcgtgcacacactcacgtactaaggagcaaccgagagctagcaagcgtctcgtcttaccaccgtgtcctgcttctgatcggtgacggtgacgccgccgccgccggccagctcgcggtacatcacggcgaccgctaggaagtaagtgatagacaggatcagcaggaggagcggcgtggtttccgcagccgcctgatcaggaagctcgtcgtcgtcgtggccggcgagaccggccgccgcagcccatatagcggcagtgaatgcgagggacatgagtggcacggccgttagcccaccggtggagctaagctaggcgcgcggatggtgatgactgacgatgagccactgtttagtcaaattgtgtgagagagggggcaaagggtagctacgcctgttgttacccgacacatgtggttatatatatgggcggtagagtcggtgctaatgttaccttccggttaaaaaatggtatgatgtaccgagtaccacctgcctcatcttttcgcttaatagtattaactccaaatcatctatagccaattcatataatagttgtttactatactattaatacctggtcccacatgtcatacacacattacatcttggagtccgtgctgcagctggctacagatctgtagcccgctgctcttctctctcttcctttatctctttaaaatatgtttatagctggcttatagcctgctattgtacctgctcttatgcttatacttatcagccaaaatttaaattttaaattttaaatttggagctaattttgaggttttttcatcgaagtttatttttcaacctttgcttttaaattactaagaacacgtgtataaaagttttattcataaattacttttcgtttgcaaatatgtcattttgcttattccgcaaaacgatgactccgcgagtgtgtggcaaaataacaattgcaatcaactttgtgctaaagtggagagatggacactcaagtgtgtgtctagagcaattttcccttaaaaaaaggttgattcttctggacgttaccatactatcataaaaatgttctaattgtcatttgccgtttgctttctagtttctgttgtcaagatgttagaggagagtttctacggtccatcatcaagtggtacctcaaggtactagtactgccaggtaccaaatgaaatcaagccattaagtcatcagggtcatgatcggtattccaaagaaggaaacgagttactagtgtgggcggggtggcgactgctagtcgattcgttcctatcctcccactcacgcgtgtcgcgtcagcgaacggcgacaccgatttcgttcagcggctgcggtggcgtagtgaccccgacgcggtggccttcgcacagggacgttgacgttgttcgccggtcagttgtggtggtgcggcaaccccggcccagatcttgcttgtagaaaagatacggtgagtaagaaaacaaaccctccctagagattttgcttgggaggaatgaaaaaagaggaagaaaagaaagagtgcgtaaaaaattgaaaacataaggctcgcatgaagtgtcttctgggttgtccctcgggactcatggtgacgatacaaattcagcagtttgtatcatcttcaatggccatctgcatcaggaggaagacggaccgattttttgggcccaacatcagaaaatggagctaggttggttgggtggcggcggcaagttgcaataagggaggcggagaggtgtccagctaacttggatcaaccggcgagcttggccgcgccgctgtgcagatgatgctccagggaggggatcgggaggagctggttgccggcggccgtacggactctactaaaacggatgcactatgtcaaaaatccaaatttgcccttccacctgttcaagtgcatgcagtaccgaggcttccaaattcttgtaccttgtggtaccgaggcttctgaaccgttggatcaggctcaacggatagccccaattgcaagtaccgggaggtacttaaaaaggatgatggacggtaacaaagctcgttagacaaacagtccgaagtgaccaataacaccataagagtaacgtatttggaaaagaaatttaagacagaaattaaatgtcccagttgatactgttcatggagagttgtcgccaatcgccataaaaattcagagtgtccactgctccatgcctccattgctgtctgtgaaataaaaagtgatacatttgattaaatcatgtaaagaagattcaagtagattttcattcatgatatatgaataggagagatgtattatagagagataatagattaatttaacgatttgtatggaaagagtaaattgcatcagcggtttatgaacttattagatgggtgcaatttaatgcataaacttataaaacgcttgttttggtatatgaacttatgtggtgcgtcactactaaggccaaaacgacacaaaaggctaattcttctaagttgaacatcataaattagtacatcatgtgcatgcacatatggtagaaaggctatatttgtaaacttggtttctattttatctttctttgtttctaccccttgcattattacttgtttttttatttcattctttatacaatcactatgcctttattgtatgttttgctaaacagatctttgtctacatgatatccttgaatccttctaagatacatgtttacatagcattcaaataaaaaaatcagcaagatcaaaccttgtcgtgtgattttggccttggttcgcacgcaccaaacaagtttgtgcattaaaacaagcgtttttcaagttcatgcgctagattgcacccacctaacaaattcgtttaccgctaatgcaatttacttgtttggaaatgtacggtttcagtggaactttcttccttaattatatatttaattatatatgccaacagtatataaattaagggtatttattttttatgaaaatgaatagatttttcgtagaaaatatcttcatcataatataatacaagatgtttatatataaaaaaaatcaagtattgattatttgggttggagaccgtgtgtatatttgttgtacatttggggtggagcctaaaaaactgactcttttttaaaaagaaattctttggttagcaccaattattaaatactactgtacctaatacacccatgatggtctaatttgtagtgacgcctaaaaaaattatcacatttatctaagataattctagtattatatagctgatgaagttgagtttgttgctgcaattttgcatggttgtctatttacatatttccgacatatgtgtgattcttttgaaaactttataagaaagttcaaaattttcaccctacatgtggtttcaccatatatttttctgattaacactgaatctgtgataaaattgactaatttggtgaaggtccgatcccatgcattcttgaaatgtggagaaccaaaatgcaaacattggaaattttgtgcaatatgttattcattgtgccatcctagctccctcctaaacacctcaaattctaagcatggaagatactccgggaagatagcaattagtaactcgactgaccagttgatcgtggttaacaaggtaagctagattatagctctttgttttcttcgcctaagttgcttgtaggcatggttgtgctttgcagtatagtgacattataatactccaacgtagcgacaacaaatagatccaaatttcgtgctgaaggatatgaagaattagtaggttgtagctatctcttaaaaagttttatgtatctccaacatttggagccagttgcgagccactgtgtcctaagaaactgtaagaagaagtgaagtaggatattactgacattgtattggtttaataatttaccatcaactttgccttctttataatatgccattgatcaagtttattaattgtttctacaatgtatcgtctgattggatactttctcaaacatggccaaaatgcactatagaagattgtagattgattaatcccgttagaagttttttaaaaatatgaattttttagccttcttgcatagaatttttagcatatgggttaagatttgttttcatgttttattttttaaagttatttgtgtgtgacatatgaacgaggaattgtttactcaaaagatagtaccatgcaaatattgcgtatagcacatgtatgatgatttacattaaaaaaaatgagcacaaagtattgtatgtagattataaaagataagttatagttgtaaaaatattgaaacttacaaacaaatacaaatccttatgttgtgcaaggaggccttaaaaatatcatttttttaagttcttgtaggataaattaattgttagccttctatatttctaaggatgttttaggtatattttgagaaagaatttggtcatgtgatacattacagaaatgattgatacactatcgtgacatattatataggaaaattttgctacaagacacgcaaaaaaacgtataattggcttcgggacatcgcaaaaacgtgacactgctcatggacactgcaaaagttgtgtaattggctgtaagatactagaaacattgttttatcatttttgggatgaaactggtgatattttttttgaaatgctcggattgcccaccgagtgtcgacggcttcgtagtcctccccggcgctggcgagattcacaacatgtgaagggacgtcggtcgtccacggtggcgaagctgcagaggaagagagacggcgggtgggtgcgcgtggggaggcggccgaggagcggcatgggtggagctgggcggaggatggcgagcttgatgtccccactacggaatccggcctcggcgaagacactgctgacaaggggtcatcgaggacggccataagggagttggagatgggggctcgtcgcccacagctcgtcggcgcacgcggcctctgggtgctctccctccgatccaaccgcctctctagctagcgcacgcgagagaatagctcgactggcaccgccgccaggccaccgtgcgtcggcgcctccccctgcgcttggtgccgctgcccggccaagctcctcctccactcggccacgccccgccacatcggcactaccgtcaaccgcccgccatcgatctggccagacgccacacctccaaggtggcgccatgccatcaaccgccctggccgccaatgtcgtcgcaactcgtcgtgctgacctcaccccaccgcgctctctgtggctgttgtgtcgttcccggcgaagtcaacgggaaggtgaaaagaaggaaagagaaggggcaatatgggcatttaaaaaatatctcacctcttttgacctggaaataataaaataatacgaccgatgtcctatggctaattatacttttttagtgtccatcagccgtattatattttcgcggtgtctctcagccaattacacgtttttttacgtgtcctgtggtaaattttgtctattatataacggggtaaaaccgatacaataaattatctcaatttataatactctgctcatgcatcgactcatccatacgtgtttcatacgtgtttctttatatcccgtcaatttttaagtaccacctacgtgtcagagaccagagatctacctcttctgaacgtaccacctactacaatttttaagattgtccttgtaagtcaagattgaagtcctttcatgccccgccaaaaaaattcctttcatgaatgccatgttatactccctccatcctcgtcttatttaaaaaaattatgcaaatataaaaataaaaagttgtgcttaaaataatttgaataataaagtaagtcaaaataataataataataatttcaaaattttttaaataagacgattggtcaaacagtgcaaacaaaaattcaaaatcccttatattatgagacggagggagtaaaaaacttgtgggttatgccagggccatgttataaaaactttttattattgattcacaatttgtgttcgacgataaccttttttcttggggaatagtaacattttagtgtgtatgagctgttggcgactaatttttacaggaaatttaattttcatcactaataagtttggcagttatccaaatgtccctttagatttgctctcttttttaccactctaaagagatggtttctacttttgcccacgtggcatgtgaatgtggcaactgagcgtgaacaatggtgtgggacccagtagttagataggtgaagagaggaggggaaggggtccacgtgggtcacacgctgactcaactgccacgtcaggtaaaaccaaggataaaaccgtctaacgacttagagtgatctggttttgtaagttaagagatgcatatatatatatatatctgtttttttcggtttatgaacgattttgtaactcggcggtaagatgagggacctccggtataccttttcccgtcaagttgaagctcggcccactgcttgcttcttggcggcccatatgcagaactaatggtttggtcgttgttcgtcaaatcaaaactactccaggtggcatggatttcgttgacaacaagagaaaacgacaaggcgcaccagctagctggagaccaccaaatctaatcatgcagtacgagcgccagtggtcaaccagagatgaaaagacacgagtcctcagatcgattgccttctctcgaagcttccgtaatccaaactgaagtgctctgcatggactcatctctgcatgcattccatcctacagatttacctacattggctcacacgccccaacatgatcgaatacgtcacactcgtgcgttcaatcgattggaagctagctagccgtgtttagtggatcgaatgatcgacgtacgattgatcgatcggtacgtacatgggttgatcagctcggtccggtctgccttacgtacgtgtcgctcggattgctgaggagagcgcgcccaaatctgcgggacaggccggattgctccactacgcgacgccctccgccggccgcggccacaacctcgcgacaccgacgcaaatcccactaaaaccttacgacacgacgagccgcgctagctaccgcacgcatgcgtaccaccacaaccgcgcgcgctccctataaatttcaccgctaaatcccaccacgaactcatcaatccatcaagccatcagttcatcacaccacacacagcagtacagcagaggagcactggtcaccggaggttgagacacctgcgtgtgcacggctagagtgtctgcgtttgcgcgatatggcttccgtgaaggccggcgtcgtgttgggcgtcgcggtggtcgcggcggccgttctcgcggctgagggccgcgctgcaaggaaggacctgggcgtcaacctcggcggtggcctcggagttggcggtggcggcggattgggcgtcggcaccggcggtggcctgggactcggctcggggattggagtgggcatcggtggtggtggtggtggtggtggtggcggcggctctggctccgggtcttactctggctcaggctccgggtcttactctggctcaggctcgggctccggttcagggtctgggtcaggttcgtggtctggctcaagctcgggttcgagctcgaggtcaggtggaggaggctcatcggccggctcgagcgctgagtcaggagccggctcgaacgcggggccaggtggtgcggggtcatacgccggctccagggctggctcgtatgctggctcgaatggtggagatggcggctccggcgcaggctcgtacgctggttccagtgcaggctcgtatgccggctccaacggcggaggcgcagggtcgtacgctggctcggaagccggctcgtacgcgggctccggtgctggcccgcatggaggctctggtgccggctccggctcgtatgcagggtccagagccggctcatacgcgggcagtggccatggcaagtaagctcgtcacgacccgcgtgaagcttaccaaagattatattgttgtgtgttcctagcttgtgtagtttgtgttctatgtgttcagatcaccttattcatgtatgcataaataagtgtgtaggtgttgatgaatgactaattaataagcgctacgcgcttgcctatcgatgtacacatttatgtggatgaataattcataatagaattttatttttatgtatagaatttgtttatgcatatatatgaaattgtggatatggttgtatgatttttgaattatctgaagatgtacccctgtgagttgataactataccaagcaatcagtaacaatctactgaactacaaacatcatgcaaaataactaaaagaaaagtagtggttaatctgttggtcatgtcttctcagttgttaatcacattttattgggcatcattcaacaggggcagtacccctcctgaacatagagaacaacgaactaacttcaactaaaaattacaccaacggtgtaatttttctctcttttcatatgtgaattcagacgaacattacatccacaaggaaatgaaccgaggaaaaccaaaagacacatgtctttgcctcaaacgaactttgtgttgatgatttgctagcaccttcagcttgttgaattgtgacaccaagttgagcatatgcgacccgttgaagaaatactcgtcagttccccgttcgatgttctgtgtgatggtgatggtgttggggcgaggcggtcctcttgtgttcaactctgtctttacattctacttcctctatctcacattatatcacattataagatctatttttttacatggttttcaacgatataatttgattattaattatttaatattatgttatcaataactataaaattagtataatataaaatattttgaaatatatagtatgcataatacttagtataaatattgctagtgtaattgttagtcaaaatttaacgagtttgattttcatagaaacaggagtgctctataatttgagacagagaaaagtatttgctaacggtgacatactagtgttggcatctcgaacccaatatggcagagatagaagagaatgcagagagagggagatattgcggcgaaaaacttgcattacactctatgtattggaaaataggcaaagagttggaggcgaggaggtgtggcgtggcaatagaggagtcgggtgattcgaattttgagaagcccagtcgtgatcactgatggaagtgtaggtagtggaagtagtggcatgaggaaaataaaaaggtgtaagtcatggacggacaattaggagcattgtctaaagatacacagatacacatttgtctaggcgggcctctttatgaccatcttatgtgtaattttcacgtgcattaccttaagtggcacacctatgctattagacattaatgtgagttgttgcctaagacattttgcctgtggcacacctatgctattagacattaatgtgagttgttgcctaagacattttgcctgtgtaaatcattgtaggcgaaattaatgtacgttgttttcttttagcatcatattagtagtccaagcctccaaggtagggcctatgaaaattcttctttttttaagtagcgatcgtccaagatatggcaacttaaagcaggttcttttctcttaaaaataaagatgaaaattaagtttttttacgcaaaacgaggtggtattaacgtatgattggttgagttttaattattacaaacttgaaaaataaattaatatgacattttagagcaactttcatatagaaagttttcacacaaaacgcaccgtttagcagtttgaaaaacgtgccacgaaaattttaatcttcatccaactcttgttagaaaaaagaacatggcttactctggtaggactaccaggtgaaaaccttatcttggtcctccttgagacctcaatagacggcgacggtggtgctcatcatcgttcatctcgctggagacatcatctaggtcccttgccaaaacttccctctggcagctgatgcaagctctttctagttgttttatcctcttgcaactgtgtcctagcttatgcaagttggccacgttgacgggccatagggggagagcggatccattttttttctctcaccctctcctcctcaatttcaaaggcgtggctagagttgagttcagtctagggattggttttgagccgtcctggctataccttcctttattggtctagcggtgaccgatcacgtttagtgatggtcgatcaggtgctagccttctctttgactttgtgtaggtgctctcgatgtgtggtggtggtattttttcctggtattactgccttctaaggtactgaccttgcaattttttaatacactattcaatgaatcatcgtgccctcatcttgttctgattgttttaaaaaaaaagaatttttggagaaaatctacatgtatgtttttttttcatttgtccaatttaaagtattaatttgctctaacttaaagttactcggttcgatgaatactagttaacgagaatatgtatgtatgtatgtataccgatgctggttgcccgcatgaaagtcagcaagtggcatgtctgtatgtataccgatgctggttgatgcaaggttacttctaagcaacacggtagccagaccaaacactgcaacccatatatgttcattttggttcatctcgatcagcacctgaaaccctgtcggtttcagggaggaaccagtgacaaattcgatcagtgcacacagccatacacccggtacgacacaacttctagtgaaaccgcacctttaatcttgtcaccttatgcatgagcaccagtcgcgctctcgctagctcgctttagccgatcagcccggtcgccgtgcaccggtcgcggctgccattggcacgcaggagcagccgcgaagcagggctagcgcggccgacacgatcgaacaactcagaccccgcgaacactccatgcgacacgcgcggttgcggaacatatcatgacaagctcgcgttcgcgcgcctctcgatcgaacacgcatcattctactactacacgtccattccatccggccatgattccccttctcgccgcggccagccggcagggccctgctccacacgccggtgtcccagcggatcgcacggcttttggcccgagagaatgcaagggaagagaacgagagagggagtgagggacagagagacccccgaccggctggccggccggccggccaggaagacgagagccacggatcgagatagcggcagcagcagcagcagcagcggcagagaccagagtgcctcccctctgcatgcatgtcctactactgcatctgcatgcatgtctctttttctcttcactcatctttggggggttgcttttgcttctctttcccagcaaacgtttctctctcctttccccctcctctgtctttcttttgcttcttttttcactcttgtcatcttttgcatctttggctttgtcagagaggggtgtatgtgtagtactacgtgaaaaagagatcatcacgttcgcgtagcgtagtacaccatgtgtttcgcaaccggagaatgtatctggatcagcaatgcattttccatgtatgtgcgttctagtatgtgtgtgtgagtgcgctgcctgtactgatctagagtagactagtggtatactagcacattggcttatagtacaattgtacaactgcccggactcggagaggcagacaactcctacggccagtagcgcccagtgtacccgcttctgacctttgacctgacctgttgcttcacgcgactacggaccgtgtctcactggcatgtgggcccagcacttttcggggtcgacatgtcatttggtaatatgatttttttccttcccgttcttttttgaatgaacggcttttattcccttctttttttcatgagataccctgggccaggttcggcagctctgtatccctgacaaacgaatcaaaacgccactgattctgaattccattgctcccctcggcaacggaatctaattggctaactaatgaataagtacatgcatggaagttggaactatcattagtacttcacgttacaagtacagatgcgttggttagagataaaagtcaaatacaaattatagagatataatactagagataaaattctaaagataaaataaagtcctaaagataaaattttagagataaatatactcttgtattgtactgatctaatcagctacgagcatgtacatctactgatctactttaagaccaacgtcacctatcgatcatcgccaagtctacagcaagatcgggccagccgctgcatcgataacctgtacgactacgcgatcgtcttcgccgattctacgtcaccagtggtcttcatcaacttcctgccgccaactcgtccatatagatggacacctcacgtcatctgacagatacatcagcatggcgcttcttcgacgacatcgaccgcgtcctctacgacgacaacgaccgcatcaacgacgacgacatcgatcacgtcatttacgatgacaacgactgcatcaactcggtatcactattgtgatcactactacacggcacagaaggaccaagcaaaagtggtggcctcatcgccaacgacatcccctgacatatgcaagacgtccccaatgacatcctctgacatctacaaggtgcaagatgttaacaattgcagtttcgtcttcacaacaacgtaaaaaaattttcgccttcggctacatgcggctacacctagaaccatggctacttcatgatcggcaacatcgatgaacgtccacaacaaaaatcattgacggaaacttcagtcaaagcgtccatgtcatcgctatcgtccatgccactctagctatgattgcgggagggagaatagaggagagtcaagggacgaaacataaggggacgcaggtaccaggtggaggaccgtccatgagagatgcaatcgatgatggtgagtcaaagaagatgaagaaatagaaaatttcaaatccagtcgtaattgttcgcttcgcttccgttacgactgagggggaatgttagaagtacaaatatgttggttagagataagagccaaatacaaattatatagatagaatcctagagataaaatagagtcctagagatagaatcctagagataaatctacccttatttgtattatactccaagtctctatctcctttatactcctatatataccccatgagagggtcaatctaatagattacaaaataacataatacaacaattagatttttctacactttagaattttcatcaagtatgttcatatacatcgacttgatcacttttttttgtgccgtgtaatttgcctcaggatactatcatttagagcagatacaatagcagaatataagccaactataaacacacatcgagaagataaaagaagagagataagcagcgagctacaagtctgtagccagctgcagcacggactccaagacacaatatgtgtatgataggtgagaccatgtattaatagtgtagtatatgtttaaatcaagtttaatagtatagctcattagtagctccaattcatctacagtcaatctaatagccaattcatacaatagttgcttactatattattaatatatggtcccacctgtctacacacgctgcgtcttggagtctgctgcttttctctctcatattttatctcattaaaatatgtttatagtcggctaatagtctgctattatatctgctcttatagataactattgtatgaattggctattatattgactatagttgacttggagctagtagttgactatattattaaacttgctcttatcagacatactaactaattttcacccctcgtgttctcgtcaacggtcaaacaataatttgaaacccttcttatgtcctcagcaataagcaatttgaaacccaacatatggtgatgctagctcactatcctagtggtgacagagttgtctatgaaaatttaacataagacatcaaccttgatcctttatctctatctctcctcggttacctccaatacatttcggtctcgggaaaatgtagccacagtgaatgtggtcaaggagacaaccaatagcgaatgcataaccaaactttaggaggtgccaatgaaacgaagcaaactaatatatataattaagtggattaaatataagagaagtcaaacaaattcatgaatatattataagtatctattcagaaaactaaaagaactaattatgctacgatcattaagcttctcctataccttttttttcacgaacgcacaaaagaattgcacgtcaatatattagaagaatagagtttcgatacattctcctatacctagcaaatatgaacatgtctttataaaaaaaaggtatccactggtttgtacgggtagtacgggttgaaacccctcttgttcccctgatcaccccttagacaatagtgtttggttcgagcatgagagctttaatttggcactggagcggagctagaacgaaatggaagagggtgcctcttgcttaatttactctactttatatcaagtttaagctgatgggtgtgtctaaatttgtattaggggggtgcatatatggtgaaaatcggtagttataactttttttgactgggttcctaggcaccccctcccatactctatctccgtccctggcattgtgtacctatgatccatctatccctgttgtggcgctgctgcccatggtgacctcctgcttggtggtaacatctcttaaattctttcttggttcaatttttgaacttttttgttcaattctcttcgccttcgatcataaacaacattctctcttcacttaggaacccatgcattgaaagacacctaggggtctgtttggctcaactccagctctatctctctggaagctggagcttagccaaacagtttcagctccacctaaaataggagcggagctggatggagctctctcacaaaatgaactagagagtgctaggtttaggctcctccacagcttcactgcagaccaacctcctaaagctaaatttggaagttgtagctctgccaaacaaaccgctagacttcatcctcgctctctctctcccccggaggctcatccctaatgtaccgtgcgaatcaacacgttataatgaagtgttgaaaatactcatatccataacaatagcattattgcttatcgatttcacgggcctccttctcttgtatatccacaaaccctacaattctcccatataaaatgccaaagaagaaagataaaacaaaacaatgttcacctcagaagctcatacatacatactcactgcatcatgggccccctttggaagatcaaaacaaagcctcttctctccccctctcccctctcaccccaataggccaaaattgatcactgcaaagtgggccccacctgtcagcttccatggcatgatcatttcatcttcatccaaaagatgcccaatattgccatggcattcagtcacatcactccccgcccccggtctcctttccctcctccatcacacgagaaaaagcagagccactactccactcgctcgacggctgattgcctgcctgcctcccctcacccctgcttctccttctccctccttctcacttttcttcctctcgggcgcctctcctctccatcattcctcccactgctccgctcccccattccaatggcctccaacctcttcctcctcctcttcttcctcgtcgtctcctacgcgccgttcctcgccttctcctccgagcccctcaaccctgaaggtacgtgcccttgtctgacgtttcttggaaccgaagatggctgcggctgatgagaccgcatgttggttgtatttggcgcggcgaatgcgcgtgcagtggaggcgctgatcgccatcaggcaggggctggtcgacccgcacggcgtgctgaacaactgggacgaggactccgtcgacccctgcagctgggccatggtcacctgctccgcccacaacctcgtcatcggcctgtaagctcgctctctctctctctctctctctctctcagtcttcgtcgtcgtcgtctagcttttgcttgttttgagcaacttagcgagagaccggaaatggcagccgaccggctcgatcagctccactaatgcgtgcttgtgtacctcgtctcaggggagcgcccagccagggattgtcggggaccctgtccggcaggatcgccaacctcaccaatcttgaacaagtgtaagcaagagaaagaaacttttgttttcttgtttaattgcttctgttagagattccaatcgattcatctcgtgttcttgggagaaatggaggaggaagaagcagagcagagcatcaaatggtgatgatgacgtcgtttgtcttcgactttgttttcaggctgctgcagaacaacaacatcaccggccggctgccgccggagctgggcgcgctgccgaggctgcagacgctcgacctctccaacaaccgcttctccggccgcgtccccgacacgctcggccgcctctccaccctccgatacctgtcagtcacttctctccccccaacacattccattccattccatactttactactctacactaaagctaaaatagtttaagttcttcatggttgtctcacttgcgtgttaatcttgccgcaggaggctaaacaacaacagcttgtccggggcgttcccgtcgtcgctggccaagatcccacagctctccttcctgtacgctaattaatccaactctgtcaaatcgtctcaattctttttgtcttgcatagccgatgaacggatcgatgtgattgatcttggtatggtttggtgtgcatgcgattttgcagggacttgtcctacaacaacctcactggccctgttcctcacttccccacaagaacattcaagtatggactactcctccctagtaccactgctcgtgcattcgtcttcttattctattccagccgccactagctatagctctgttacaacttataaaatactatagaaatatcccttggatgttttcgaatctgatgccgtgtttttttttcctttttcaatcatgttatgcgtgcacgcatgcagcgtcgtgggcaatccaatgatatgcgggagcagcagcggcagccatgcggggaacgcgaacgcagcggagtgcgccaccgtggtcgccccggtcaccgtgccattcccgctggactccactccgagcagcagcagcagtgagtccaacctcctctcgtcttgtctttgcattcttgggatcgatcggtttgggggatcggagggagtttaatcgtgttcgtttgggcgtatgtgcatgcatgcgcggtgtacgtgtgcactgcaggggcggcagcggcagcggtggggaggtcaaagggtggaggaggcgccgcgcggttgccgatcggagtagggacaagccttggcgcctccgcgcttgtgctcctcgccgtctcctgctttctctggaggcgcaggcgccggcaccgctgcctcctctcgggcccctcctccgtcctcggcatcctcggtacgccacgtccccatcaacaccagtactaaaatgcacgatcgatcagttagttaatatgtgagtgtaattggtgatttcagagaaggggagagacgtggaggatgggggaggaggggaggtgatggcgaggctggggaacgtgaggcagttcgggctgagggagctgcacgcggcgacggacgggttcagcgcgaggaacatactggggaaaggagggttcggggacgtgtaccgggggaggctctccgacggcacggtcgtggcggtgaagcggctcaaggacccgaccgcgtccggggaggcgcagttccggacggaggtggagatgatcagcctcgccgtgcaccgccacctcctccgcctcgtcggcttctgcgccgcggcctccggcgagcgcctcctcgtctacccctacatgcccaacggcagcgtcgcctcccgccttcgaggtacgttacgtacgcttaacgtgacacacgcaacacagtggtagtgtcgatttcgtgggtgcgtggtgtgtgggtcccgcgtgcgcgttggggtgcacgcaggagtcatggggatggatcagtcgtagtccccgtccccctgtgtgtcagcgtggtcaggcgtggtcgcgcctccaccccgtcctgtactttgcctcctcccccacgggccccactcgccaggcgccaccgcactcacgttttgtccgcttcaccggcgtgcgcgtccttcctcgctgcgcggcgcaacaacggcgtgcggctggttcaccggccgccgcggctgtagcagtaaattgggcaaacatgatgacgagtggtcatcaggggctcagggttgaggtctgggtgtaacgcgatcattgcgatggtttttatacagtactacctccgtcccaaaataagtgtagccataagtttctgtacccaactttgattatccgttttatttgaaatttttttataattagtatttttgttgttatgagatgataaaacatgaatagtactttattcatggcttatgtttttaattttttcaaaaagtttttaaataagacgaacggttaaagttagacgcggaaaaccataattgtacttattttggaacagagggagtaacagtaggagtagtgctgccacggtgcttggggtttttggagatcggtgtggtggtccgggtgggagggggccaccggtcaggggagttgcagggaaacgtttgtttcttcttttattccggcagggggccggcctcctcctctccctagccgcagctgttgcaggggaggcagccagcggcagcacaggctatacgtgccccagctacgctacgagcccgtgtgtctggtcgctgttgccggcttgttgctgcgtgctcgcatgtgccaacaagtttgtggcatactgtacacgtcgttatttcagtagtacgtacgttggccgcgttcgtggtttttgttcacgatgcagggggacgtacgggttctgtataccctacgtaccttgctggttcaaacatagcaactgtatgcagcatttatactcacaagcaattggcgttttgttgtcttgtgctgcgcattgagaactgaaattgtttggagcaaattttgttgaaacatttgttacgcaaaaaatttatgaagggaagccgccgctggactggcagacgaggaagcggatcgcggtggggacggcgaggggattgctgtacctgcacgagcagtgcgacccaaagatcatccaccgcgacgtgaaggccgcgaacgtgctgctggacgagtgccacgaggccgtcgtcggcgacttcgggctcgccaagctgctcgaccacggcgactcccacgtcaccacggcggtgcgcggcacggtggggcacatcgcgccggagtacctctccacggggcagtcgtcggagaagaccgacgtgttcggcttcggcatcctgctgctcgagctcgtcaccggccagcgcgcgctcgaggtcggcaagggctccggcgtcatccagcaccagaagggcgtcatgctcgattgggtaagcatgcacttccacatttcttctccaattttcagctttttttagctgctgtttgagccgtgatcgaaaagatgttgcactagttcttgtttgacgaattaaaagcctcggttgctttgatcgagcccgtacgtgaatgtctttggtaaagttcgcaaatcttttgcgaaagatccatccagtacactagcatgtgcgttcattgcgcgcgcggtcactggctcactgcactttgaggcgctgctcattcaatagcaacttctagtgaatctgatgctcgaatgacagtagtcagtaggcgccccaactgtcagtctaagattaattgcgagtactatgaacctgacatactaacgcaatcctgcaagcattgccactgcatgtttgaatgctgatcgtcctcccacgtactgttcactctgcatatggcatgcaaatgacttgcttctgaaaaatgacaatgtcttcaactacttaatctccatgtgtaaatgatctgaaaattttcttcttttttgttttcgttcgatcgtgttatcaaaatgaaggtgaggaaggtgcaccaagagaagctgcatgacttgctagtggaccaagatttggggcctcactacgacaggatagaggtggcggagatggtgcaggtggcgctgctctgcacccagttccagccgtctcaccggccgaggatgtcggaggtggtccggatgctggagggagacgggctcgccgagaaatgggaggccaaccaccggccggcggcgatggcggcggcggcggcgccccatgagctcggctacgaccaccgcaacgactccaacggctccgtcttcttcaacgacttccacgacaacgacagcagccttagcagcgacgaggtgcggtccatcgacatggtagaggagatggagctgtcagggccaaggtagcagcagaatgcagcagagcattcagagcactgaaaaagaaattcagagaatcagatattcagggagagtacttcaggaaaaaaagagaagaaaaatatattacagagggaagggattggatttgttgctagctggagtagtacgagtagtttcaaagtgattgagatgctttttagttttagaccacagtgtgtagtttctgtctgatcaaagagaggccctttccccgagaaagatgtaaagaaaaaggggctcctcctctccggtttctcttttgcttcttttcacaggcttctttatcttttgctgctgctgctttcttttctctctttcttttgttgatttggggacggacatggcacatgcagcgctgcagaagacctttggtttgcattctggccctgatctcgagcaaacttttgcagtacacccctgttcatatatgtatgggcttcttctgaattctgaactccttatctgtatcactgtatgtaaggggagggatgttgatagagccttgagagagacatggagtcattttgactgctttgtgacctgtaaagataatcactccatttctttttgtatgtgcaacagtaaatgatcgaatctgatagtgggaatgttggatgcattgttctcacgaaaatctagggtgcagcattgtcactttccttaatctgcaaaaggagtactatgctatgcatgcttggcagtgtcatggtcatggcccaggcgattgatttcttggggagccgtctgggccagtgggtcattcatgaggaatctgtatggtacaactgaactacggagtggcggagtgcccatctatgagctatgataatcaaaacgatgacacacaatgcttcagattgttttatggttgcaacttataattgatttcactgaggctttctttacaaactgtattaaaatatagctgttgatttattaaaagctgatctcccatcttcaataagaggtttcatgctaaaaaatgctggtatcgagcgcttcattgagcctcctgacatgaaagctagcttgtaggccaatttaggctcgacctgagcttctatccagctcaagcttgcttggttgatagccctaacttcagacatactaataacaaacacttgcaaaaacattcagtaaatagttactgcaaattctaatctcctccaatacttgtccttgctaggtataaaaacaccctccaactatctagagggaaatggagtatactcagaacaaattcagatgcatatggttttatagtgtagggtgctagacagacgttcactcaaagtttaggatatatggagtctaaagaatagtatatagcactgtatcaatatttacactatgcgtttgtcgtacttacatagtagtaaaatttgaacacatcaaagaatggtgtatagggtaccctattgtataacactattgcaagcctaaaccagaaggatgagtacgaacaaattgtctatgacacattgtaaagacaggaatagaatgtgcttcccaatcaatattcactatatgttgaatttactgccatttgccatggccttggaccttctatgtacctcctaacagcatacaacttaaatcaatctttaccactcacagacatattcccttggcagttttgagccccgcaaaaacattctatttcaggaccataatgttgctcgaatctacaaaacagaagccagaatactgtggtcatcaactgcatcatgcatatcctttttcaagcaaatagaggatctctttgtgattctgttcaacaccttttgaaccaaagtaatatgacaactgttttttttattttgtttatggaaaaatctctttgatggtcactaatgagtgtattaaatatatactcaaataagaaagtaattgtcatgaaaaattcctttggagtataaatatatactaagaaattactttcacacaaggggatgtacgacccaaataaaaaaaatcctatgaaagtaattttcatgacaaatgagcagacgattttcatatatgcaatccaaataaggaaaaaaaatgttgatactcaaaatttcgaattttggttgcattgcatttatgcccaaaagtgatattaataaccagagggagtagaaataatattctattctgatagtgtttttcaagagaaatatgcaaatatcatatgattctcatatttaccaatcaaaatattaaaataagatattgatactaagttttgaaaatctcggttgcgtgtatgtactccgtacaaaagatatatatatttgaggc

SEQ ID NO: 13747 - DNA, 566 bp, Oryza sativa
  unsure (1)..(566): unsure at all n locations
acaaactggtgctgtcccccggcgtggacatgcgctggggcgcgctggaagggtatgacgaagccgccgcacaactggcgccgcacgcctggaaggccggcacccagacgcagctgctgcgccagcagatggaagccatggaagacggtggcacctttgtgatggtgattccggccaaccccttccgctgcccgcccggcccctacgagcgcgcggccatggtggcccactacttcaagcagcacaagcccaagagcaagatcctactgctggacaacaaggacgccttctccaagcagggcctgttcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13748 - DNA, 10624 bp, Oryza sativa
  unsure (1)..(10624): unsure at all n locations
cagtttcaacctcatctcttcctgcaccatagcagaaatagcctcttccatagtgggcaatgtagcctggtagaacatagccgctcttctgtcctcaaactccttgttcagcccctttaagaaatgaatgactctttgcctctgcatctatttatttccaatcacaatgtcctcctcatgcttcaactgtagaggatcatagtgatcaagatctgcccataactgctacaactcactagcgtactcctggactgttctcccttcttgcttcaaattttctactttgttctgagcctcaaccatcatcattacatttccctctcctgaatacatgttgctcaatgtcttccacacaattgctgcattctgaatagtctctatcatcctactaatagaaggagccaccgaggtcatcaaccaagataccacggtggaatttgttgtattccacattctccatgcttggctctccttatcagaaggctcttcacaactctcttgcaaaaaatgatccaccccctttgctctcaacattaattgggctctcctacaccaactcaaataatttttgctccattccaacctcaactcatttggcatcaattctagtttcagttcgaatccccctgctacactcttcggacctatcatgcccatcttcaacaaattctctagcaaatctttcatatcacccttagtaaccaccgaggaggcatctacaacctcctttccaacccctgaagacatttcccctccccctttctaagcttccttagtcctcacctgctactgctctctgctcctgtaatttttcagcacacaagacactaccaacaacaagcaacagcaaccttctcctctcttttcccttctctccacagcagcagtccaccaaacaagcaatagcagcagcaaacagcagtcccttctctccacagcagcagcaaacagcaagcagtagcagccgcaaatagcaaacaacaagcaacagcagcagcaaacagcagccggtgcccttcttgtcgtcctccgtgccggcgcagcaaccagccgcggcggggtagcaacagcaagcaacagcggccagccggctcacctggtcgcagctccgccaccactcctgcgccgtcgcccccacgccacggccgcgcgaccggccgaccaccccggcacgccgctcagccgctgtcgccgtaggtcgcgccgccacctcgcgagtcccagcggtcgcctccacaccgtcttccacttcgtcctgctccggcacgagcgccgccgccggctagggttttgccgccgctggtcgccaggagctcggctctgataccatattgtctaattttgggggttttttcagggttactcccctgttcccacatctcctcctttctattctcttaacatttacaaatgggtcctaggaacatcacttatttacaccaacaggggatgttgcagttagtttctgcaagtgtttactgggtaatggatgaaataattcgtctcttgcccatctaaccagagttttcgaagctacaagagtgttaacatctgttctggagggattttaggactccgattattttgtcactaactgatgttgtatcttttgttggatatgatgctatgaattggcaactgttagtagccatgagaaagatcttatgctgctttaatacctttttgctcattttgtactgctcacatgggaactacaaagcatgaattggctttcactcagttggcttgttgaaagcatgatgatgtggtctttcttgatttcttttcatctgtttagcatactatttttaatatattttggcaatgctttattgagccaatctagtcaatctgaaaaaatgatgaactgaacaatctgcagaccttgctgcatgttattattggtgtatcatttcaatctttcatgtgacaacttagttacactttgaacaaataggttagctagataaatgcttgattcaatcaagacgatggagcaggtactcgacctccacttgtttagtcaatggaatcacccatttgtcatacagtttatacactaatgaaggatcaactttgaaacttgtttggctactgttgctgttgccagtttcaactggtccatccaatgtcacattttgaccgaacaccatggccttcttctgaacccttctcttcaccacatcttcctgggcttcagatgtcaacaatttcatcagggcatccgtgtcctgtgaaggacaaatttcacttggatgattcatctccaaaaaataattgtactgttgtacatgatcactccaacactgatcagcttgttacttattatgtaggagtaggtgaaatgataaaattaccttgttacgaattaaagttgtgtagttctgctggtcgcctatgaacttcacttctgccacatacctcccatagttgatccttcttgagagtgcctacaataagaatgaacctttccatgtaaatttaggatgaaatgtgaatatatgaattcaagatctgcagtgtagcatgtattgttacctgcagacatacaagatctgatgaaacagttgcagcatagttgccatcatcgccattcttggccaggagagggagcaactcattgaaatacatgctccatatggcatcattcacattaactaatgcggctgcagaatacagctcctacgatttatatgaaccatggtttcagtaagatcattttgagatttttttcagcattgttctagatgattttttttaaaagatatggaagctgaacgcttacggttgtgaagttatatggaggtgccaatgtgaaaggcactctgaaagggaagaaaggaatctcctgcaggctttggtaccttcctgcctgtagacaagtccaacagaaaatgtggattagtgatgctgaaataacgtttagttgatgtcttttgtcacaattcacgcatcatattggtaacgtgccgtttaatgttgacgtgtgctttttgaatccactgcaagatgcttattctttatctttgcttaaagtaaacatatcacatttatggcatggctactctagttcttcactccttcagatcagacatgcatgcatgatttgattaataaagcgtgtatatttattagaaaatcaacatttgtaacttttttcattaataatgaaactaacaatacaaatattttagtgctaatataagtggtactactgtattcatatttgaaaatatttttgtatgatgttaatttcagtagttgttaatgatgtataattatattataaaataaaataataatcaaagcaaaatgttggagaacaagccaaaaactaataagccttactactatattttagaatggagagagtaaaatgaaagagattattagttttattcaaacaattttgatgagagcatgaaacatttgactaggattttcatatgctcaactagtcaaaacacttagacagcaacaacttcaggccatcacctagataattaattaaattgtccaactccgattttcatacgctcaagtcaaaacatttagacaacaacttctggtcatcaacatctcgacaattaatctcccaaccgccagatgacatagcagaccgttgacatttgacaatgcaagcaaaacaaagagcataaaaaaagatacaaaaacgagatgaactcaaatactgcttcagagttcaggcattgcaagttcgaatcctaacaagaacacacaggagcaagaaagaagaggagcaagctagagtccagagttgagatatcaaaaacggccgcaccttggcctgaaccgcctcggactcgcgcacgaacatctcggcgaaagaggcgtcgtggccatggccgccgccggcgaggtagccggggtcgtaggccggcgtgttgcgcgggtgcttggcccgctcgatgaggccgaacacgacggtgtcctcctccctcgtgaggaactccctcaccgtgtccaggctcagcccgctgcacagtcgcagcagcagcagcgcaagcgtcgcgctgcagatgagcagatacctgcaggagagaatcatcgccgccgccattgctgcttgctgctcggaaagacagcgagagagagagagagagagacggagaaagaagaagaacaatgagatgattcagatgtgtgtgcgatatgtgtatatatatgtctcgtcaccggaaagaacgccgggagatggtcaaaaggaagagatgattagattagacagtgtgtgtgtgtgtgtgtgcacagcggctaactctggctggatcagtcaccatccaattaactccggttaattagcgttgaataaacaggtagcgtgagcagcttacgttgaagcttcagaaacggatgataagtcagaatatgattggctcagaggtcaaatactcaaatggatgtgaacaaatgtggagtctcagtatgcgagcagagatgatcatattacgatttacgtgcggctgcgtacatatcttatcatcccctgatgatgacctctgatacagttaatgatatctgacgattcagtttaggaattaggatcctcatcagcaggaaaggaaatgttaaacaatgcaatagcattgtggataacatgccaaaaaaattgatatggggtgacattccccgtcaccctcaacctgaaaactagagtaattaattagataaaaaaaagtatacctaatactactaggatataatctattccaatcaaagaaggaattaatgtcaggttccaaacttccagtgcaaaaacgcactgtgctccatgatttctttaaaaattaagtcatgttcctttatattgacttcatctaccaagaatctgaatgtcccccattgtctttgggattagggccttagttttccccatcagcggaattgagagtttgaggcccatctaggcgaggtgttattgggccatgccgcctctttctccgccatccagcccagagcccaaatattgatcgttgccagtgcctgggccgcctatcggcaattggcccatcagaagcctgcggcccggagcccgcacgagcacacgcagccgcatccggcccagcaaaaacactactctcgtaatattgtgggccgtggctcccaggtcgggaggtgagtgggccgtcgcgcgtgattctccgtcacggcccaatactgggccgaattcacaccattgttcggcccggcctgctcgtatggagagtttttttttataggtgaagtatttgagattgtgattagactctctccgtccttaaaaaaaattacctaaaaggaaatatgatccattcgagtgtaacaaatctgaatagcaaattatctagattcattatattagaatgtattatattcttatttagaaatatgatccattcgagtgtaacaaatctgaatagcaaattatcttgattcgttctattagaatgtattatattcttatttaggttgagttttttttaacagatggatacccttctggacccagactcaggctatggatctctaaggatggtggtggttgcacctcgccatcaagctttttgagtataggagacaggaagcagagcactaggggcatgcttgccactcagagagttgccgtatcaatcagatccatatcgccattttcttttccgtttttctcttaaagaatacatatcctcggtgatctgtggcactgtaacaatattataagtgttaggatatgttttactactagcaaataaatggatgggtacacatgggccatgcatggtgataccacgacgatacagtatgtcacagtatgttggtaggtgcaaactgttcagtagagcggctaatgaagctcctgtcctaaattggtctttgctgaatgttgatcttcttttacgtcgatgctgcttaatttccggagaaatcaattaatttgcctggaatgctcgtaggtaatggctttggaaaggcctagaatgttctaccctaccaccaaaccatcttttcaagaacgtgcaaggtcggtgcgagacaggcaccaaaaagttaaaaagtactcctaatgcccaaattaatccccactcatcgacattttcccacatacattggcggtccatatcgaatcaagattcagtcactatgccagtatgccactatggtcctagctaggtcctcggttcggttaaaggttccctccacgccgttgaaaaataatattagcactcagccctacatactccgccagtaagctcattacacacagcaaaaggaacttgaaaaaaaagtgatgaacaaaaagaaagaaagatagcaacgataagagtataccactttcgaattagtcgtcacagcaatcgttgaataacaaatagtactctttccgtccttaaatatttgatgccgttgacttttctaaatatatttgaccgttcgtcttattaaaaaaaaaagtaataattaattattttcctatcatttgatttattattaaatatacttttatgtatatatatagttttatatatttcacaaaagtttttgaataagacgaatagtcaaacatgtttaaaaaaatcaacgatgtcaaatatttaaagacggaggaagtattagcactcagccctacatactccgccagtaagctcattacacacagcaaaagaaacttgaaaaaaagtgatgaacaaaaggaaagaaattaagaaagaaagaaagcaaagcaaagataagagtatgccactttcgaattagtcgtcgcggcgttcgtggaatagcaaatagtaaaaggctggtgggatgcacatagatgggtattgggcagtgcaggatcggagtagcactttggcaaccatcttttgtgggctgcatccggcgccggtcatggccggtcgccttaccgacaacgagtagtctccggtgtccaagtgccaaaagtgccaaaagtgccaattatgctgcatatgctcccgttgtcctgtttgccctgtcggaaagcaatggcaccaacagatagtactactagtagtgcagaacatgatccggcagtgaagtggacacctaacatctccagtttactggaagcactcctagcaccacccagtatgcttcctccagccctaaaagaattcgtccaaattcgttattttagaatagggttatatcatattttagattgatttatttttggacgtagagagtacgtaggtagcaaggctgatttatcatcaattatcaggtgggaattgaatcttacaagtaatgataaggaaattaataacttggctgcaagggaaaaaattacttttttaaatattgatcagagtgcccaaaccacgttaatcccctgtacgtgtaagcgtgtgctaccaacggaacacgaggtgaatattccctgttatttccgtcacgcgggcggcatctcacaccggaggatttagcacccattggagatgggtccagcgggtgcacgatttattctcctgcatcgtgcgagaattttgtctgaattttcgacgtgtggagttgtttcagcatatcataactcatgcaggagtcactgtcggctctcgggattgattaatttaggggaaaagatgcatgccgaaaactttagtaaggagtatttcactacctgtccctcttctccaatcggatgagctggagtaacaagcgacgcatattgcagaccggtgtacacagtaaatctcacgtaatattccttaataataatttagtgcacatctcctttcgttgttgccgttgttgatgggagaaaaaggagggaaaacggaagcagaaatcctgatgagaattgacatacacgagtcccgtttttacaggcaagcaatgaacttaatttgcgttctaattcgtccttgtgctcttctagaaaaccccatttgcgagttaaccgcatgcagctaacaggtcttttactcaagtgctttatcacgttcgagctgtacgccagttttaggaagttaattaaccggctaaattcaccgaagcgactggaggtctgaaaactgaaactgccaaaacttgacaatctgagctctgaaccctgctagaatccaccaccaaacctgaagaatagtcgccaagctaggcaaattaaaagtagatactagcacgttttttccaccctcgcatgcaggaaaattcgccggtgaaggaactgcacaggaatgaacagtggcttgatcacgcccatgcagccgtagtactgtttctgtcccagtacagtaggtcagtagcttactgatgattaaacttatgattcttatgattatttgtcttaacaagtactactatagtatatactgtattgtgcacgcgtttgacgtttttgtaccgtgttgacagattccgatcgagagagaaagtactgtactgatgagatcatcatgaacataacataaaacatgagtgtctcgcttttcccctatggtgcccctctagctgtaccagacaactagctgaaaggatgaggtaaaaagtaaattaaccgagtcgtgtcgtatactggaccgagagtccgagaccgccgtgcaaattgacgctaatctcgccggtcggtcagtcgtcgctcgtgcagcccgccgcgctctctgtggtagtagtactccgtagagtagtaaaccggcgcaactagacggagtcacggccacgaccgtcaaaaccggcaacttcttggagaaatcgagcctcccaactaccacaccacaccacaccaggagtccgcggctgcggccatgcccctcgcgtgagtgggactgtgggagtggacgtcagctacaggagctccggaaaaaaaaatcgattctgcagtacttccaccctccctaaaaaagaccatagttttacattgtttagggactgtctagattatatttaaaataatcttaccaaattttagcatgatttttttatgtatttagcaaatttagcaacaaattaaatgtagatatttttttggcaactttaccttaaaaaatggtattatattcaatgtttgactgttccattttatttgaaaaaattgtatgcttagtatttttattgttatcagatgataaaacatgaatagtaatttacgtgtgacttttgttcttaaatatatttttataaattcatcaaataagagagacggttgaatgttggacacgagaatcacaaccacagtgaacccaaccgcgcgcatccggagcagctctcgctctccctctcaaccggcggggcctcacgtctcacaagatgcatttgacatatagtggtaagaagtgtgacgttttaatccgatatcccgtgtttaatttctaacatgtttataatttcttatattttttttgagggtcctcacgcgtctcatgatttgttggagagaggccagggaccaataggttgtacgcggcttttgcctttagagcaaggtcaatagtattagtatagtctgctgactagacttattgtacctgctcttagcagcttctttgtttacgcgcgcgcctcgcgggatgtagcttgctcggtcgccacgtacgggcgtatggtcgtatgggacaccaaagcaaaaacggccggatttccacaaactcgatcgccatgatgcaggcattgggcattggcccacgtccgcatggccgggagggtccggactccggagggagacagtcgatgatcgggcaaagcaccatctgtggcgtagaccaaccgccggccatgctgcttgcttaggtgggtgatcactagatctacatgtgcgttctgctcggctgctccagtgctgtgctctttgctttgcatgttccaggagaccggagccggacgccatgatagtatgatactactccctccgtttcataacgtaagactttctagcattgtccatattcatatagatgttaatgaatctagatatataatatatctagattcattaacatttatatcgatatgtgcaatgctagaaagtcttacattgtgaaacgaaggaagtatttgtctagtgtctagccccacgcctcctcacccaaccaaccagtactccctctatttcattttacaaaatatttatttttttcctagtcaaactttagtaagtttgatcatgtttataggaaatttaaaaacatctaaaatatgaaattatcattattaaatatttttataatacatttattttgtgttaaaaatattactatatttttctatacatttaatcaaacttaaagaagtttaaaaaaatcaaataacttataatatgaaacagagagagtacaatatatttctctttaggggagataactcatgtcattttaaccatatagacaaaaagtttctttttttatcgaaccggcaccacacatacagggagttgttgggctactaattacaagagtgatttaagttaccagtaggtacatattttttttagtcttgatatctgttagtttatactaaatattgtaaaatttatctacttataaattacatactccctccgttttttaatagatgacgccgnngactttttctcacatgtttgaccattcntcttattcaaaaaatttatacaaatgtataaaatataaatcacacttaaaggactatgagtgataaaaca

SEQ ID NO: 13749 - DNA, 13829 bp, Oryza sativa
  unsure (1)..(13829): unsure at all n locations
ttaaaaaacggaggtagtatttgagaaaatttcatctcatgccactaaattttgtcctaatctcttagttacctttcaagaaacttagtgcattgtgacacttggtcgaaaagttggatatcaccattccatgccacttctatatgagagagttattatgttggctgtgaaaatatgtttttacactctttgactcttttcttcaaaattcatttttcctctcttttctcgaccaggccgtggaccagtgtaattcttttgtttccctattcaccttgtttgcgcttcttgcttgcatttctcttttagtgtagctaccaatatggacctatggtttgccagtctattctagatcgatttcagatagttgcctccatcaacaatcatggaaagagagaaagaaggatcccaatgtataactaattaacccgattatccaccaacaaatcaaatgattttgactaaaccaatcaaatctgaacgaattaatttggaccgtcatgaatatcagaacaaaattagtagtccacttgtgcagagaccttggaaaattgatgcgtctttgaacccttgattaactgctccaggcggtccatgagaaacacttcaatttgttgctcgagcgcgtttgttgagtccagccgtaggggagtggagagctactatcattggtgtaagggctgtgcaaaggaagacatgaaaacgaagatggcaagtggatcgaccatcgtgagagctacgctcggttttgacaaaacttaaggtgtttcgaaggcttaaagactaaattgtcgaaaacggtcagacatcaggcttaattatttccgtaatcatattttttaattcaaaaacagaataaaaaccagtaaaactagaaatgaaaacggcataaaaatatcaaaagtagaaacagaactgtaaaaacaaaaacatatcggaaacataattgtacgaacagaaacatgtcggtaccgattagaaatcgataataaaggtcagaaataatcattggtggactagctttctccttatatatgcctttgtttggaacacatgagtttcacagaatcttagccagaaattacgtacgaagcaattgaagcattaattattttgttctaaatgggacctcaaatatttaggtgcttttctttgttgatgtttatctcttaacattggacactttcagactcaaaagattcgcgcttgagagaaatctaaacaaagaaatcaaatgaagaatcttcagcaatagaaccagcaacaactcttattacgtggagattgagtagatgatctgtgtagaagaaaactatagttttttaggaagcttaagaaaactgtgttttttttttaaaaaaaagtcatgcatacttgactagaagttttaaccgatgcacgattaaactatgcgactgaaatatttggccacccatacacacgctcacattcttttgtttatctctaattaattaacatgcgattctctattcttgctctagctctctgcatcgagtcagaagacaatgcctttttaattagcatgggcagttgagataagtacatggtgttaacaatatgggcttttcaggatttgtccaaataaaaaaagggcttccggtgacgtcatgctgatgtagtaatcgagctaccaattgttcacgtggagtttgtcgtcatatctttgatctagctagcacaactaccagcttctgacgagcaaactgagcatctctatcgattgatcgtgtacgtccttctctggatcgatcggctagctggtcccgattgaatcccgatcaatcatcaatcccaaatactaaatacatatatatgaacattgttttcactaaactaaatattgatagacaaaacattggcaccataattgctttgaacccgacctgtcacttgtccatcgtcgtcgaaaactatttaattaccttacttaattttacctctattttgatcttccaaggaataatctctaattgactttaattccactaattagtattctccggccttagctagctagctgaccggcaggtttagcattttagctatcttaagctgcagcaggtagtagcatatatatgccatccgtcacacgtaaatgggtgcgtaggctaacggctcagctcagccgtgatcccgcggacgtttccggcgtttcggcgcggcgcgtgagggcgagcccgagacgtacgacgttgagacggcccggcgtgtcgcgagcgtttacaagtaaaacccgtagtaaatactccatccgtttttttagtggataacattattaacgttttaatactattttcatctaaaataagtgctgtcatgagaatccgtgttcaatgtttaaccgtccatcttattttaaaaaaattactctctccatctatttttgatagtcatatttttaaatctgaaaattttatttttgataggcatatttcaatccaacaacctatcatcttaatgattttctcgaatttaatgcatgactcttcattcttccacacatgattggctacatgggctttgagaaatgtaaatattaatgaatcgcttgtttacgaggaatgactagtagcatgcttaaatgaatgataagtagaactacttatccttggtctgtgtatcaagatgaaatataactatcaaaagtagatggagggagtataaaaaaataaaaaaaagtcacacataaagaactattcatattttatcatctgctaacaataaaaatacaaatcataaaaaaaattaataagacgaacggtcaaacgttggatataaatagtgtaaaactgcacttattttgggaaggagggagtacatgtttaactattcgtcttatttaaaatatttatataaatttataaaatatacatcatggttaaaatattttgtatgataaaacaactcacaataaaataaattataattacgtaaattttttaaataaaaaagtaattagatgtgtgaaaaaaaacggaggtagtaataggcgttcgatcgagtcgtcgttacggcgtgcgtgacggcgcgcgcctcagctcacctaaccccgggtcgccgtcgcgggccacccggccacacgcggtgcgcgcgtccgatccatctcctctccgtttctctcagctactctcgcctgtacacacactcgcgggtagggagccggagcgagttggctttgttgtgttgagccctttcctgggcctataaattcggcatcacgcccaacgcatcccctccccagaagaatcccagctaccaaatcgaacctaccaactcattcccgatcgatcgatcttaaaaaaaaactaatcgtaacttttctctctctctcctatctttagaactagcaggtagcaactgcttcgagtgtagtctggtgaacgtacgatctttcgttcgttcatcaagatgaccgtgatcgacggcgccgtcgctgccgacgccggcggcgcagccgcggcggtggtgcagccggggaacgggcagaccgtgtgcgtgaccggcgcggccgggtacatcgcgtcgtggctcgtgaagctgctgcttgagaagggctacactgtcaagggcaccgtcaggaacccaggcatgcacacacacggacgccataagctactacagctcgttcgttttagctagaggcttatagttatatggtgtgtgttgcgttgcgtgtgcagatgacccgaagaacgcgcacctgaaggcgctcgacggcgccggcgagcggctggtgctctgcaaggccgacctcctcgactacgacgccatctgccgcgccgtcgccggctgccacggcgtcttccacaccgcctcccccgtcaccgacgaccccgtacgtccaaccacacaacctcacctcacctcgcctcgccgccggccgacacggcggcgacaccaccattattttctcggtttctcacgctgttcatcatgggcgcccatggcgtacgttaattagttgcgactgacacgagtagcgcattgcatgtgtctttttgcaggagcagatggtggagccggcggtgagggggacggagtacgtgataaacgcggcggcggaggccggcacggtgcggcgggtggtgttcacgtcgtcgatcggggcggtgaccatggaccccaaccgcgggcccgacgtcgtcgtcgacgagtcctgctggagcgaccttgactactgcaaggaaaccagggtaggtgcatctgcaaaatctaatctaatttcttgatgatctctctctgcccttaattgcacgtactaattaaccttggataccttttgcttcatcatgttattgttaccttttttgctttggttcttttcactgagaaaatggaaaaagaaaaaaaaaactttgtatggatatgaattattacatgccactacctagctagctagtactaccaaccatgactcaaaagaattattatgtctggcttttgagccaaccaagacaggtgctcatcgatcgattgcctgtgtcgacgtgagcactaaggttaaaagctgcttcttttttttctttttaactagcgacgttcaccggcaaaaggacatggtgagattaagtttgggtgttactcacgtaaagcatgtgaccaatccggatcgatatgataggaacacacgtaataacacgccatgtagcttagcgtgacacctcggagttttctctgccttacagtgaaggactaggaagtagtaacatgattagcttggacgtacgacttattttatccattacaatatatccacactatttttttatggaaacggcaattttaatatatttaattatattttatttagtttatatatattagtataacataagaatctattttggaaattttgggaatttaagatagtttgtagctcacgattgttgtggttaattagtaggtaaattactattaattagtggttaattatatggaattttcgaacatgcattcagcatcgaagcgtacagttgatccaacagacacacatgtgcgccgtagaggttacaataactagaagtccaacgcacccagccactggaattgaacgccggcacgtcatttattaccgatgagtcaacggtcaaccgttaattaatcagttgtagtagtagctgaacgcatgcatgcatggtcacgattttcaagaacccagtaattggcctctaatttgttagtttctggaaggaaaaaaggtttaccttgtggacagtttttggctttttgcatcgcaatccgtcgggaaaaattcaagtagtatttttttttatctataagaaaaactatttttaagagctactgtacttttttcttagaaagcagatcacagctgagtgatccggcaatatatactccctccattccaaaatgtttgacgctgttgacttttttaaacatgtttgaccgttcgtcttattcaaaaaatttaagtaattattaattctttttctatcatttaatttattgttaaatatatttttatgtatacatatagttttacacatttcataaaagtttttgaataagacgatcaaacatgtttaaaaaaatcaacggcgtcaaacacctttgagaaggagggagtatctttcaaagcaatatatgttaggcgtgaagaaattaatattgtacgacgccgaaggtaacacatctttcatgttttaatttagcatacaaatattaaaaacattggcatgtttcggcaggcaaaagaataacatatgtatatactggcctcgatcttcgcaattatggaaataaatcaaacacacgtgcatacgaaagcgaaacccaatttaatttcttgtgattttgtaatatgaaaccgaaacttgactcccaaacctaaaactgtaccgcgtcccgcataattttctcgtggatccccacagagtaattaattcttctctgaaagaaaaaaaacctagtaccgatttttcacgtcgtattccatcagcatgtcctaattaattcacctaatatttgtaatagctttgcaataaccttcgtcaaagtcaagatacaacaaccagaatctttcggaaatgttcctaaggatagagcgaccgtacatttgtaggggtaggtgtgcttccattgtggatatactgatccaatttttttagagacactcagaggtagagtttacgtgtattcatttgtagggatgagtacggactcgttgtgaacgcgtttgtattatgtttctttcttcttaagggtagcttaggtttcaggactttgcgcttcaacataagctacgaacaattatttgcaatacttaatcctgtaaagtaaaagaaaatgaaaaaaatatatgaaatgatggtgcagaactggtactgctacgggaaggcggtggcggagcaggcggcgtgggaggcggcgcggcggcgaggggtggagctggtggtggtgaacccggtgctggtgatcgggccgctgctgcagccgacggtgaacgccagcgtcgcccacatcctcaagtacctggacggctcggccagcaagttcgccaacgccgtccaggcctacgtcgacgtccgcgacgtcgccgccgcccacctcctcgtcttcgagtccccttccgccgccggccgcttcctctgcgccgagtctgtcctccaccgcgagggtgtcgtccgcatcctcgccaagctcttccccgagtaccctgtccccaccaggtaaaattaatttcatctttattactacattcgtttcaggttataatattttctaacattgcccacattcatatagatgctaatgaatctagtcacacatatatatctagattcattaacatatactccctccgtacttataaaggaactcgtttaggacaatgtttaagtcaaactttcggaatataaatcataaataactcttaagttgttgggtttaaaaatataaaaattatataaatagatttttcttgaaaaatactttcataaaagtatacatatatcaccttttaataaatatttttatagaaacaagaagtcaaagttgtgttttggagaccgtgtcgctgttctaaacgacttcctttacaagtatggagggagtatatgaatgtaggcaatactagaaaatcttataatataaaacagaggaagtacttcttaattaattacttctcctaatcacgtcatcactacattaccaccatcatgctaactactctcttcagtatcagcatttactatgtgctgttaactatagttgatcactcgttaatttaaccccgtattagggtatgtttgagggagcttctagctgctgctgtttctcttagaattagaaacttcttcaaacagtctagttttttgtctagattttgagaagctatagtttaagaatccagaaaatgaactagaagttagaagctagctactaaccagctgtttctcagaatcttaagctttccgaacatgcccttactcccttagtagagttgcgacttctcctaattaaacacgtcattagtactacacccccaccacatcatgcaaactacgtactggtattgtcttaattgtcggcattaacgtacgctgtgttgttaactatagttatagaagtagttggtgcgtctgtggtcacgagaaacagagtctaaattgattatgagtttcatgtttgcttaattagttcattatttgttctctaatctccagtgaaaggggtgtttagccattaactaatgactaattagatagcagctgctagtaattaatttggtgggattggtaggtaaggatggataagacttgcctaccaattgcagcatcagctcaggttcaggtgaaccaactccgtttcagtccggtctgacgctagctagcttgagtttttactcaaagtaaaacaccacactcaaattaaggcctcaaagtaattctaagcaagttcatcgcactaggttacatacacatatgaacaaacaacatcgtgatcatctacatgagatccagagatcgagagatttgtgttggtggcaaaagttgatcgattttccatgcaacttgtgccacacaaatacaaccaaaatctgcacacgtccatgtcgaccaaagttggtgtgagactgagagggttgagatatattcccctgtaagccacaaccaaaccctctgctaatcttctactctgtctctgtctccttcctctcgatcgcatcagcgatgatcgatggagatcagcatcatcgagatcaccatcacgatcgatcgggtagaaatgcgtagcatcaagagagcgtttgttttctgaaaattgagtgtggcggtgtcgcgttgcgatccaagttggtccgcatcgtacgtgtcagattgttcgtttgtttctgtggctctgcattttgtcgtcgctggcaaatcacacgtacggctgggtactactaataaccttttgagagtgtcatgtcatcgcctatgcacgcatgacttcagagtcctgaagtgttagtttttagtttgcatgttgcgatcgtacatcattttggaaatggttttagtgtccgccaactgctacaaggattagttgtctaatgaacgtcataagatggaaatgctgataattgttagtatttaaggcgttataactaaagagtacgtagatgatgcaaatgctaagtcctcatacaaaaatgcaaacctttcttgactttgggaattagctgcttgtgggaagaagtcctaccaatcctggacatttaggaaggggtaggtcggaatagtggaattttctaggaatttttcttggttcttttctcagagaattttttttccttaaaatgtttgtttatgaacagaaaaaaaattattgctttagttaagccctgccttagacgtctggtgagcagtgtctatgcagctcttgagtcctaatgggtctcacctaatcatatattgtttgttagccacacacaaagggttacttgggagaaagcatgacaatccctcttgcaatcatttgctctgacttctttctagtatctcgactcagctagtgatataatagtattaatcaaggagaaattacgtcatgcttgagtatgttaactccttttttctaaaacaagaggaagcttcactcagaaatacgcaaacaagaaataaatattgacatctaggagtacaaaatcaatcggaatagcctgatttcaatgcacaacctgacaagcaaccaaaacgcaggaatattcagctttgcttttgtcaaaacgtcgttacagcggggttggactaagagcacccaccccacttgctaatattacttttcaaccggtatatcccgtaaaaaccttgctgaatttggctcatatttattcaagatcctgaattgtccacatgattgtttcaaagataccatgcctgactacatgtacgtgaataaacagtctaactcgatgtcgtaatcttaccaaacctcttgtactaccttcaagggtcaccaatacgtagcatgatgtcaggtcaggaactcgggatgctttaattgggtccaaggagaccaaggaatctcaagctcttcacaagtcaagccaatcgtgtttacacctgaattaaatcccatatactcccttcattttttaataaatgacgccgttgactttttctcacatgtttgaccattgtcttattcaaaaaatttatgtaattataatttattttgttatgggttgttttatcactcatagtactttaagtgtgatttatatcttatacatttgcataaaatttttgaataagacgaatgatcaaacatgtgagaaaaagtcaacggcgtcatctattaaaaaacggaggtagtataatttttctagttaatcgaattcccccaatttgcgacctgccataggatttgttatgtaaataggtatacgttaatgttccttttcattatgaatcgtaattgtatggccaaccattacggatcacaagataatgtgagaaaaaagaaacaaaattttcgtgcattacctctgaactgttactgatcctgtgttgccatcaggtgctccgacgagaagaaccccaggaagcagccgtacaagatgtcgaaccagaagctccgggacctggggctggagttccggccggcgagccagtcgctgtacgagacggtgaagtgcctccaggagaagggccacctgccggtgctcgccgccgagaagacggaggaggaggccggcgaggtccagggcgggattgccatccgagcatgaggaaaacagcagagcaaaagagcaggaaaaatgtccatatcgtgttagtgtttaccgtgctgtaaaaccaaagtagtagtgttcgctggtttgtctggtctgaagccctgtaatacacccctgttgttgttacatgtgcaccagagtgaccgaataagtatttctatgaagttctctatgttcacaactgatttgtgcagaatttgctaccaagacagcaggttgtgaaaacccacacaccgatataatcgtgcagcaccgtttgcttaacaatagtagggtgcaaagcaaaactggaaatgaacgtacgaatctacgaacaaaatttggcgagagaaagctctagattacacagaatatacagcatatcgaataaacttaagaaattaaaccgtgtttgttagcactgacgtgcagaatattgagcaatattatttgccggtgcaagagcaacttcataaaaatctagactacagaatatacagcatatcgaataaacttacaaattaaacagtgtttgttagcactgacgtgcagaatattgagcaatattatttgccggtgcgacagcaacttcataaaaagacagtctgatgtccttatttgcccgtaccattaaaatcacaatacttacatgatcaccacaacttatataaaacactaaagcagtcattgactgtcacaaggtttcataactttcaaaatagttgtagaaaagaacaaagaatgcaacaaagagaatttaacaaagaggctggaactgttaaactaatgagttggtgggggcaaaagttagaagtagaaagcaaggaacacgtagtacaaaaatgcccctactaactccatggaattagaatctgcatcttgaatggatagaagcaattcaactctgattctaaatggagtggtgttccatcattatcaatagagatagcaacaaaccttaccaaccaaaaccaacacaaaacatgaaaacaacatagagtcctatccagataagacatcccagaattcactcacaatatatcagtataggggatataataaaatactcttgggggcgggtggggatggaagataagatttctcatccttttaatcatatacagttattctggccttatattaatcatgtacaattaattctggccttatatttggtgtagaagggcataaggaatgcaagacccaaagacattgtagtcccaaaaactaggcaaagaatcttattgctacaagcttggaatttgaaaaccagtgggtagtggcgattaccacatcaaacacagattctcaaatcaaattgttccccaaaactaggcaaataatattattgctacaagcttggaatttgaaaacctgtgggtagtggcgattaccacatcaaacacagattctcaaatcaaattgttccccaaaactaggcaaataatattattgctacaagcttggaatctgaaaacctgtgggtagtggcgattcccacatcaaacacagtttctcaaatcaaattgttcctatgtgtgtgaatttcacataaatacaaatacatgattacaactatcaagtgatatactttcaagaacccaatttacagaactataaacactattattatattcttatatacacataaacaaactaccagcccagtcataaccaacatctccatttccattgattatgaaagcatttcgagtctttgacaagcttctccctgaaaaggacatataaaccaaaagcatagcaataggtaggaagtccagcaagttggaacaaaaaaaaagttttgcaccaaaactggaactaatatccaattccaaacatgcaagtaatgacaaaacttgtgtgataaacaatctaaaatagccttcaacatgataaaagataaatctgaaatagtcttcatcatgacaccagaaataaaataggcttcccaataattaagaaccgagattcctactgtactaattagtaaagatatttgaccactcagcttaaatcagtagcttagcgatacaaaaatgtcttaaatatgtagttctatgaaataggttcgtaaatctgtagttcattggaagctatacgctttatgtgcagcttaacgcaatttacaattcatataccatatatacgttcatgtaaaacttgtccttcatatgagtaaaaacaagttcatcatttgaatgtaacattaaattttctgtttcactgaaccctcctttttggttattgcgtctccatattattacctttcacatctatcaagtatcaatacccttgacactacccttggcactaaatatcctagatgtgtaaggtgaatttggcatggtaaatgacatatcatttacatatcatttaccagaaagtacaaaggcactatgaatcaatgtataaacaaacacgtcattaccaaaataaggcatagcactcaggatcataaacgcattaccagaataaagcctagcaatgcagatccaagaattattagagaaacccaagcacataacataattattttcttttcagaacaccctaaagcaaaaggttaaatttgtgcccagtattgccataaatttatagtttagtatcaagcattaactgtgtagggagtaagcctgatatcacgaaacagtgtaaatgcttcatcctgtcatacaactcaacatgggatcttgctttcacttttctaatatctaaaagtggttctctatggatatgtcaaactgaaatacgatattcaatcatctgaaataacgattccctgcacacaaaaaaaactgaaataacaatattcaatcatatgttttttgtcaacccaatgaactacccccccccccccaaggtgcaagattcacagataacccaaaaaaaaaagcaagcagaattcatatgtttaggaccgaatgggatgttggacatggactaccagataggacacaagaatttacaggataagctataagaggttgcacagtcaaagcatgcaaaatcaaagtggtccatccctacttaaaaaaatctgcccataggacccaacaaaaatcacaggagccacctgatgttttgatgcattgaacagtttactaggtatagataaaatcacattgcatactttagcatttttcatttgttacaaaagcaattttgattctttaacaagcctctgccacaacaggacaatgaaacaaaagcctataaatacataggaaggaatttctaaaaactggatgtcataaccaattccaaacatgcaagcatgacaagtcgtgtgaacaaatatctaaaatagccttctggcaagacaaaagataaatctaaaacagcctttaccatgacagaaatagatttcccaataattaaaacccagaaattcctactatagtaattagtagaggtagtatttgactactcagtttaaatgagtagcttagtgacacaataatgtcttaaatatgtagttctatgaaataggttcacagatttgtagtccaatgnnnnnnnnnnnnnnnnnnnnnnnnnnnnnnnnnnnnnnnnnnnnnnnnnnnnnnnnnnnnnnnnnnnnnnn

SEQ ID NO: 13750 - DNA, 1248 bp, Oryza sativa
gaagggaaggtggataggtataaagcaagattagtcgcaaaaggctacagtcaaacatatggaattgactatgatgagacatttgcaccggtggcaaaaatgggtacagtgagaactttagtatcttgtgcagtgaactttgggtggcccctccatcagcttgatgtgaaaaatgcatttcttcatggtgatttatatgaggaggtctacatggagattcctccaggatttgggaatagccagacagttggaaaaatatgtaaactcaagaaatccttgtatgggttgaagcagtttccacgtgcgtggtttgaaagattcaggtgcgcagtgtgtgatatggggtattctcagtgtaatggagatcacacggtattctacaaacatagggggacatacatcaccatcttggctgtgtatgttgatgatatagtgatcaccggtgatgatgtagaagaaatcaggtgcctgaaggaatggacacctaaatgtagaaggatattgtgatgctgattgggcgagtagtatggatgatagaaggtctacatcaggttattgtgtgtttgttggtggtaatcttgtttcttggcgaagcaagaagcaggcaatggtggctcggtctaccgccgaagcagaatatagagctatggctttgagtttgagtgagatgctgtggatgaggagcttgttgactgaattgcgagtgttaagaagtgatactgtgatgcttcattgtgacaataaatcagccatcaacattggaaacaaccttgttcaacatgatcgcactaagcatgtggagattgataggttctttattaaggagaagattgatagtggggtacttatgctagagtatatcaagtcatgtgaacaactagctgattgtctaactaaggggttaggtcctagtgaaattcaatcaatatgtaacaagatgggtatgattgatatcttttacccatcttgagggggagtgttggtgtaaataagtgatgttcctaggacccatttgtaaatgttaagagaatataaaggaggagacgtgggaacaggggagtaaccctgaaaaaccccccaaaattagacaatatcccctctgccaactatatcttcaggtctgcaaccgcatctcagttgtatgcagtaatgcttatgcacggagcattaccacgtttgaactccttcctacgttctgttggtgccttctaccccggaagtgattctccaagtcagatgcacatgtgc

SEQ ID NO: 13751 - DNA, 8392 bp, Oryza sativa
gccttctaccccggaagtgattctccaagtcagatgcagatgtgcaattagccttgcaagtgctgcaactccatcttggcacaaacttttggttcttttcaacaaactgcgccacttcctttgcatacacctttgcttccatttccttgtcttctctcttcagggcttctaagttttcttggtgcctcctacctcttaggtgattttttaagtccagttcacttgaacaattggctttgcaaataccataattccatgttggtggataatgccgtgtgacagataaggactctgtttctactttcttcttcgtcccaatagcttcctttcttgattccaaagcattgttttcctcgttcctatggccagcagagtgctcctcgaaataaaattcattgtgtattcacttggattccatcacagctccttggcacacatatttttttgttgttcatctggaaagtatctgcaccccttttcctcttcactccagatgacacctttctacgcatcttggcctgtgttatgatgaaaaattattagaaaatagaaattacatggtcaatcttttttgagaaaaggcaagaataatattgtttctatccttgacataaaaatcatatctatgaacatattattgggcaccggtaaagctaccgaattcagtaatatgatctgcatagcttcaggttacatttcccttggagataaatttcccttatctagttatattgttttccattcaatttcaactgccaacaaaccaggcaacatatgtgatcgttgagactgatacgtgtagcttccttgtagagctgaacaacatgcaaacaaaaaaataggtcacacttcatcccatacatgaagtcaaattctttgaaagtttgaactcacctgcccttttgcatattgtatccatagtctacatattagaaacgtcccatctccaagaagcatcgattcactttaccatattatagttaaactaacaacatttgtaaactgcattgcttgcctctagcgaaggaattgtcaagaatgcatacaaaaatattaatattattgagattatggcctcaattttatgagaacttcaaaactagggtggtattaactatcaaatgtcaattataagaagtacaaaatcaatggtccattgaaattaggaataacaaggactaccactagtaatagagaccagaaggcaaattgcttcccagtacagatgattcacatgagacacttttttagtgaaagatgcacaaaacatatcaaatggcctgcttagtggctagtcatatttttgcactacaagctaaatcaaacatagttaagcatgcatggtcaactggattagaaaacaaaagaaattgagtaagaaacaactcaacgctaagacaagtgggtggctccgagaatacaactaatatttgggaggacacaaaccaagttttcagtttatgtgattcagtgatcactgaggaacaacatagactattataactagaacactacagtttataaagtggatgggggaacaatcttgaacatggaacattatctattcgtaacatatggataatcgattaaaagttttggaaaggggacaaaaagcaaaaaaaaaaacaagataatcacagacacatggctcaccgcattaaaagatgcattctcttcatctgctgtcctatcccatggaggtcgataccattcctcgatccgatctttcacaggcactctaaacatggatgctcctgcaggcattgccatcggtcctcctaaccaaagctcaccatgaggcgaagggaatgtgtcaccgcggaccggctggaagctgacggacaatcgcgagggcacatcacagagcaatccagtatcgcgctggaccttggcctccagttctctctgctcagcaatttcagcagcaatgacctcctgacgaatgccctcctcccagagctcccggcggagcgcgtccatcgtcacctgcactgaaactccccaaccccaccgctgtttagtttctgcgcatgagtaatttactcataatttcgcatgatcaatctatctctcagtcaatagcacatcatttactcaccttcttttattattatcgtcgtgttcttataatatttcgcaggaaataattttgatcttgccataaacaaattcctcaggaaattgaaaaaaaattactactggaggcagcatagaagaattgtaacgggggtgaagctctagattagcgaaaacaccaaattccccccttatttcagaggatacgaacccacattgttccttccacagaatgactgaatgagaacagcaggggaaagtagggccgtattaccgcgcggggacgggtggggaacgccgcagccgtcgtcggcgtcgaccggggcggtggctcggcgagcgaactccatggttggggtgggtggggttagggtttggttgtggtgggagagatgatgcgggaagcgggatggcttctccgctgctgatgaacgacgcgatggttcagcttctgggctggggaggcgtgcgctgcgcagaggtggtagacgagcttcgaagccttgggccctgtgcacggagtgaccgcgagccgttggatcagacaagaggtcatctttgtaccgtcggatgggggaagcccatccgtcgcacggaggcgccggatgaaagaacacggggtctgatcccctacgagcaagtttaaaatatcgtaaaatctataacgagaggcctctcgatctgctcttaagcagcgacgtctggcgcggtcatccaatttagtcgagaagcatcagagtttagaatttgagagaaacataagagtgttaggcatccatgtcttttttcccttcttataaaattttctctcaaattacttgtctaatctacaatctgagtacaccattatgtccgttgcaattaaatctttacaacaagatctcgcatgattatattatgatgaaaaattacaaattacttttataatatatctaaattactttttagacatataaaagtaaatttaataaattctaaaagtaatgaagtaacttgagacaaaaaggaagtaactttgtcgtcacattagaaattaatccgttgtagggataaaaacataattctatctagaaactaaattaatcagcacaaattaacgaattgactaaaaacaataataaaagtaatcacttcatagcattatgaatgtataggaagtaatttaatcaaatctaaaagtaatttatatatatgataaaagtaacttagtatataataaaagtaattttcaaacatttttttcatcataatataatcatgtaagatcatgttgtacagatttaattgcaacaaacacaacgatgtaatcggatcgtatatcaaataagtaatttaagagaaatttttatttgaaatttagatgggtaatgaggatgcaaatggcaggtactactacttttaggtgctactacttttagtaagggcatccacaatgtagaaataagaggggtctttaagcctccaaagaagtctatatacattgtggaagtggtctatatagaagacatttggatgagctatccttagctataaagaccggccacaaggattaaaaaattggtacatcctctccaattctggtacttgccgctatgagaagaaagaggaaggcgggaggagcaccttgcagccgctgccattgaagccatccgtgagcgtcgacgtggatctgctcacgcgagctccgccatccgcgaacacaccggggatcaacgggccgccgcggaaccgctcgcgtgtgcaagctgttgccgttgtcgaccgcgagcgccatcgccgcctccttttacgagcaccacccgcggccgtcggatccgttgtaacggtgccgtcggatacatctgatagttttttataggtcatagactgccctcacagatcaacacaagtcttttctgcacactttgtcctcactcgtgcgcacccgggaagaatttcccgatcagtagcacgcttaaccctggagttctttggaaatcggcttccggaaaagaagttgcaacttgttgatatgagtattctattaatcctattaagccatgggctgggatgtcacatctgtggtccaccgccaacgagcgccgccgtcgtggatccgctctcgcgagctgttgccgtcctcgtctgccgctgccataaatgccatcgccatgtctttcatcgatgggttgggggaaggtgtggggaaagtggccggaggaaggggttggttgggatggtaggtattttattaaaatgtggggtccaccataatgccttcttcctcccatatacattgtggagatgaaatatatttttgtgggacccacctagggcccaccataaggcctacttatgccatatacattgctcatgccctaagaagggtaacgagttgatacacactatattgtttttggtaaaaaggatagtcgttggttagcactaacgagtgcatgcgctctctgtagtcgcgtccttaaaatatagtcaatccgcaccctcttgggtaccaaaccatatagagaaggcactctgttattttttgtactcgcaccctctaaccatggatcgtcccaaaatagaacagccttgccatcaccaagctgccatcgcgttgaggccataagaaaatccttctctcgccgtgaaactggcatcggcaagccttgccaaggcttgtctggtgctgtgcgaagcgaccaaagccatcttgtacggagcacaacccctaagaggtcaaggttgaggatgccgaggcccccaagttgttttggagtgcaaaccttcgtccaggctaggcggcagtgacccccttttgcctccgccgctccctgccacaggaacccacgtcgcacctcgtctatccccttcagaacccacttcgtttttatcctgctgtttatgcatatcgaatttttaaaatgcacatatatgagggctcttctacaaaaagcaaaaaagaaaattcgcattttcgaagcggagaagtattgcatatgctaacgtcgcaagtacattggcatgtttggtagcgaaaaatggaaaaaattgacttgccccatctgaaaattttaagaatttcgtgggattttcacaagaaacaacttagatactagaagattagagaaaaaaaacacatatcctcttttctatttccccatttctctatttcctttccaatcggtttgttaacaagcaaaatactatacaatgagaataggtaaagagggcagctctcgtcatgactcatgagaggaacaccaaaactaggagtggaggcaatttgagtgcactgtacggcgaaaaaacatttacacttgaatcaagcatctcctatcttccctaaacacaataagacgtactccctccgtccaaaaaaaagccaacctagacacggatatgacattacataatacaacgaatttagacacgctcatatccaaagttgttgtactatgtaatgttacatctgtacctaggttgacttttttttgggacggaggaagtaaggaagtgggtcttaactcacttggcaaggaagtgagcctaattcactcggtgagaggtgttggcatacacccctaacacccaagttagaagtattcttaggttcaaagacacctgtttcttcttcaaattctttacgcactgtgagatgttaactgcagcctgcacagcatcgccgctatgcattgtccccaggggatgttactccaggattttgtatgtacgctccatttttacaccgtgcctgtacatattgaaagcatgactggtttcttcaacttggattatcaaagtcatcctaaaactccttccttcagttgcatcagatgagtacggaggctggactcctgtacctgaatcaacaccatgcaaagattgaattgatgttagtacattgcacagttaagtaaggcagatcatgttgtacaaatgaagtctggggtgtatgcaaggacaaagtatttctgcaaatggccagaactatggctactgatgcctactagaaattgtcagtttccaatcagataagaaccagatgttcatcccatcaaataaatccaaatcagacaaggcatgcaactcttgcaggacatgctacagggattgtggatatctatgctgccctctggctgtgtctgcagactgtttctggcaggttgaccaactaaagtggttggattaatgcagaaaacaagtcgagtaaccaacaactagttttccaaaggtgggtagctactgtggagaactaatggttaggagtgcaaatggctcggctcatgaaagctttgtgcaagggaagctcggtttggctcggctcgctacgagcaacgagctaaaactaaggctctgctcagctcgttaatgggctcaagcaggtctaggagaaatcaagcaacattttaacacatagaatgtgcaataaagtgataggtttcttcaatatgtcatcccaacacataaatagacaatatgacaatcaattttaccattttcaacaaataaatagctagaaaaggtacaaaattattgtatatgaccctattgtactgagccaaatgagcttgtgagcggctcgtgagccagcttaggcttggctcatttcaaaaatgagctaggaaggagcttgggcttggcttgtttggctttcgagccgagctatgcgagcatgaaccaagcttgagcctgagtttattgtccaccctactaatgggggttttaaagtggaatgttctttcgaaagttcagacagagattcataaatacctgtagttttgctgccgtagctaagagctctctacactcaccaagggcaaccttttcttgccttgccatgtctgaaagttcagaaaccaaagacgtcctaccttcaacctggtacacatatcctaattaatgttactaaaagcaacaaagacattgtatcctaataaattgcgggcaaattagagtatgtactaattttaaaagttttagtttatcaaacaatattctgaaaaaaaaaattgaatgttagaacctgagctgctcctctttttttgaaaaagaaaaatatatggtacgtttatatctaacctttgataggaggtacaaaattgaggaactcaaagcttgcataacatcaaccgctgagcttatagaattcttaactgcaacagcatctgcctgttaaataacggtattgtcagcataccagacaaaccaagataagagtattcgatcaaaaaaggaacaagataagtgtaactacaaatccaagatcatttgacattaagcaatgatggcttgatcacgtacctgtgctcctgatgtaactggaaggcgaagtgtgcatgcttgtaaagcttcaatagccccaatcaaagtactaccgttctctccttctagtttcggccaatgttgaagataagcaatctgaatcacaacaatatggcgagaagtaacccaccaaggattttttttagatataaaaaaattgaaatgggctaaacaccccaaatcaccaaataaccgtactttaatcaaaatctgaaatttttcaatgaattcaataaatttcgaaaaaaaaaatcagggggcacaattaccaaaaaaaatcactgaaagattaaaattgacagtacttcttccctgaatttgaaaaaatgtcagccaaatcagaagaagatttttccagagggacggtattacccaatcaccaactttttttttgttattttcagccccatatttaaaaaccacattttttttcaaattttgaatgacttcgaatcaaatttaaaggaagcatatttagaggaaaatttcaaccaagtacctgctcttttaaaacgtagtacagtttgagctcttgttgcaggagttgaacatcaattcttctgactgtaacagaatcccgcagctgcacgatacttttccacacactgtaaagaatactctgttttacatgggaggagagaaatactatattagttgaacattgcttgcccaatgaaaaaaataataataaagagaatgcacccactaagaaacaatggcttcatcaggcacaaacttgagcaaagcaattagagaacagacaggagcaaaaccaatatagcatacctctatgctactcttttggaaggttagtgtatcttctgaacgagcatttacaaactgccactgcaggcatctattatacagcagacgtaattggtgaatattctcaaactggcttgcactcttcttccctttcctcgcatcaactatatagttaaacacaagaggtgcaacgcctgattgacttgttgaacaacatcgtgatcggcaaggtgccgaaagccttgtc

SEQ ID NO: 13752 - DNA, 19687 bp, Oryza sativa
caatggctgattcagaccattggctttgacttcagctggacaaatcctccttggtgaaagcccccttgtagggtttgatggagtgactgacctgataggcgtgttggcaacaccattgcttctcgaagttaagacggcagagccacggccacccatcattgccgccggccatcggtgttgctcaacgaccctcttgtttggagtctctgatggccgagcattctcacattggttgccaatgttcctccctctaagaggacttcttttcctctcagtctcggtcacgtttcttgcctgcaccttggtctggtcagaagatgagccatcagcaagcttgtgtctcttcttggcagaggttgccattgccatggactccttctgaagcaatggaggcacgctacgagctgatgcccacaagccatcagggggctttgtactggctgcacgacgagagatgccatgtacctcggtggctgccgcaacacgcaccggcgtcctgggcctcgacgcagcgccgccaccaccaccggacggcgtcgagctggaagaaggcgtggaagacctcctcctctcagctgactgtgctctgtttgtcgatgctgtgccttcagctgctgaagccctgctcagacttggagacgtgcatcgcctcaccgaggaagcagcagcctgtggcgccggcgtgccgccggacttgaacctggaggccacctccctcctccgacctgccggagcagcaatgttcttctccggtggcaccagcggctgccgcaaggcgcagtcgacggtacctgcggccttcctcccctctgtcttcacggcatccatggagtcgagtagctgctccaagaaacgcccacattgatgtactggccagctatcaccaaagctacccaccactctcctcagcaggcaatatcaccagagagatctaccaaaagacgacgccaaccaccaggataaactgatacaaaaatccaaacatgcatgcgtgcattaaccttctgacacaataacacaaacaaacaaacatgaaggctctccgcctctcccctcccccaccaggccaccacgtcaaagaacggcaaatgcaggcaaccaaacagcatggacgattgcacattattcacaacgatggatgacgacaacctagtgtcacggccatttacatgcaaaggattgtccaatttgttgctactgcccacccggtccctctcgtcgtgtgggcgtaaagtgccccaaggaagaaaaggaaagctcccgtgtttgcttggttggggcctagtacaggattgcaacagtgcagtaactgcaaatctgcaaattaatccaacatggcctcttgatgtgaaatgcgaattgctgctgctacatggtactagttacatggatgagttcgaccaaggacgaggagagaattaggttcaccttttttttcccctgaagttgttggagccgacagggacacatgcgtccacgcaacatggatctttgtatctagattctagaaagtttattctactgctttcactacttgttttcttcatcggaaacaaacattatgggaatgggatcattcttcgaagagtaaattactctttaagagttaacacctcaccattccagaagaccagaactacaaacttgcaatgcatcgtaagatttttgtactgttcgatgcaggcaagaaaacaaaatccaaatctaccagatacctattcacatggcaccagccgatgcaacagtcacatttcactcactggaaaacatgagcagaatctccaaaattctccaaaccggcttcgcgatcaaatgtggcaagaaaacgagaaggaaataaatctagctcgatggcgtatataagacccaaattgaagggcctatccgtgctcacgatgtacagcgaatcggagcccaatcgcacggaaagggacgcttagcttcggcgcaaagggctcacccttttcaaagctcactgtacgtctggatcgcgacgacagcgcacgcacgcaggagcacgaacgcgaagcggctgggccaactcgaatcgtccactacccccacaaaaaaaaaaggcaaaattggttatatagcatcgaaagttcactttttagttttatagcaccgaaagttaccggttcactttaatagcatccaaagttcaccctgttcccatttttagcacttccgttaatttttccgtccgtctttatcattattgatccagccacacacatgatattatatttctacccctcattgacatgcattatacttgtacttgtgaggggtagaaacgtcatatcgtgtgtgtggctggatcaagacggacggaaaacgatcgagaattgacggaagtgttaaaaatagaaacatggtgaactttaggtgctattaaagtgaaccggtaactttcggtgctacaaaaccaaaaacgtaaactttcgatgctatataaccaattttgccaaaaaaaaaaatctccgtttcgaaacgtttcgaatagtaataaataaataatgaacggggttttcccgattactcggaactgtttcaaattgacgagagcgattgcggaatctttgaaacgagaaaaaaaaattgaaagccgtttggaatctcgaatgtggtgaagaatgctacaaacggaaacagatggaaacaaatttctccaatgcccccaaaaaatttcacgaatccctaaagcatttgggggtttaaggatgaggggattaggatttaggaaacgctgggagaatgcagcttcacgcacgaacccaatccgatcagaggaggcgaagcaacgaacaggacgcacgagcagtggagcagtatgctactaagctgcaagttgaactcacctcggctcgatcggggatcgcggcgcgaggagccccctccgttgccggaccggcgggtcgccgccgccgccgccgcctcgtcggcctcctcgccgcgcgcgagggatcggaggttagtggcggcgatgggatcccgagctgttgccgtgcggcgaactcctgcagattttctcgcgtgcagaggaaggaggtggcgtggtagagggaggaacgcgccgcacggttactactgagggtggtggtggggccgtggagaaaaagagaaatcgtattagggttgtgtttagataaatgcgtgtaaagttttagcgtgtcacggcgaatatgccggcatacatttgaagtattaaacatagactaataacaaaacaacttacagattccgtctgtaaattacgagacgaatttattaagcctaattaatccgtcattagcaaatatttactgtagcactatattatcagatcatggagcaattagacttaaaagattcgtctcgcaatttacacacaatctgtgtaattagtttttttcatatatttaatactccatgcacgtgttcaaacattcgatgtggcagggtgtaaaattttgcgagggatctaaacatgccctaagttcatgatggttttatcagggcttttttttgtttgtttttttaattttgagaaggatttttttttacccaacctctacattcaaccgaatatatgcagccatttaaattgaaaacttagccccgcaaacaactcaatacgaaatttgctcatatggaggtttaagctcaaggcccaatctgaaattctataggcagccattttaatcggaaacttagccccgcaaacaactcaatctgaaattcgttcatatggagatttgaactcaggacctaatctaaaattcacttctatggatatttgaactcataaccttgagccgctactcatgtcactgcaattactaggctacatgccctttttacctttggttttatatcggcatatcgcgaggacgaaatttaacgattttcaaacagagatgattcttttttttttcgagtgatgattctattgacctcactgaacttgtatcgtgtgagctaacgtgttcatgacagtgaactgtgaactctttttctatgtcctagctaaatactcgtgcattgcaataaagttttgtaaagagatctcatgatagtttcttaagttgtgttggttattatggattaggaactaaatctctacagaatacacataaaatgaagcggtggattaacacataattaattatacattagttaaaaaaaacttaaaaataaattaatatgtttttataataactttcctatagtatattttttaaaaaacttactgttttagaagtttgagaagtgtacacgcaataaacagagagtggaaattaggaaattagtacatgcaaactcaccctaagaccatttcttaggagtgtttcgagaggaggagaaagaactagatacgtaaaacgagatgagtcattagcgtatgattaattaaatatgaattattttaaacttaaagataaattaatatgttttttaaaacattctttataattttttaaaaaaatatacagtttaatagatcgggaaacatttgcatggacaacgagatgaatcatctctctttgtccctcgctcaaacgcagcctttctaatgacgaaataatatttgcattagtcgagtgttagagattaattttgacacgtttcataataaccatttctcatcgtctaataaagatgttatacttatatcaatcatattatttagtgattaacttgacatatggtccatcaattgtttgagatcttacatagcagtgtggtgagtaactgggagaatcactatcaccatcaccaacatttaaagagatgaatgtcttctacatccgagagaatgtcttcctcacccatactaaaagagaggtaaatgttcaccaaacattttgtttttaaaaaaagaaaaaaaaatctaccaatagcataggtacgtaccagtgtaccagcaccactgcattatggagagttgtttcttaacgtaacttagctaaggttgtgtttagttactaaaattgggaggaagtttggggaaagttggtaatttggaaaaaaaaagttgggagtttttgtgagtagaaaagttttggatgtgatgtgatgtaatgaaaagttgagagtttggggtagtttggtgtgaactaaacagggcctaaacttgggtgtgtttactttcatttactaactttttactttctccgttcttcatgtgcaaaatattttctgaactattaaatggtgtgtgttttttttaaaaaaaaatctatacgaaagctgcttagaaaatcatattaatctaattttttcatttttttaagttaatacttaattaattatgagtcaattgagccacctgttttatatgtacagggtaaaggtttccaacccctcctcccgaacacacccttaaccctactgctagcattgtaagggtctgtttggagaccttaagattttgagaagcagctggttagaagtcagcttctgagaatatggaaaagatgggtttccctacttctgacttctaatttattttctggattctacaactacagcttctcagaatttggaccaaaaactagactgattagggagcttttgattctgggagaagctgcagcagttagaagcttatccaaatatgccctaagtaggtactatttgcacaataagccatggaaaaataaagaaagcaatgggtaacaaagggtttttttatccgtgttattctaggtttaaaagcttcgtttcaaaattatgggcttataaaaaccaatgctggaaaataaataatagtcttaaaaattgaaatcaactttgaagttagaccctgttctgttctccaacaaaagttggattaaactttggatactcgtgacacgtttttcaaattgctaaacggtgcgtttcgtgcaaaaactttctatatgaaagttgttctaaaatatcatattaatctattttttaagtttgaaataattaaaattcaattaatcatatgttattacaacctcgttttacgtgaaacacttaatcttcatctttatctttatcttcagaacatttaaacaccataaattttacgatcaaattttgactatggagggtaccatgggagaggaaacatacggatcccacaattcgtacagtattgacttctcaagtcatctgcttctacagttccttgtaccaccaccttgttgttgtgtcctcggccgatcgagaccctcgagaattcgtttcagctctgatttcgcggcgtcatcgatgctgcattgctgcgtgctacagccacgcccttgcacatgccgccctggtcccgtcgtgtcccgtggactgtagcgacgacgtcccactcgatcgggcaaccgccacgaaagcccaccaacgctttggacggaggcgcatttacgtgccgcgtgagcgggcccgtcgtcctcccgtgcacatggcacgtgggccccgcgcgggtcgctcgctactacgcctacgtgaagttgctggtcgccgcagcgctggcttttggtgttggtggtctctggctgcaatgcgtacggtacatgggagggaggttgagctgcaatgcaaaggcacgtatggttgttttaggccatttctaatccaagacactagacatagtttaaataaacttcacattattaagaaactagtactagacaatatttttctaatgcaaacaccactattccacacttaaatttaatgctacttatcccacatgatgccttggatgttgtatagaaacagtgtctcatgcaagacatggtttccttctctttcctcatttattcacttgccacatcattttttatcttatgtgacagcttatttaatgctatagacaccatcatagtcattgggttgggaatagccttagttatggctgatttgatctgaagccctatcaaaatattgataatatccaaatctaaataagtccaaacactataagtagggtagatttttctattagttaggcaaaatttgatcttaatcaaaatactattaaagtactatttgaagctaccaaaaaattggtaagccacattacggtgctctttactagtagtataaagcaatttgaaccgttgatcttatttggccgaggggtttaaatctgtttgtaccaccaccccatttagtgatagtagagatgtggaggaacattattgtcaaaaaaaaaatatacgggtgacagtgactaaatccttttttttctcctttttggctttttcgattgaacgatgccagcggaatcgattaccacatattgatatagatatagacccataaaaacataaatgatagttacctctaatcactatattagtaaattactaatttacccttaataatgaatggttcagatcatttctactggtagtataatattaccagtagagagcaccggaacatcgctcatccaaacatgcccttagtttgtaagggggtgtttagatctaggggtgtaaagttttgacgtgtcacatcgggtattatatagggtgttgcattgggtgttcaggcactaataaaaaaaactaattacagaatccgtcagtaaaccacgagacgaatttattaagcctgataaatccatcattagcaaatgtttactatagcaccatattgtcaaatcatggaacaattaggcttaaaagattcgtctcgcaaattagtctcaatatgtgtaattagttattttttagcttatatttaatacttcatgtaggtgttcaaatgttcgatgtgatatggtaaaaaaaatttagagtgggatctaaacagggcttaagtaccttgatgtagatgtggaaaaaagctcgaagctcgtggtttggattggctcatggtgagctactgagctcgactctgattgactcaaacccatggtcttaatgagttgagccaagctagaaatttaactcttgagcttaatgaactagcttgtgagttgctcattactacaaaagatcaccacatcttcatatatacttagtgtttcttaactagcgagtagtgactagtccattagttacatcaaaactatttgtattttgtgaattcttcactagtgtttattattaagtttatatgttgtaaacaaataaattactaattataaaggtgatataaatacgttaacaagcttgacaagagccagctcatgattttttgctcactttttctctcacttctgtattcaatgcatttgctcttgtatgtgaaacatttcttgtttttcgttgtctctattctccacatgtgcttaaaataagtttaatagtatagccaatttctagctataaaattaacacgtcatctacaacaactctattagcctatccatacaatagtttatataaatatgcattacaccgttaatacttaacccaccttgcctacacacataatattgtagagcctgtgctacaactagctataaatctaaatacaactattcttctctctcctctcttattttagatgtgtttatagctaacttgtaacctgctattgttcttattatactcttatagttggcatagagccattaaacttgctctaaatccctctttcaaaaaacatttataattagcaacgacgaaaaacatttataactagcaacgatgcatggcacgtgtgtggtgacgtgcatgaataaataagtgtggcatgcatgtctggccatcttatcatatatgggcagaactgtttgcgagcttggatcgagcatcatagaactggtcatcagtatatgtgtagtgtcgggggtgccttagctagccggccattcattgtatcacgggcccccgtaagcatgtgccgcgtgacataatgacatggatgcaagaacacggtccaccggtcggtactgcacgtacgggagttgatcaacccctgtgcaagctataacaaaacaagcatggttgattgggtacgtaggcgcggccgcatgcgcgcgtattgacctcctcggccggctgcgtcgacgtcggcgcgtcgccatcgcgtccggtactccggtgtgcgcgcggccatgcatgcagcatgcacgtacggtcacgcgagcgaggtgacccgcgcgtgtgtgttagccaggggaggcctagctacgtacgtgtgtgttcatcgtgacgcgcacgcgcgctggaccacccggttaaattttgtccggtcgcctagcgagctagctagctatcggtagctcgctccgttgcacgcgggattaggtcagatccagtcattaaggagggagggcggtgggctatcaacttcaatttgtagttgcgcggtgttgctttccctccgttgttcgtaggcgatgatggtaggattagttttatttagcgcggtataattgaccacagccaccggtgactaaaacgattatacctccctccgtttgagattatgaaccgttttgactttgattaaagttaaactgtttcaaatttgataagtttgtttaaaaatgttttcaacacatgataaatatattcaacttgttgttttaataaaactaatttgatgttataaatattaatttatgtgtttataaacttagttaaacttaatcatataatttgaaacagagggagtagcttgtaagggtatttgattgcacactggtatacaaaactaaattatattattctacctttgtttccaaataaatgacgttgattagtgcaatttcgaactaaccggcgtcaaacaaaaacgaaacggagagagattatatatcaaggtgtgtatatcaagcacacactgaaaaaagactactaaaacgtctaattaatatagctgccagcaaaaaagagttgtaccaatcctgattctactgctaaatacctaattagcctgcctttattattcctaacaccactaaacagataacttctttctactgcagtaggccgacgtagtcgagatcgacggagccgagccacaacttgcggtccctctccacaacctcgctcagcgtcacagccctactagcagccgtcagctcctccacctcgacgccgtcgccgttgagccggacgccgaccaggtgcttggccggagaagccgccgccggcacgttgaacgtaatcttctcccggttgagccccacccagtagccccccttggcgtctcgccggacgttgtcggggtacccgggcaggtcggcgaagagctcgtactggccggccttggcccccttgagccaatacctgaacacctgtgccggccccgtgtgcgccaccacgaggtacctcccgtcgtggctgacggccacgccgttggcgtacggcaaccggtccttcagcaccgtcacctgcttcgtcttcgcgtcgtacttcatcagccgagccgtcgcgtcgcggttcctcatgatgttctcttggtatctgcatgcacacaactcatctcctgttaatgctgatgatcaacaacgcattgcatgcataatgcaaatttgaaagtaaattaatttggattgttctcgatctgtgtatacgtaccggcgtgtgatggtggtgctgctgtcggtgaagtagacgtcaccggtgtcctggtcgacgtcgacgccgttgaggtaattgaacggcacgccgtcggcctccgtggcgagcacgtcggcctggccaccccgcggcccaacccgcatcaggcccttgtaggcgtcggcgaagtagaggatccccgtcttgaggtggaacgcaagacccagcggacgcccgcatgtgctctccgtctcctcagatgacgacgcgcacgtagggttgctcctgcacggatatatacatgttagtctcgtcaaccaatctatacgtaagaaagtattttctacacctaggtctcatggcacctgggtatatacatgtaatttaaatagttatataaaaattttaaaaaatttgataagatatatagtacataataatatcacacaccatgcaaacatacaagtcaaaattctatacatgcacgtacgtaccggtaattccggttgtacgcgaaggtagtccagccggcggagtcgccgccccacttgaggacgcggccatcggagacgccggtgaaggggccacggttgctggagtcgaaggcgaggctctcggcgccggtgacgccttcggggaggcggacgtgggaggcgcgatttgtcggggttgtcttcacctgcgacgcggtggtgcacggtggggcttcgcagatcacgcgctgcgcggcgcacggcgaagctaggcagacaaggctgaggagcaggaaaaccgtcgagaaactagccatgacgacgaagcgatcgatctgaagaggctacgagaagaagaagcgactacttcgagggactaagttacacagatcgaggaggccatcgggacgctatttatttggagaagaggaagagacagcagccgacacgacatggcgaggagttggagacagagctcgacacgccagcggcggcgaggtttatctctggtttttgaagcggcggatgaagacgaggagacagagctcgacacgcctgcggcggcgaggtttatctctgtttttttttttttttttttttgaagctgtgcggatgaagaggaagaggagacagtgctcgacacgcctgcagcgacgaggtttatccctgtcttttgaaacatagcgaggatgaggagacatagctcgacacggtagcggcggcgaagtttatactgtttctcggatgagatcgtttgattcgaaaaagatcgtagacgacaagaccggatttggttgaggacgcggcgtcgtgggcactgcgaactcccggccggaggaggaagaacgagctgacagggtggtgagctgggctgggctttggcgcactcccgcgggccggattgctgggccaggccgggccggaagagagaaaagagaaacgggccatttttgcatctgtcctcgttcatcccccacactgccccacacatccatcgccggattcgcctccgcctctcccttcctctcgtcggcggcagcaagcggcggcggcggcggagctccggattcgaggggaccaagcatcgcctgcagaggaatccgcctgaagggtaagcacccctcagctcgacgcatcgcgctctgcctccctctcgatttcctcgtctgctctagccgacgtcgaatcgtgatccctagcatcgtgtgttgatgcggaatcgtggttgaacatccagattggacttcgattccgggaggatccccgcccggatccgaattttggccgaccgggatccccgtctcctccgccgagatggggagcacctcgtcgatgctgacgcagtacgacatcgaggaggtccaggaccactgcgaccacgcctgtgagtttgcgcgcttgtgtttctctctttcgattggattctgaactctcaacgaagattgatgctgtctgccgctgttcccctccgatctgacctgctgattcggggtgttttgggagctaagtctcgcagcaggagatcgtgtcgctgtaccaccggttctgccagctcgaccggaatgggggcggattcgtctccgccgaggaattcatgaccgtccccgagttcgccgtgaaccctctctctcaggttacaagacataactagcctgttcctcaataccttttcttattctgtattgagaacgagggattaggaaaggaatgaattgggtgattgggtagatgtttgaggaatgctatttgttaatcgatgcgatgtctctgtcagaggcttctgaggatgctcgatgggctgaactttaaggagttcgtggcgttcttatcggcgtttagtccccgcgcaagcctgcagcaaaaaattgaatgtgggttcccagttcgtacttaaattctccatttgctttctgtcccggatgtctagatgttctgagaaatatgctatgttttctctgtagttattttcagggtttatgacactgactgcaatgggaaggtggcatttgatgatatcttgagcatcttgcgggatctgtctggttcttttatgactgagcagcagaggcaggtttgtgcttaagatctttggtgccatatcatatgtgctaacatatccatgttcatttatgtccataaaagcttgtgtagttgcaagtaattgtaatttgttgattgctcatgttgttgcaactacaatgctgctaaaattggtacctcacatgttgctctgagctggtagtcaagtggtcaattggtcataactgttgatcgactctaaatgcggaggactactttttttttgttccatgatcacattctaggccttgctggctgggataatttttggaatcaatagcgaattctaccttcgagtcaatttaactaaagcgtaatagtaatgtatttttggtagagcactctacagaatattttttttccttgtaagtaggattccgtctggtccgtgcttctgccggaccagcataataggttaatatacatcttggtttacttcgtaataaaataacatcatttttttatggtaaagtatactgtagtccttttctgctatactgatgtatgccacttatgcatttcagaaagttttgatccatgttttagaagaagctggctatacaaaagattcaaattttactctgccagactttatgaaggtaagctccaatctactactttattcccttagatctctttaaccttaacagataaatattttctgcactagtatcaggagcatacacattatgcttggtgaatcagatagatgttctagaaggaaaatatcttgtctgtatttgacaggtttaattttgaataagctgatatcactaaattaaaatctagttgtcatcatctccttatttgttctaaatcgagcatcccattcacttggttttatggcatttagctttgaaatatctattttgacctatactttccataccatgttattttgttaaataatgtagcattagcatgtgatcattttttcattaagaaatgaatggttttgattattgcaatcagcagatcttcgtatttacttgattgtagctaaaaattttcaccttttgtactcacgaaacttgtttttgtttccagattcttgacaattctgatgtgaagatggaggttgaagttcctattgactaagtacttgtgtcattgttctgtgccccggcatgtatgtcagcttgagaagatggattaattagaccctactagtactttttttatcatgtattaagctgtaattagtgaaacatctgtatttgatcattttcaggcttaattaacttttaccacccgtgcatcctatgacctttcaggtactgttaccctgtaaggtccccttcattttttcctaacatcttttcatattgaaaacgtctgtgatattatggcttattaatcctttctagtaccttccattatgagtgaaaaaaatgttctttgttctctcgcatcgaggatatctgcaaattggagcaggaacaatttgggcttgcttggatcattgtcaatccatgccttaccaaaatattggcatgctaaattttttttggtggagtatgattggttggtttgttgccaagttgtttgagctcatggttctcttgccatttttttttgatccccagaggcccagttcaaatgcacgtctagcttctccagctactaatcttctgcatggcaagtttagaggcagtaatccaaaaacaagccctttatctcgtcgtacaatgggcaatgcaacaatattcatttctctaggtcaatatggctaaccaaaggtggcgacgttagcttaaatgttaacttgctagactgaaataacatgccagtatgatcagcactactccatccgtttcataatataagtcattttagcatttctcacattgaaatgctagaatgacttacattgtgaaacggaggaagtaccaaaaagtcactgaggtacaaaaccatgttggtctaacgtgtttccgacaggacatgctgctctggctttttatctgccatcctcatgtttgttggtattccaggcagactggtgaagagtaaataggtttgctcagctcagatgactccaaattcacatcccaaaaataaggaacaccttcctgtctttctccctctaaagttgaggtcatcaatgttttctcctattaatagacgctaagctgattacctgcacttctccctagcagggaggaaggaatggcagaaccattggagaattggatctttggctcatcgttggggggtttcaaatatcggtgagtttgtctgggcttcatgtactccaacttgtcgttgcttattcaaaatttgttttctatatccaattgttaatccagtcatgtcaaattttgtgctcaactagtggagtaataaattatcaccacaacatccctcaacacctctgggaatcgaatgcatgatctattgtattaaccctgacagcaaaatcataacagaattcttagtcaatttgaactcttacattagtgcttcgttatattttttcagcacggctgtcaattttagatactgaattccagtttttcaatttattgcaatacttttggcatctaattagcttttatttagtcaatgtgcattatgttatgagcatagaaacattaaccctccatagaaaacatatttcgttaatctgctatcttctcgacatcttcgtaccacctttgttttgtatattctttcctcttctttggcctttctaaatgcgcttgattgacgcttttcaaattattcatagctaccatgggctaatccatggaacagccaaatggtgctttttcttcaaaagcatattgtcttgcctagttttaatttggtcctccactctcaatatatatatatgatcctgttagtcaggaaatatgtggatcatgaggttatcatccttgccaacagttatttttatttaaatttttaacatgtaagattcaattttccacattttaaattgaatacgaatatatatatatacacgtaacatgctacgatgctattaatatcatctctttctcttattcttcatggcaggatcacacattttaggctaggggcataaatttaagcattataggatacatgatatgacttccgtagtgcgtacaatgtggatggaagttttaccctatgatagaaatattaacacatcctggattaagttttagtaggtgcaaaaactgaaactcatttgtgttatttatgatatcacatatacaattacataatcaccaaactactagaaaggaatcatatgtacggtaatattatttttatggtgcggaagaattgtgacagtattattataggttgagttgattttacacttcaaaatcaactccaattttttttcctttttcagcttcatccaatcgtcgcatgtcttcagagaataaagtgaagtttttttaaatattgcaggttcaatagatgaatttaatagattctaaggcaaatagtaaaccatatactaatcagagcctttgagaaagatggcagaaactgaagatactcagttacaaaaagcaatattcgcacagtacattatgatgaagaagttattcatggagttggaagaggagagagaagcttcagcaacttctgcaagtgcagccttgtcaatgattcgaaagcttcagaaggagaaggaggagcagaggatggaagcatggcagtacaagaggatagctgaggaaaagattagccacagtgacaaagcactggagattctacaggaagtccttcaacagaaggaactggagaatttttatctgagaaaccaattgctggtgtataaacacaagctattggatgttggtattgatgagtgtgatattgcagacgagacgataactaacaatataccattatttgaaagcaaaaccgtggagaatctttgtcgtagcatcaaaaggaatttctctctgccaactttgcagatgaagaaactttttgccgaaaaggacaccgacagaaatgttgaatcaacaaagagcagattaggtggctttgtttgtaatttgagtgaagatgaattgaagcatatttctggaaatgctagtgacttcaaggctctagaggttcagaaaagcttgctgacagatggggatgccacagaagaacatggagaagaaccaaatcctccaagcagtgatctttctcaacaacctcatctcttggaagagtcaagttgttcctcctcgttgttgagtaatcatagagaacatccagtgaaagagcaatacaggttggggaaaatgcggaagatacacgacatggtgatcaactcaagcagtcacattcaggcattggaaaggaagaagtacaatcacatcccttggaagagtcatcaagttgttcctcgttctccacatcgagtaatcacagagatatatgcagtgaaagagaaatacaggttggaagaaacgcagaggatgcaccacatggtgatcaaaccaaagagtcacattcaggcattgaagcggaagaggttgcagttcatcctataagtgacatcgttgacacaatcaagattcaagaaagaagccaaggagtagaagaatcctcatgcactgcaaatgaaatcatcacaaaggagtcagaactttctcccaaggacgttccgaaagagcggcggcctcaggctctatccaagttatctgcaacaagaaaagttggctccatgaacaacctctacaggaatgtccatgtaatcaccgataagagttcgacgccacgaggaaagaattcaacgccacgagctggcactgagaggaccagatcaaggctgaagcgggtgcagagcgagaagatggttgagatgaatgacaccaggaaaaacaaggagcagatcataatgctcaaggaggtgtacgagcagcttaacatgatagaatcgcacatgaggccttcgacttcacaggagacccctcggaatgaccaatccttggaatctgtcttggaggtaacttgttaaattttcaacttgttatgaaattttacttttgtagagttctaacatgtctaatcatgccaattttccaacaggcggctctgtccttctccttatagctagacccttgtggcctctactctaccatctgaacttctgaagcatatattcagaggccacctccagttttgaggcggccatctatcaggaacatctcttccatgaatacccaacaaggggaaatgcatagagtttttatatgcagtgtaaaactgcaaactccatggtggcgttctttgagaagtctcatacacacactcatctatcaaggcctccttcgagcggaggattttcgaagaaattctgcaggaattgaactaattcctgtaaaattctgtgaagttttcgcgttcgggagtccaaatagaaagaaatctaggtgttgggtctgtgggctgtggcctgacgccccacttcggcaaccaggcatccgttgtagcaacgttcttttcacagtggcagcggccaatgcagccgttatgttacttgtgtgagaaagttttacggttctacagagacaattttttttaccttatcacactaaatatagttaatgccatttctctcttctctcgttgagctatatcatcttaattatttatggtctaattatcttcctcattttcttcttttataaagtcatgtcgccttaattatcttccttcttcttttcttgtcttataaagtcatgtcaccttagtttcttagttttacctctagatgattaactatattacctttttttttccttttctcataaaccacggcttttgaacaaccaatccatatataatttaaattattataaacaacatcatcttaatttatatgagaaggggatggcggggaggaattaataatcaaaacccttgtttcttgggtatactcatgcatatacttgtagaacttgattattgaataattaaagttagcactcatgtgtgattatatttatacgttgtcctataaacgtgaaaattttttgtaggcttaggcacacagcacacataccctctatatagactagtagtactaggataagtccattccggtactaggttgttatattctgggatgggacggagggagtatgtttgagcttacgggggagctatttactcgcaactacgaccacacgcttcccaaataattaaacactatattttctcaaaaagaaaactttctataaagatttctttggaaagatttttctttaaaaaaatattaacctttaaattttataacagtaaatatatttaattaattatctaatggagtaatattttttcttattttgcgtatggcttataaactcatttcaaagtttcaaactctgtttagaatgggcccttactcgatataattgaactggttcttcgtagcctttttagctggccttttttttctctctctctctctctctttcagaatttttcccatcacacaacataatttttattcagtaaaaataccactgtttgtgtgccgtataacaaagaccggtgatgtaaaacatttttattaacaaaataatctatgtgaaaagtgtacgtggtcagtcggaaaaatataaaacagtcattcggacaggtgttccgtgtcggcagtcagctgtacatttcattttgcacacgtgttgtttcacaggctcacagctgcactac

SEQ ID NO: 13753 - DNA, 12368 bp, Oryza sativa
tgcaattgccaattcacatttcaggtttggatctactgatcctggattagccacttggtgctctcactcaacggatacgtgtagatcccttcgcacggcgcaaactgattcaggttggtcacctaaacactgccagaaaaaaaaggtttttcttttaagaatacacataagatttgtgtatctttgtagtattaagaacaaaaaaaaatggagaaagttttgctttgggcttttgctcagttgacttttaacacgtcaaattttgcacagttcgtcaactagtgatgggattcaactgcagatttgtcatcttgatctgtgacgacgaatgcacgatatgactatgtaataacaattttcatgtacgtaattgaaagctaaattgagtttccaattcagctgttcatgacccataactgatgtatgatcagtgtctgatgatcaattaattcctcatggaagtacattgattcaggtcatgggattgatcaattccatgccattttcagagactgttgctttcttgagtactttgaattcaagatcaatctaaccgattccaattatttttcctggagtcacgctctttctctttcatttaattgctgtattttataaacttgaatcataatttaatcaaagtcaaaacccacagcatctgatttgtccgttgtgctgtctgctacttggttacgtctgtgttgtctgctacctgaactgaaactggaaccggtccaggatggatgccttgttttcatgtcaaaatctgctggctacacacaatcacaagtaacccagttaattagtctacaaaaataaaagtaacctaagtctaccaaaaaaaagtaacctagttgatcagatcgagaccgtggcatgccctagcagcactacaggattgatcatcgatttggttgactgctcataaatcatcataactgaacaatgttggtgtaagttcatatttgccgccttctattctgacggccaaatttgttggaagttgctacggtctgccataaatcattaaattgtgcccatgctatccacaagaaaataacaggagagattcttttgtctgcgagattgtggaaaaacacaaccttatttctctttatttcattgtttcttgcaactccacgatagtgatgtaagtatggatgaacagtttgaaatataatgtataaaatcaaggaatgggaagaggagcaagaacttgaacatgacaaagacatgacaagagaaaatataggccagtcaaacctggtattgcttcaccgcatgcactcctcttactttaacagtctattttttttataatgtttgatagtctaattaggacggctatagattattgacgtctatttatttttaagtagtcattagatttttgtttattttaagaagcacatcaagatacacgtacagtcattagtcaaactcttgttgaacagtatggaaatgtccctcaggttctcatgcaaagattgccaactaagcacgcccacatttctctcccaatttccataaaaaatactttttttctcccaagcttctttgacattaatttattatactgtaaattataatatccaatgaatggtttgtgcttgacataatgaaaggtcagaatccgagcaaatatttttccttatctactgacccgttgtgataagaaaagaatttgaggatatctaatggccggaatttgttctttgtcaataaaagaagcacgttcagaaatgagcttctttcagtcagaaaaatggtactactaactgctagctagtactagcgtgcgtgtcaaatatgaattcacgctccgatcttccaatcctaatcagtaatttgtcacgcaatcttgcttcaaaacaaccggccgtaccgttcaatacggtgcatgcttgcaacattgacatctgaattaaggaaatgttcgcccaattctgttgatgttttgatgatgggagagccattcaatttagactcggttttgcaaagacgcatgctggcagcatgctcagtttgacatcgtgtgtaaatactctgcaaatttggtcatgcagatcagcctttcagatttcagctgcatacgtacacaagtacttgcatttactgatgatcgtttggactttggaacagatttgagaatcccgagtactgtacttattactacacaattaaccttaagtcaattttcgagggctagaaaattctattattttcttcggatcatgatcagttacgttactggacatataatactatctgctaatccggtcataatcaggcagtatagatcagaacagatgtgctactactgacggatgggtggagccgttaacgaaatgaagcggacagctgaaagttgcagtcagagacaagagaatgtcagctacactcatgaagtcttggaaatttgcagaaagtctaatccgtatactgctcctggccattattaaggaattaaaatgccggcctatttcagttaacccgtggaagtagtagtcagctagtgcgatctctgtagtgggataatagcacttgcgtagccatgtcatgggataatagtagccacaagaactaatttctcacaaaaagaataatcaataactaattctatgttcctcctacagactaatcctatgattctttaaaattttctatataaattgtttagaattgtaatagttaattttattcgtttataactctcgtgcctcctcgaatatcaataaaaacccgataattcatcatttattcatctattaaaaccccatgtgagatagattattctgcttcattataggaagaaattaaatttttaagaaaggaaaaagtccaaattaccctattaactattgcgacaatacaaattccctcttaaccacaaaaccagacatcattcaccttaacttctcataatggacgaattacccccctgagtctctttagagcggttttcgtcttatgtgacacacacgtagcagtccaatcagcattaaaaatttaaaaatagtgggcccacatatcatacgtgagcaatggaggatgaggggagatatgacatgtgggcccactatatttttaaatttttatgctgattggactgccacatatgcgtcatgtggaacgaaaactgtctagagagactagggggtaattcgtccgatataaaaagttgagaatgaaggatatctagttttgtgattcaggaggtaatttgtattgttgcaaatagttcaggaggtaattcagacttttctctttaagaaataaacttaacttgtactaacttataacatgtggtctaaacaatatcgagaatttttcttataagaaaacgtactggctccatattttcatattttttttatagatgaggtcactgatttttaaacatatgtttcactattcatctggtcaaatgaatggtcaaacatctattaaaaattaatggtgtcatctataaaataatagaagaaatgtattttgtagatacatagagtaaataatcaggtgaaagaacggaaccggaacaatcaaactgggacctcaaatatgctaaagatgaagattaagtacggtaaaaaattaatacataattagttgagttttaatattttaaatttgaaaaatcgatttatgagatatttataaaatacaccattttacagttttaaaaaatacattaataaaaatcaaaataaaatctgtaacttaatcaggtttaactgttcagagagtttagcaactactcccttcgtctaaaaaaaataaatctagtactgaatgtgacatactgtagtacaataaatttaaatagagatatgttcagattcataatattatgatgtgtcacatttagtaagttggttttttataggacggatagtttgtggctggtttttcagcaacattggggggagttggggacaaagaagtcaataattcaccgcaacactgccaccggtaaatccagagagagagagagacaggacacagctgaggagagagaaaccactgcaacccaaggctagccgcctcactccctctctctgtttcctcttcttcttcttcctcccgccggtcagctcagctcgcctcgtctcctccattttggcgacgcgagcgagcatattaaagctgtgccggcggctgcaactttgccgccatttatttagctccggctcttttaaaagctctcttctcctgctgccatcttcttctggttggcaccaccattccatatataccatctccctcctcctcccgcgctcgctcttcgccaatggccaagcgacgcagcaacggcgagaccgccgccgcgagcagcgacgactctagctccggcgtctgcggcggcggcggcggcggtgaggttgagccgaggcggcggcagaagcggccgcggaggagcgccccgcgggattgcccctcccagcgcagctccgcgttccgcggcgtcacacggtgcgtgcgttggctggccggattttctcaccggcgtacgttcgccgcactgggctgacagcgtttgtggtttggatttttttttttttggcgcgcaggcaccggtggacggggcggttcgaggcgcatctctgggacaagaacacctggaacgagtcgcagagcaagaagggcagacaaggtatcatcaccaatcactccattaatccaccttatagttgcatccctcgagctgctcgtcagacaatttgctcattctgatttcgctgcgttctctcttgttgctctgattttgcgatcggattggcgtggccggacgaacagtttacctcggtgagctcccaatctgaacattctgaaaccaaaatccatggccacgcagaaggattgtttgctgaccacctcactgtctgtgcgccggcgttgcaggggcttacgacggcgaggaagcggcggcgcgcgcctacgacctcgccgcattgaagtactggggccacgacaccgtcctcaacttccctgtacgtggcatacgcctctccaaaaatccatggcatctttctctgaactgaatcctctgcacaagcgttcttcggaacccttcaagaaatgcacgcacagtgcagcttgtttgattctgtttggttttctgaggaagattgttgctgtttttctcatgttggaactctctgcagctgtcaacatatgacgaggaattgaaggaaatggaggggcagtccagggaagagtacatcggatcgctccggaggtaaatattcagttaaccccatgttaccactgactttcaacaaagagaagttaattcagatcattacaaactttcagaaaaatccaaatcaaaacccattgaaatatgcttctctgatcagacatagtgaaatattcatgtctgagaagctgtgttttgaagtagttcttcttgattaagatcataaacctttttcaccctgcaggaagagcagtggcttctcaagaggggtgtccaagtacagaggagttgcaaggtagttaatcagtactaatctacactgaaggttccagttttctactgaacattgctagtagaatcagttaattaacagctgttttattcaggcatcatcacaacggcaaatgggaggctcggattgggcgtgtgttcggcaacaaatacctctacctaggtacttatggtaagtagtttgtgactttgttatatatgtatgcattaaaatgttcttaaactggtaatcagtcatctatcttgcgggtaaaaagctttgaaatagtataaattttacaatggaatagattcttcttatctgagtcagcttgcgttatcaaaaaggtagccattgggtgtcgttgttagataggtgacacctgttagttgcaaaggaaacagagaattttttagacacatccaagaacattgctgatgtgttggcttcaagacttcagacaagtagaacctaactactaactactcctttgcaaagacgaaaaggcacttggtgaagtaaagatgaaaaggcacattagagatagtttggaaagaatgtcactgaattcaaaagagctttcaaactatggctatccaaactaggattcgaagaaattgaataggataaagttcatgatctttgggataagattcgccgagttatgtttgaagcagccgatggccatactctggtagggccagttcatctgaatgccacagaaatgtttccgtacgctgtagctaaaagccgaccgatgcggtccagctctgactaggatggacgacctttgtttgattttgtgcgcaactatgtgcaaaatttccagcatgaactgaattgacgattttagacctgtttcctttcgtcaataattcataaatcaccatggcatccgtatgaattggccaccaactgttgtgtctagttgctgcagaaaccggtggcatgatgtgccgtgcatctgcacaaattcaaatcagttttattagctaaccgtaacgttgcctctttgtcacatctgtacaacaatacaagggacgtgcaatccagaaaaaaaaaaagtccacaacgaccggtatgttgaacaagtcggtatatgtggattatttgcttcacacttcttttaaaaaatgtggtgcatttcttcttggttcacttgctataagttacttactctgtcctaaaataaatcaatctaggtgacgatctgacacaatcacacaatctctttgtccagattcattgtaccacctagattggtttattctttatgtattatgtatttattaggtttattatatataatatttaagttttcgtataatcaagtagataatctatcaacatacatatgcgagcaatatgtttgaaacactaattctaaaagtacactttgaagtcaaggacggaggcaggagtttgctaagcctaaggctcaacaaatgtaacttgttagattttcaaaattttcaattttttttggatgaatttaaatgggattgatttagcaagcgcactttatagtcgttatattccctcctgtccgtggggcccacagacagacaggcaccaagcagtggcaactggcaaggccactggttcactgggcctggacgcaggcaggatggcaggagacaggagtcccaggcagccacacgccacagtgacccactcccacacccaactcagcaatgcacagccacaaaaccaaaccacgctctttctttcttcttcttcttttttttttccttttcttttctctttttttgcgggagaaacctcgctcatctcatctaagccaccatcttgtttttttctgaacgaaatttaccatttcatatggatttcctctgctatgttttttttatttgttcatggctcacggtgctcttttttccgtacgatctgtcagcaacacaagaggaggcggccgtggcgtacgacatcgcggcgatcgagcaccgcggcctcaacgccgtcaccaacttcgacatcaatctctacatcaggtggtaccacggctcttgccgctccagcagcgccgccgccgccaccaccatcgaagacgatgatttcgccgaagccatcgccgccgcgttgcaaggcgtcgacgagcagccgtcgtcgtcgccggcgacgacgcgccagctgcaaaccgcggacgacgacgacgacgacctcgtggcgcagctcccgccccagctgaggccgctggctcgcgcggcgtccacctccccgatcggactgctgctgcggtcgcccaagttcaaggagatcatcgagcaggcggcggccgcggcggcgtcgtcctctggtagcagcagtagcagcagcacagactcaccttcttcttcgtcgtcgtcatcgctgtcgccgtcgccattgccatcgccgccgccgcagcagcagccaaccgtaccgaaggacgaccagtacaacgtcgacatgtcgtcggtggcggcggcgaggtgcagcttcccggacgacgtgcagacgtacttcgggctggacgacgacggcttcgggtacccggaggtggacacgttcttgttcggggatttgggcgcgtacgcggcgcccatgtttcagttcgagctcgacgtctgaactctcaactccgaccagggtgtttcgggaggcccacaatcccagcctgttcccgtagatgggctggaaagatcgaatcaaatttgggcctattcaggggatgggctgggagaattgatatgggccggcagggatggccgaaagggaaggcctcccaagttttggctgtcaagaagctagaactgagttctctctcaaaagagagagagagagagaagctagaactgaggattagttgcttactcgcaaatactagtagtttggaggaagagtaaaatattggtttatttgttgcccatctctgcgaaggggaatttaccgtaataaagagtacatattgccgtttttatacgaaggctagtttatgcgtttcatcgcaagttatttcctgttgcaataaacctgcattgttatacatcatcaattctatttttttcgcattaaaaaatctaccttttcttttttatgttaaaaagaacgcttcaataacttccactaaaaatccgcaaatcctagccatccgattagagatcaagggctgaaacgatctccttccccaacggccggtgccaaaaacgaaccattacttccactaccccacaccgcagcgcacgcgcatgtgggattcccctcctcctcttcctcttcccgccctccccctccactccacctctctcccctctcctcaacccaaccgcccaatcgaatcccccaaaccgcagcaacggcggcgcggcgcggcggaaaccctagctctaccctcctcctccggtcgcatcctccccggcatcgccgccgatggcgggccctcccggcccggcaccgggcacctcctcctcctcctcctccctgcccagccgccgccgccgccgcccccctccgcgcctcggccgacgccgcggcggcgatgatcaacagcccccgcatcctccaaaggcctcgtcggaggctctcccctgcgcggcctccccgcccgcgcggtgccgcggcggtgatcaccagcccccgcatcctcccgaggccgcgttagaggctctccgcggcgcggcctcccctcccgcgcggcgccgcggcggtgatctacatccctcgcatcctcccgaggccgcgtcggaggctctccgcggcgcggcctcccctcccgagcggcgccgcggcggtgatcgacagccctcgcatcctaccgaggccgcgtcggaggctccctccggctcggcctccccgcccgcgcggcgccgcggcggcgatcaacagcctccgcccgctgtggcggtggcggtgactagtgaaggcggcgtgggtccccgccgctcgttccgcatcagcctgcggcaccgcgtgcgtgtggtcccgtgggtgaagccacccgtggcgaggaagcccaaggaccccgcgaagcccccgcgcccgtcgatcgaggcgctcgcggcggaatgggcgaaggagaaggcagcttccggggcccccgaggaggagtgcgtcctgcctttcctccagaaagatgcgcctaagaaggtagcgagctgaaactatcgaattcgttctcttctagtagtagcatttggctcccagggttcgatcgttaggttgcgtgggtaattaatgcactagttcccctcttcgggcttccttgcgatgttctatggtggatttgcccctgcacactacgaaaattgcagcctattgctgttgtggtgctttgatttctccgtggaagggtggtattttggcaatctggggttgtatgacctcagaattcaactattagcaaatgtagggtccaactttgtgtataagggttacaactagatatgtcttcattttggtaatatgacagtatgttgatatcgccttctacttctaggatatgaaattaaagtatagctgcctccatttattttaggcaattttacaccgtgtcatctgaaacgtgtttataaacgttcatgcttttggttaaaagtttttgtttcctgttactttttgacacgtgagctgtgagaaactcattgtctgcatcgcctgaagtgtatagaactttatataactctgggtttcttgatggttcagaaatctagtgtagctgtatatggtctggacatttgtagcatcactgtacaatctgctgattcaattttggactatctgtataacacccttttgttatgctttatattacagaccagctaatagcacaaatgtttgattcactgttagcaccactgtatattgtgactggttagaatgactacaattgttgtcatgggtcacccagaaatttgagaaatacaacataagatttttagctttcttgagaagaggtggatggcagagaatttggggtacaggctgaaatttcatatcggttttcatcattatataatcttgataagctcgacattgtaaaagttcttggactagatggatttggatatatggatacagtgatattgagcttgaaggtatagcaagggctgcaacagggatatggatggctaagggttaaatcttcaatttttgtagagttacaggaaaaacattcccattacagtaggaaatgtaagtggaatggaaattcattttgtgttaggacagttggactaaggacaccaactgtatttccaagaaagctagtttcattaaattttgggtagctggttattaaaagcataatgagaaaccaagttaaatggtgaatggtgatggaattcaaagtttgtaaacaacagataacgatttgtagaaatggtacaaatgataggtcactttctgtacatatatgaatatggactgaactgatcgtggaaagcaagtaatatctgaagagaaaatatggaagagttaagctctatgcaagaaaaagagctggatgtataggagtaaacattttcttaattaaggcagggatggggcttgaactgtagtcctcaactactgcgcataatcgcatatgggaatgggatgtcgatctatatgcatgcaacctgaagaaactgaatttttgctgaagaggtcagatatttgtatggatgtctccctctcccatgagaaaccctgatgtatattatatgttgctcaaatgttctccatacagtaattattcagtaacctgtatagaaattgatgactatgcgattatttaactaataactggtagaagaagctcatattattagagtctgaatagatggaggtttggaggcattgcttgccgctgttattcaaatgtctggttgctgataaataacaggaaaggaagcttagaactgctgtataaatgaagtcagtgtgtggacatcttcagtgtagaattttaaccagagaatcttattagctaatacaagaaagaagaaagcttcatcaagaaatgaaggaagaatgacaagaaaatcttaccatagcattctggtccagctggaaaattttggctcataggatgttaatatcaagttgtctctgctcagtattacttgaatgtatactactcatctgcttttttattgaagtacaaaaggtattgtgacacctcctgattactggaaaaaaggagtcctctaaatcattttggatttaggttgagtgcctggtttgctcaaagagtattctgcctgatgacaagatgtgttgttcagttcgtgattgtgatgcaaagctgcataaggcttgttctgaaaaaggtgatggatgctgtcctcgacatgtacgcttctgaaaccaagttactgctatatttcagttgtttctcaatgttttctcattgcctgaaaaatgaagcagattgaaatatccatatgtacataactgagacttttgacacatctcagccctacataatagcaatcaataattacagtttattgataaagagaaactgagagtttcaaattgcatatgtgtgtcaaccacttatccttatctgcatatgttgcttatttaataaaggggttaatacaagagttggatattggctgatcagagaatgtggatgtaacttgaaaccttaaaccattggcatgtatagctgcaaatttaatgtttcatcgtttcctcaccatgaccaggcgttaaaatgattttgcacttagtgaagattaattagtaatgtcatgagaatagagtgcctcattgaaaacgccatcctactatttatgagtttgcttactatatgttgcaaaagattactgggttgacttagagtttttcttaaatccttatttaaaatattaagaatttaatacctgtacctgctttgtttctattaacattacttgattctctgttagatgt

SEQ ID NO: 13754 - DNA, 1501 bp, Oryza sativa
aacaactattgttcccttaatgaactaagatctttatcttgtcaagaacaaatgtgatgatgattccattgaaggtggatgcactaattgtctccctgattttacctgtaaattaagctgttcatgcaggtacaaagtatccattccatttattatgtgcagcttatcagactttctcctgttgctcattggatatagtgttttctcttatgctcattggccataaatgtatgtggatttaaaaagaaaatatatattttttatttttttacagaaaattaagataattcctacaggtctctattggttagctgctctcgggcttgtcactgctcagatgagtgcactaacaaaccatttcgccgacagaaaaagattgagatcgttaaggtaaggcttgtcatggactgctgagtttttggagggcagttaagttccatagttgtcttggtgatattgatacatgtaaggatcttttcctaaagtactaatgctgcccttttctttatgtgttcttatgctgtgcttgattgtgctttggagatctgattttgaaattattttctgtcactattgtttctctttgacaacctacttattagtggaatacttctgcagacacaatattgtggatggggatctagagcactggaagccattgagaaagatgattttgtcatagaatttgttggagaaggtataagatattcattatttggtttgcttagacattttattgtaatttattcagatcactgcttcttcttacttatgcttttgtggactattttatcaaaggattttacatatgttaaacctgttaaattactttcatagggcagtactgaaggaacttgcctgaaaactttttagctctgcttacttttgtttattgcagaacaatagttctacctttcgtacctgccaactttcccaatttacctatctagatgatttggtagaaacacactaataactgggctttgttttctccccgaaaaaaaaactattaccaggacaaagttagatctattttagcttattttccaacttaatattggaatacctttttccacatgataatgtatatttcagcatagtttgatgttccatactattgcctctgtaacacttttttatgcagtgctaagatatgccctttgtttgttgtttattatagcagtctatcggttaattgtatatgatatttaaacttacctttttatccttgctcctttctggctgctaataattaaattaatgttatatggtcatgcgtcatgaatcgttttaaaaccagatctaccaggcaaacctgttactgttaagtaaaacatagtataatccagttaacaattataacttgctgagttatcggtataatcacctaacaggccatttgcaaggttagtgtagttaagcctcacttgtcaagctcatttatggcttatactccctccgtttctaaatatttgacgccgttgactttttaaaacatgtt

SEQ ID NO: 13755 - DNA, 670 bp, Oryza sativa
aaggcttgaggacatgagaaggcgtggagataagaatttctacatgtgtaaagtcaaaaaggactttgtaattgatgcaacattcaaaggaaatgattgccgcttttttaaccacagttgtgaacctaattgccagttacagaaatggttagagtgctctttactcgctgatgcattatatcaatttcacattttgcttagggttgttttcttgttaaattggtcatttggtagctaagctttctgcttaaacaaattaagattgtttcaattacttttttttttgtttttccaggcaagtcaatggcaagacaaggctaggtgtgtttgcttcaaaagctatagaagtgggggaacccttgacctacgactacaggtacctgttcttatcaccatgaagggtttttgtcctttacagcacgagaattttaacctgatttttataacctatctttttaccatcaaagatttttcttattctcgcattattcagttttcgcctgctgaagtgcataactcagaactgttagctcagcctacaaaatattatgaccataaaaatatatgttgagacttctattcaattatatgtgtaatactaattactccctccgtttcacaaatgaagtcattctagtatttttcacattcatattgattttaatgaatc

SEQ ID NO: 13756 - DNA, 661 bp, Oryza sativa
cttctcaacattgccaaccaccgcagctagccccaggtcctcatgattgatgtaccacaacccatcacacctgactctagtcccaatcctcctcccagtccccttctcctggaacagatgagagttctcatcaaatacaacaatgcacttgagttggtcaatagctgagctaactgagagaaggtttactggaaaggaaggaacatgcaagtcagaggataagtttattgatgatgtgcactctactgaccctataccatgaataggtttggatgtaccatcagcgatttggatagtttcagagtggacataaggggtgtatgatgtgaaggtattatgcaatcctgtgaaatgctttgatgctcctgagtctatgatccaatctataggatgtctgtatgtagatgcaagtgcctgtgcctgaataccttcgcccacttgagcgtagttggcgaagttaccaaagtgagtggtggtgttggagctctcattgatcttgttcttctgccattcctcccactgtgtcacctgttcacctgttaaggtaatagctttaccctcctctatggctacatggcctgaggagcacctcgcccctaccacgacctccaccaccacgatctccaccacgacctcctctaccactgtggttccccccaaa

SEQ ID NO: 13757 - DNA, 54520 bp, Oryza sativa
  unsure (1)..(54520): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaaatcagactggagtctggttggttccggtttggtttattgatgctgtttccgagtcttttgtttccataaaatatgtagactcatattaaatcacaaccattaatctagatctattttaatccaatggctaatatttttctctttttctctgattaatgtgggaatttctagcccccacagtgaacgtggagcctccttttaaagctgttttaataatataatagatagatttattagtaatgcccatattagatttcacattaatttagaacaatcttaaccagaattcgaatgttggcttatattggtaacaagtgacactaccaaaaaaaaattggcatcgtagcaatccaaataagccccaagtttgcggagcggcgggccgtggacgctgtcgcgcaagtagccgagagagtaggaggtgtacatagtgtgcatgtcgacacttccgcgctcaggcggtcacgcgtgcgtgcgtgcgttcaagctgctggtggagactggagtaaatattattcagccaaatgactcggtgaattgaacatctgaactcacgccacttgcgcgcgtaagacgatgtccgcgattacgatcgagccgacgcccgtgcggtcgtgatttgccggggcccggcctgcaatctggctcgctagtcgcccggtcatatatgcaggctgcccctccaccagatgcacctgcgacctgcgtgcagcctctcattccttcgcgcgctctatgcagcatatgcaatctcgattcgtagccactctaggttggttggtaggttgttgaattgaacccctttgatgggataggtgacgacatcgcatcgcaaaaaaccgtgcgtgtgtgcaccggatatatatcttcgtgctggcccccggctgcagctatgattctcttctgttaggatatggcgacgtgcgtggcgttgatttgtactgttgcgggggcgttgctatttgagttgagtaccatacatgcatgaatgctcgcttgctcgcaaaatagtagtatcccggctgtgcacgtacgcgtctcgatcggttgttaacttgctggttctcgcgcgttaccgtgaggccacggcgcttcaatcaaactgtatcaaattaaccaccggatgtgatagaggctgtgtttagattggcctaaagtttaaaatttagttaaaattgaagacaatgtgactgaagttgtgtgtgtataaaagatttgaggtgatggaaagttagaagtttgaaaaaaaaactttggaactaaacacgcccagaataatggaagatcttcttgtccccgagtgttattatcagggatggtgtcttgggcaataagcaacgtgatttttgacctagctagttagagaagttacagcaggtgcgtggaaactgcaaagtaaaagtgccatatttgcggccatggcgagcccagacatgatggagatagttaacctctctcgcatggttgaaattaattgcaccagttatatcgtgggcaccctgaaataccatcatatttgaagacaggatacgtaacagtactagtttctttatactaagcttaatgtgctgttgcttttgagcccttatttgttttctgtcaggccaaggccgggtcatcctgcctctgagaagagagaccacaagtggttgaatttggcccctaggagagggaaaaggcaaagatactgatacatacatgacccccggtcggcgaggcgactcctactattcagtccagccgcgcggcgcgtgacggcggtcatcggtcaaagacacgaaccggaaccagtgtggtgaggcggacgtacgtacgggaacgggacgaccaacccctggctgctacgcgatccgcaataataattctcggacatgccaacaccataggcccaccggcccgcatgtacttgtagcgattaccggcccggagaatccagcgcgaccatcggcccatcaatctgcgggcgcgttgcgcctccgcaaccgcaaccgcaccgagcgcgcggcctgcctggctagcgtttcggcccatcgatccgcgcgcaccgcaccgcaaaaccggcagcgcggcgcggccgtcgctgctggcggcagcagccggctgctcctcgcgaatcgtgatggatggacgcgtgagtcgtgacgttgcgagtggtgcgactttgacctcgtttggttttgcgtttccgtcggtgcctcggcccggccccggcgcgcgtcggcatgtgacgtcccacgtgcgcctcgcctccacctccaccgccgcgctcctctccgctcctaggattgttcttttttttaaaaaaatatacatttttggccccttctacagcttcttccctttgaattttttttcgaaaccgaactcttccatcaattccttcattgcttcttttactcgctttctgaaacaaacaagagtgtaggtgtatcagttgtgtgccattctcgtctcttctccgcgacgcgttcgctttctctcccacccaaaacccccagagagggaagagaaacgcctccctcccctctcctcccccgacccaccctgcacctccttcctcgtcgacgccatggcagcaccggagtgaagcagccagccagccgcccggatttcaccatttggtcccgggtttcgcccggatctgggtctctcttcaaccgtcttctccaatctggcggtgctatagctcgccgcgcccggttggggacaaggcccagtaggcgctagccaaacagtgttgagcgcctcctcccctcctcgcgcctcggcgcacggccggcgagaaggttttgaggggcggcgagcttcttcaatctgcctccatctcggtttgaatcggtatgcatatactagcatctccctgtagactgtagtaatacgaaattgtactagtagtttatgtatgcgtcgccgtcggtttgatctccagaaccatcgctgtcagcgagtagcattagcacttactgcgagcttatggtccctggggatctagtattagtttgtggatttctccatttgatgttgacatgctacagtatctccttcgcccatcatactactagaagcgtttctttttgcgcttttgtcgaatggaaaagatttgtagtttttttatgtgtaaatcaagtttgatttttattttttgttcacctgcatctgttatgaaaaattgttgtttttcccttgttgatgctacagatgttctatgactgcatcatcaggttcataagtcctgcttctaatcaatggtgctaacagatgtttctgttttgtacagagtggtgtagcaaataacatcattttcggaggcaatggcggcatataagttgggtgtggaggttgcaagtgctcatgacctgatgcccaaggatgggcaaggttcagcaagtgcctgtgtcgagcttacgtttgatggccagcggttccgcacggctatcaaggacaaggatctgaacccagtgtggaatgagcgcttctacttcaacgtttcggatccgtctaatcttcctgagcttgcgcttgaagcgtacgtctacaacatcaacagatccattgatggttcaaggtccttccttggcaaggtcagaattgctggaacctcattcgtgccattccctgatgcggttgtcatgcattatccactggagaagcgtgggatgttctcacgtgtgaaaggggaactgggtctgaaagtatacattaccaatgacccatccatcaaagcttcaaaccctctcccagcaatggatcctgtttcaaacaatcctcccccaacgccagcggagcaaatagcaactgatataaccggtacaaatctcagcacaactcatgagcacagggctgaggtgaaaacattgcacaccatagctaaggaggtgcagcatcagcaccatgggcatggccatctaccagcttcctttcccgaccaaccttccaagtatgctgttgaccagatgaaaccagaacctcaacaacccaagattgtaagaatgtattcagcagcctctcagcaacccatggactatgcactcaaagaaactagtccatttcttggtggcggacaggttgttggaggccgggttatacgtgccgagaagcatgccagtacatatgacctagtggagcgaatgcagtatctttttgtacgtgtggttaaggcacgggacttgcctgacatggatgtcactggaagcctagatccttatgttgaagtgagagttggcaactacaggggtataactaggcactttgagaagcagaagaatccagagtggaatgcggtctttgctttttccagagaccgtatgcaggcaactatccttgaagttgttgtcaaagacaaggatttgctaaaagatgactttgttggtctggtgcgatttgatctgaatgatgttccgatgcgtgtgccccctgacagtccattggccccagaatggtaccgcctcgttcataaaactggggataagtcaagaggcgagctgatgcttgcagtttggatcggcacccaagccgatgaggcatttcctgacgcatggcattcagatgctgcaacacttgaggatccatctgctgtaacacacatgaagtctaaagtttaccatgctccaagactctggtacctgcgagtcaatataattgaggcccaagatattgccataactgataagacacgctatccagatgtttttgtaagggcacaagtggggcatcagcacgggaggacaaaacctgttcaagctagaaatttcaacccattctggaatgaggatctaatgtttgtggctgctgaaccttttgaggatcaccttattctttcccttgaagatcgtgtagctcctaacaaagacgaggtgcttggccgtgtaattataccgttgacaatgattgatagaagagccgatgatcgtattgtccatgggaaatggttcaatcttgagaagccggtacttattgatgtggatcaattgaagaaggagaagttctctactcggcttcatcttcgtctctgccttgatggagggtaccatgttctagatgagtccactaactacagcagtgacctcagaccaacagccaagcaactctggaaaccgtccattggtttgcttgagcttggaatcctgggtgctcaagggattgttccaatgaaaacacgggatggaaaaggttcatcagacacttactgtgttgctaagtatggttcaaagtgggtacggacacgtaccatcgtgaacaacccgggccccaaattcaatgaacaatatacctgggaagtttatgatcctgcaacagtcctgactgtcggtgtttttgacaatggccagcttggagagaaaggtggtgagaagacgtccagttctaaagatgcgaaaatcggcaaggttcggattcgtctttccactcttgaaactggccgtgtctacactcactcatatcccctcctggttctacatccatcgggggtaaaaaagatgggtgaattgcacttagccatacgattttcctcaacttcattagtaaacatgatgtacctgtactctcgacctttgctaccaaagatgcactatgtacgcccaataccagtccttcaggttgacatgctgcgccatcaagctgtccagattgtgtctgcccgacttagccggatggaaccacctctgagaaaggaagttgttgagtacatgtcagatgttgattctcacttgtggagcatgagacgaagcaaagccaacttcttcaggctcatgtcagtcttctcaggcttgtttgcagttagcaagtggtttaatggtgtgtgttcatggaggaaccccattaccactgtgctggttcacatcctatttataatgttggtgtgctttccagagctcatactcccaacagtgttcttatacatgtttcttataggggtttggaactatcgttaccgaccttgctatcctccacacatgaacactaagatctctcatgcggaggctgtccacccagatgaacttgacgaagagttcgatacattcccaacaagcaggagtcctgatgttattaggatgaggtatgataggctgaggagtgttgctggaagaatacagactgtggtaggtgatatagcaactcaaggggagagggttcaagcactgcttagctggagggatcctcgggccacagcaatatttgtcctcttttgtctcatagcagcaatagtcctgtatgttacaccactccaagttcttgcagcattggcagggttctatgtcatgaggcacccgaggttcagatataggttgccttcaacgccagtgaatttcttcagacgactgccagcaaggaccgacagcatgctataaaatagctgccatctggtggccttatcattgtgataaattggatggagtactccatgccgattactgtagtctggcttcgttttgttgttattgtaactgtgtgttcttagtacttgagagcctgtatatcgtattagcttctgaatgcagggaataatgtgtttaaggcttcttgtgaactatcagattttggagttgtactggtcattttaaatatctagttgcccaatatatagtactttaaaatcttgcttgcttggtttctgttgtatgcctgcatatatgttgtcatgaaccattctctggaaagggtgactactgatcatcatacaagatattttttctgcctaatttttgttgattgatcggataggtagaaagggtgatgatattttgtggctaattagaaagctgtgctaagcgttcaatttgtacctgttgttgaacagctgaacattcagcattgattgatagctttacacactgtatgatatctccgactctccattatgattatattgtgatttccgctgtatactttgagaatgcccagaaactggtgataggaatggcttctgtgttgtagcgttgatggacacaatattttgtctacttgtatagtagcgttatatagagatacatgtgctttagaaatggcccattcaattatcatgttttacatattttgtggttggcattagcatctgtggaaaacatttggactggaaaaaaggggagaattctcaaacgaaatgtctgataaaatgcagaaataaatctcgtggtgctagttgccagttgtcacacttctttttgttccttcattgtctctttgcattcttctccaatccttcttccagtggcttgtccaggagagcacttcagtgttgctgaaagcaaatatgggagcagctgagtcatcttcaaagctcgctggctccatccatgaattcactgtgaaggtctgttgagcgcctgtccctccttccatttctctagaattatttattcttattttttatcaagcatgttgagaggttttatgggaaattttgaagaagccacgttgaagtgtctgtgaaccaatgcaatcgggctatttgaaaattgataatacaagaacaagagatggagtttttcaatgacagggtctctattcccattcatccaactttgatttcatttcgtcgtgtttaaataacggtctgtggaataattctgcaggatgcgagggggagtgatgtggaactcagcagatacaagggaaaagttgttcttattgtgaatgctgcatctcgatggtattggtctttacattttcattcgaaattgtctaatgagagtttgtactttcccacctgatctgatgatatctctgcagtggtctgacgaattacaactacactgaacttggtcagttatatgggaaatacaaggagacaggtactagttgtttacctatatgacagtacgtttgttgcaactcggctctgaagtcacgcgaatacctttatgaagtacttttggagaaatcgctgcaaatttcttgaatcttgaccagtgctcatttttcagtatcggtttttttaataacatttttagacttttatctgtgggcactgggcagctgtataataccgtactgctgttattgcttttactctgaagaaagtattcactctcttatcgtttcctctgccgtccagttaaattgcatcaaatctttcagtttccccttgacacctcaattgtaatttatgagagcataacgctgtccgttgacagtctacaatgacctcaattgctttgtatttcccctttttcttgtgcaattaggattggagatattggcgttcccatgcaatcaatttgcaggacaggagccaccgagccaggcagcaatgagcaggttgtggagtttgcttgtacccgcttcaaagcagagtatcctatccttggcaaggtccaaccaatggcaatcttttcttccagtgctagcttccaaaaccatatccaattatttgttgtttcggtctaaaatcaacgcgcccgagttgtcaaacaggttgatgtgaatggcggcaatgctgctccactgtacaagttcttgaagtcagagagaggtggcctcttcggagaacgcatcaaatggaacttcaccaaatttctggttgacaaagagggtcatgtggtgaaccgttatgcaccaaccagctccccattgagcattgaggtgatgaaacaaaacagtgttcgttttcattttattatatagcttcacaggcatgattactcatcagtcaatggttgtttctgcagaatgacatcaagaacctgctaggggcttagagctcactccatgaaagatgatgcatcgtcctgttgttgctgctactacaatctgtttgcaatttctgtgaagaggaacctacaatgatgatgctctgtatctgtgtagtgagaaagaatataaaggtagtgaaggaaatctgaatgtacaggttgggcagtagcacatgtcgctgaaagaaaagcaagattatcctgttgggattacacaactctgagcatgcatgcatgcatgaatgcaacgttgcctagtgaataataataatctataagaattaacggctcaaaaactgaacaggctattacagagaggagtacaattttgggggtaattctttgggaatcagaaaaacaaatttctggagcacatatggaagagtcgacaaattgagagatgaagctagcctctagatgagttgatatcaatgttggaacttctcgtgtcaaatatcccggagctaggccaccctcccgtcgttgttacagggggcggcggcgttagattttggttatggccggagctcggcgacgcgtcctgccctcctccggtcagcgagtccgagctgaaggccgccgccgccgcctgttgctgctgctgtttcccggccttcttcgacttgggcttcgaccctccctgcacgaaactcccaagtaccacctgcaagtgccaatgagtaccccaggttagaccaagatcaatgctagaattgaatcccatttctgatcaaaactcagaatccctttgattggaaaagaggaattttgtaggaatcatgtaatcatcccttccaaagaaggccttaatggagtgagtacatttgcaaccagacaatgctactataatcttgatgatgaagatgatctagccatctaggagaggagaaaaagaaaagatgaggttggttcagggttttaaatctcccgctatagctgtttgagaagggttatagctatttgctctcatatacaatttagctgctatagctgcttgagaagctaaccgctaaatgtcttagcccgctatttaaaacattgggttggttacctgaacggtgctggcagctaccaatgctccgccgagaacgcctccaatgatatgcctctcggggctgcacagcgtcacgctcagcccgtcgctctgcccctcgttcatcaggttgtaacaccccgacatgctcaagatctcgtacagcccctgccacaatgcacacacaaacatcaaatccactcctgtcacatgcaactctgaattaaacttaccaagattgcattgcaccaaccaattagttgttatacctcgtagatggcagggttcttgtagtgggaggaggcgtgaacccttgacatggcgccgtcggccgggtggcggaggaccacccgggagacggagccggtggccgagagcacgcacaccgccctggacgaatggttggcgaacgccacgatcttccctgcaacgtcctgacaatgatcaatgtcgcctgtcagctcagttcagttttacctcccctctcagtttgcatgcagctctgcattttctgctgatgaaaaaattgtagtaacggtgaatgagctatgagtatttttatttacctctgaaggagatgccgtgatgatgtgaggggtgaagctcgttccagctgagccactgaacgcattgccccctgcacaagcacaaacacgatcatcaaggtcatgacagttcctagtctgaaagttttttggtattatagagttgcaggacaattttgggtaggaggaatgcctatgcaattctctaagttaattaattaggaagtcacagaatactatactgtttttcttttctgaaaaagataacaacacatgatatatttttttatcttttctaagtaaagtacacatggatgacagaattcaatatttgagtaaacaaaacaaacaaaaaggaaatctaccactaaagattaaataaatatcaacgtggcagagcagtgcagagcaaagcagaggctttccctctctctacatatataaagactgtcacttgattcacttacctgaaagcttaaccggtgatgagagctgctgcttcttccctgtccccggcggccgcccgcgccgcttcttctgcgccgagtcgtccatccctgagccgccgccaaccatgtcggcgccggacacggaccccatcctcggcggcgcgctcagcatctgctgctggtgctgcgcggcggcggcggtggacaccttcatggtcccgtccgggccgtacttgcgcgggcggcctcgcttcctcttgaccggctccatgggcgtcgcggacggcggcacggtgggtgagccggcgccggcggaggcggagacggaggccatgctgttgtgcatcaatggcggcggcggcggcgcggcgtccatctggaactgcatgccggcgagcgggcccgggccgatggactggaggatcgcggtggggctcatccccatgttgggcatgggtcggatgaccgacgggccgccgtgcatcccggcgagcggcgacgcgctatgcccgccgccgcctcctccgcccccgagcatccggtgttgctgctgatgctgctgatgctgatgctgatgctgctggtgcgcatagtatgacagttcggacggtgagaggagttctttgccatccatgcatggatcaccgagctccccccaacagaaacagatcaatcaaactgcttcttcctttctttctcctgttcttgaacaatcagcacgacgagacgaggacgaacagcaaggtgttgaagatgaagagtgagttggttgggggagaaggaaaaggaggggaggaggagatgagatactagatcagatgaaatgatggggggagagagagagagagagagataagatgacgcggttggcctacatgctatcgcagcagccgcaacgcagacgatgcaactaggccaagcgcgcgcaggcgcaggcaaacccaagccaagaaggcacaagaggacggcgagcgtgagagagagatgggcagcggacggagggacggatggcgcccacacaaggaggcgataagatttggttccgtttccttggcccaacgacgtcgaaagggaaaaaaggcggagccgagcgcgagcggcgcggcgcgggggtggatttgcttgtgatttgccttcctttgcaatttgctggctgcggcttccgtttcgttcggcgcgcgccactccattttgcgtccacgcgcgcggatgggctgggtgggcggtggcctgtcgctacccgcccactcgatccccgcccccacgctacagtccgatcgggacctcccctcgggtcccacctgtcagctctccacaagatgttttcagatatttatggcgctcgccctgtcgcccacgaccttttcttggttttcaaggttgatgcttcccaaagcttcacctcacctcacctcacctgaccaccaacggcggatatctcatgaacctttgtgttgggcggttcatagttcacgtaagacttggttgaattgttatatcgagatagtatgtctaagcaggagcggagctagaacgaaatgaagagagctgccactcacttattttactctactttagactgatataagtgcctaaatttggattgagggaggtgcatatatggtgaaaatagatgaactatagcttaaaaaaatttcttaaccgggttcctgggcaccccctatcctacctagctccgctcctgtgtctaagtgaaaaatatgcatataggtttctcacacacaccaactagcaaatgtcataaaaaattagaaaaaaataaacagttatttctaatagtactacacatatatgcgaaaattcatattaagattcattacattttagccgtgacaaaaaaaatctgataattttaagagtaaccatctctaaagatttttttttacaattaaaatataatgaatttgaagatgcatgtttcaccacaagaaatctaaccaattgacatatcaggctttcacatactaccttcatatttcatattttaatgtatgacaccgttgattttttatccaacgtttaaccattcgtcttattccaaacatttatgtaattattatttattttattgtgacttgattcgtcatcaaatgttctttaagcatgacataaatattttaatatttgcacaaaaaatttgaataaaacgaatggtcaaacgttggtcaaaaagtcaacggcgtcatacattaaaatatagggggagtacaacggaggtcggagtcttcgaaagtttcacatatggtatttgcaaaataaaaagtgtgtccatgtaattatagcctacttattgtatgtaatatttgatattcacggatctacttcaaaataaaacacgatatgacattaattaaaattcaaaataaaaataaattaaatccctaaattagaaaaataaaaataagagttcaactaaaagtacaatttttatataactaaaaattcgaaataaaaataaatattattgagagaagaaaccatatagaatacatcacgagattaattaaaaatcaaaaataaaaaataaaaaatataagagtttaagtaggaatataatttgtaaataacaaaatatcggaatgaaaaatatggaattttcattaaaaaaaacaatccatttagaacacaaacgatgacaaattacaatagagaaaggagaagcaataaccaatagagaagggagaagcaataaccccgtaaagaaatggggtggtagcggtggactataaaaaaaacccaaatagaattccaatgatggttgagaggggagacgacgggcagaccattgaacagcacggtcatggctgttggtgggacatttagaaagtaaataaaatcacacaatgataatcatgtttgctttttaaactctcagtaacaacaaagaggggtagcaacgggcgagctgtagaggagtagtggcgaagtcgctgacggtttggcaaaacttctacaaagtaaaaaaataattaaactcaatgataattatgttcaattttttaaatcccaatgacaataaaagatgaagcagtggaccgattatagagtagtatagtaatggcgtttgacgggatttctaaaatcataggaacgaaacctaacgagataatgaactctaaaaactactagatttaattttaaaatttttcaaggaggatgtatagaagccgtggtagatcaagcaagcaaataaaagggtgagaaagaagtttggggtagcgactaatgcaacttagaagtttggggtagctactaatgcaactttttaaaaactgtaaaattagaaacacatgaagtgataaagttcggttttcaaagttatatgacaacgagatagtgatttaacaaattttaagtaaaattatatataaaaagagataattttgtacgtgtgttggtcccgcagctgcgcgggtcacccaaaaagttttgattaaatggtactccctccgtttcaggttaaggttataagacgttttgactttggtcaaagtcaaactgttttaagtttgactaagtttttagaaaaaaatgttaacattttcaacccaagacaaatttattataaaaatatattcaattattgatttgataaaactaatttagtattataaatattactatatttgcctataaacttagttgaaaaaaaacagttttactttgaccaaagtcaaaacgtgttttagcctgaaacgaagggagtagaagttattaatatgaatagtagtggtatttttttaattccaaaaaattatagtggtatggatctaattaaccatatattttacgacggatcgatggagtataagaggaccatgggatatctaacgaattgaccgatgggaagctagctgcttgggtcgtcgggcgatcgtagctagtgtcgatggctcacaggtcacaaacaagcgagaaatgttgctacctcccgccagcgataataatattccaaattgcaaagcaacgtctctttctaccgcggagagtagtagtaggagtggtactggcgtttgcagcgagtgtgcaaccaaccagcgatcgactcgagtgtgcgcgcagcggccacttgggggcaatcacgtcgacgcgggcggcggtcgatgtctagcgaggcgtccgtcgagagcacgacacgtccaagttgcgtccccgcttgcgccgggcccacccgtcggggggtgagccactctcactctgtatcatgctgctgcatcttatgcacatccatcgatcctttctgtgaataatggctgctgtccaatccaatgatcaacttgtcaaccgatccaccgatggaatggaatggatccagccgtaggtgaggagcagtgttagagcaggtacagtaagagcatgaagatagaagagcagcgggctacagatttatagccagctacagcacatatgagaccaaaaaataggtaactattatatgaattggctactaaattaactttaaatgatttagagccaatagttggctataatattaaacttgctctattagactataagggtgcgttcgttcctgggggattgggtgagaaagcccatcgtattccgcgcgcacgcttcccaaactactaaacggtgcatttttttaaaaaaatttctataggaaagttgctttaaaaaaccatattaatccatttttaaaatttaaaatagttaatactcaattaatcatgcgctaatggcttacctcgttttacgtatcttcccaatcttctcaatccccttctcctcaaactcaccctaagtcggctacaagcttatgtggagaagataagagaggaaagagaagataaacggactacagatttataactagctgcgatacaaactcccaaacatgttgtatgtataacatgtgggaccaattattaatgatatagtatatatttatagttaattattgtatgaattaactattagattgacaataaatgatttgaagctagcagtactctctacaattaaacttgctcttatagtctcatgggccacacatcagtcacagatatgtgccctgcatgccaaggaaagccaattgaagaatcgagcgatagtcacgccgccattactcctagatttcaggacgtctctggctccgttgcggtgaggtactgaagccaggcatgcagccttctcctgctactccctccgttttaaaatatttgacaccgttaaaattttagtacgtgtttaaccattcgtcttattcaaaaaatttaagtaattatttattcttttcatatcatttgattcactgctaaatatacttttacgtacacatatagttttacatattttataaatgttttaataagacgaacggtcaaacatgtgttaaaaagtcaacagtgtcaagggtggcagtatccgttactactacagttgtgttatctccatccatcgcgtcgcgtgtgtgtgttgactgttgcgcgcgggagtattgttgtggataagcgagcgagggagcgagcggcggattggatgcaggataagatcggccgtcccgggcgcgggcgcgggcgcgggcggcgataccaaccaactccaacagtgactgctcctcctcttcctcttgctgcgctgcgctttgccttgcgttggcttggcttggcttcgtccacgaccacgcgcaggcgcagcacatggccccgatgagcgtcaggattggattgggtcgtggatgggaagtgcgagttggttcacggaaccagcggcgccaccgaaagctacgtccccccagcgcggacttccattcgcattgcaccaacaacttcgctagtattaaccaaaccgaaagcaacgagatttccttcatgggccgccaaagtcgaggctttatgtaggcccatcaagccctgccgctaactaaggtcgaacagcccagatctctcatgggccttgtaattcgccatgccatcaggccctgcatacaaggcgtgcctgggcttcactgcctcatgggcttcaaaattccgccaggaaatactgcatcccaggggccagcggctgagaaatcttttgagattttcctctctgaaagaaaattttactagtaactttgacaggattacataaaagacatcagtattctgctacagtagatgcgtgtgtgcagaatcctcaattgcctctttgctactacattgaattaccagatcaacacataaatatatatatacaagttgttctgcactcggccttatggacgaaagaaaatggacactgatcagccagaatagatcagaaaccttagctagccaggtattcaggggctgtttggttgctgccctcgcctggagaccattgctcaggcaggtcgatccgaccgcaggcgaccgaaatcggacgcctgagatcgacgcatgagccgggcgcgaatctgagggcagcaagcaaacacgccctcagatttcagagtggttcagcgattcagccgtgcgaaccatattcctttgattgattccatcgtcataaactgaacttgtcgggactcgggactctatatgttttaccctgtctgtcaaaagaccttcttgcactgccaaatatgcactttcagcagacatcactgtgttcaataatgcatcatggcatatcatcaactatatattttatataggagtacgtttataagcattgacagagctagcttatttgggttccggaaatattgtgcaatgatcgtttgtgttccttttctcttgataagagaaaatatagtagtacattagtttagttgcatgcgatggagagataaaattaagatagctacggagtatgtatcagtttcttctaatatattgacgtgctatttttttacgcgttcgcaaaaaatatgtatcttgtctctttctcgatgacgatcgaatccaaattggtactcattcacgcgcaaaatgagttgcaatcgagatgcgtactactccaactctcaagcaacaagcggaacaattaatgcacacaaaaagcaagatcagaaaaagggaagatcattgcaaaattccaactagcttaggcaccgatcgatgtctaatgtcttgtaccgtgcaaagtttaatgtaaaacccaattctccacgtttcttctccactactatacttttgttaccatttatatatcaccaatcaatccacttgatgatcaggtcagatgcataacaaattaaattatgtctgaacagtcctgcaagcagtactggtgcatatgcatcatgttttctgtactctatcttagcatattcagagttagatcgatagggctttaaacatatacatactggaaaaaaacaacatatatagtcaaataaagacaagatgcaattgcatgttgttatcgactaattaatggcttcttatagtctaacagctagtagcttacatctacaattcaggactagtgaaaccagtagtaatttgcttacacaaattagatgccattaattcgttctcaaagtaaaagaaagtaacactagaatactcaatactactcctactgttgttcatttcttgtatacggggatgatcaatatactgatgtggagcatgcatacatatgcagtaattgtatacgatacacacctgtgtgctagcgttgggcttcgatttaactcctgaatctggagcagcttgcggattgatcaaggcggcgatggaagaagcaagccggcaggcaagcgcgtccagcaggcaaaggatcgatcgatcaaggaagatgaggaggcggaagcaagaggaaaattccaaagggattgcactgatcgatcacgcacgtcgtcgtcgatcgatgaggcgatcgatcgagatagctagccagatcaatgcgatccctttggagtcctccactagtttcctcaggccgatatatatgtcggccggttgaattggcaactacgcgtagctaagctatcaggttgcacgcatgcattgtggtagctaagctatctaattaactctcctatctctagaattcaaagtgcatgcagaatgtttgttgcagccagctgctagctagctaggtaaacactaagctaagtgtatagtggtattatagttaggtgctagcctggggtttataaggaggtagctgagcctgctcgagtgcaatggcatggagatcgagattgatatagagagagataggctagctggagagagagagagagagagaggaaatggaaacaagcaacgctagctggaagagggaggcgaaagctacagggcaatgagatggagaagcggagaagcttagcttagcttcacagtttgggcgtgtgaagtgaaggcgaaggcgatcgagagagagagagaggttgatgggccggggaacacaagggcccaccacggagatgctagtgtacccaatgtctggcgtactacttctgcccactccaatgctgacctctctctctctctctctcctgctgctgctgcccatctttttatttacgactctacccctggcaatgcccgttaagtttcactttagtttcgttttatccctagttattatacaacgagaagaaattactgactgatccatatccatgtaaaaacagtcgatcacgagtgtcatgcatccagtcttcgtccatagtgaaatggctattcattgatctatattgcacatgtgttctttgtgcacagctaactgtagtaaaaaatatatatgtgtgtgtgcatgagtgagaagtactctcactgtttacatttattaatttgtagaatatatagatgtatacaatagtaattagcacgaaggatgttcagcagtttaaccccgacagaagccaatgaattgttttcaaccgctagatcgagtagctaggatatgaagtatatatccaacgtcgtaaccgcctagtttgatatgatctgatcgagtatatagcttgcgttgttcttaaaaaaaaagaatatatagcttgcgtttatccctaaggttttgaattatatctgtttcttaatgctgcgttctttccagaagttggagagagtttttcagtgcacgcgaaatgggaaatatcattaagatattattaattaagtattaataattatataaacttgaaaatgatttttttattttttaaacaacctctatataatttttttataacaaatacatcatttaacagtttgaaaagcaagaaatttaaggtttggaattgaagaaaacaaataagcattagtactagtactacacattatacttgaatgaatatgtataggtagctagcagctttaaatatttgggcgttccatagcatagcaaacactccatgttgcagttggaagccaaatagctacagctaggtagataagttaacagtacacgcgcgcgtgcgggggttacagggacggccgtagttcagttaatccaatccacagccacccggcgcgattcgtgtataaagtggcggggaattaaaacatatgagatcaattactagtggtttatattggagtacgttatttctttatttttttatttatatctaaaaattaaggtttataggatgttttttaaaaaactgtgggatcagtcaaccccacgaaaaagacctaaatccgtaacttgatgcattgttgttgcaagcagcatttggccatttcacacactgacacacacgcacacatgctagatgcacgactgcaccgcatgcacgctcaaatgcttgatcgatcgatcgatcgatcaactcgattgctggctacctacctacctaccgacttggcaggctgccgtgtagggccatatgatatgtacgtcgatctgaattcctgaacctgagacgatcgagacccacacgggggaacatcaaattgagctacagatgcaacgtatgatctactcccttaaaaaaaaaaggaaaattggaaccataccattataatgtccagatttatagttagaactagtttttttttttgaaacggaaagaggagtatgtatttatgcacagggcatttgactgatagacagagaagaaagatctggcaacaacagcaaaagaaaaaaaaccatccaagaaaagaagaaagattaattcagatgcatggtttgggtcggcccctcttgattgcactgccacattaggcatgcatatgcatgatatggggtcgatcaatgggttgcacatgcatgcaacttgctaaatagattaattattaacggttgggcatacatactacctccgtttttaatagacgacgccgttaactttttctcacatgtttgatcattcgtcttattcaaaaaatttacgtaattataatttattttgttatgagttattttatcactcatagtactttaagtatgatttatatcatatacatttgcataaaatttttaaataagacgaatagtcaaacatataagaaaaagtcaacagcgtcatctatggaaaaacggagggagtatctagtaggaccatccatcgatcgatcgattcattcatgtatccatgcaacaacaacgatatgcacgcacgaacgcatgaccctgcaggacagacaagctctaaacccacaattaatcataccctgacccagatagctaagcaagcttctgcctgactaattgcaccatcaatccatcatcaacacatacattcgttcaaaagaaaaatcaatcatcaacacgatcgagctagcattagcaatacctgcatgccctctatcaatacagtttgataaaaatcaacttcagctagacagtagttctaagtacagaatatttactcccttccatccaaagtttaacaataaacacttttagaatgccgattccaatacatggaaagtcaagcattttcagtcaatcaagtacttcaatgggacataaaagcaattcaaaaatcgaaatttaacaatgagagaaatcttacatattatccttaatctttactaaggacctataattacttacatttagatcacggttcatttttgcttaaaattttttaaaagagccaatttgtcaaaaaaaaaaaatttaccgtggaaaatagtaattgttgcacttactctatgagttactccctccgtcccaaaatatagctatttctagcacagtgtcttgtcctaaaatgaagctatttcttcacctacctcctctcaaccaatcacaaccattcttcttcacctaatttctcttttcaaccaatcacacacttcctccaatcattctcacctactttcttaatacccgtgccaacctcaaaaatggtttcatttggggacggaggaagtagtaaaaaaaaagaagaaacgagcaaggacaaacgggggcatttcggtcattacagtagggtggtccaaatacgaaagcaagcaaggtccaaaagggaggagcacaagtatgcaaaggcgaagagagagtcgctggattccgccgggccgtgctacagaaaacaacgacgtgtgctcaaccgttttgttcacgacctccggcctcccttcctccgcttgccagtgcctgcctgtccgtgtctggagccaccaaaactggacccagcacacacagtcataccactgcgaccacagcaaatatcggcacttcgatctgttcatatatttatttttgaataatttctcactagtatatatttggattattcctgcaatatatacagaaaaatctaaaatatcattgtactagtctaatttcaagaaatgttattaacaagtacgagttccacgaaatatcatcgtacaatcaactttgtcctacaaaatgtcattgttagggttccatctatcccgctcacttaaccaaaaactgctaacggaaccctaacgacaataacatttctagagtaaagtcatttgtatgatgacattctatgaaactcgcacttatcaaggatctctcttaaaattgggtgtttttttttgtattttctctctatatatactcgactcgagagcatatttctatgtcagccactgtacattggacggacggacacagttgccgtatggaggtttcgatcgtgctggaggcagcatcatcctttggaacagtgagcagcgcattaattctggatagagagttatcagagaggcttttctttttatccgttatatatactaaaaaagaggtttttcttttgcaagcaaagcaaagcaactagttggtgctagccttgccaaacgccatttcgatcgttaaactactgctactacttgcaactagaccaacgattcgacgacttttcgagatagaatatatccaagttaaaatggccgttggtttttctgggtaaattattttgaattctcagtgaccgccaaagcagaaaagggtgagaaggcttctggagtacatgcatatgtggtccacgcgtgcaaccagccggccgtgtcggcttctgcagtgcaagttgccaaacctaccaaattcactcaggatccggacactttttttctcccccatttgcactccattattttctctagttaattaccatgtgtttcttcctataatcatcacactagtatacctgttcagctacccagtccacacggtttttcatttgttatttaagtatcttaggatttcctatggtcatcaactcatgatgcattccaaattataaaatgtttgagaaagagagaggaagatgccacgtacggctgacggaatcagatcgtaggcgtagctggaatgctggctaggataggtaggcacgtacgggtatacactgtacaccagtacactggcagatggtgtccctgcgtatttgtttccgtatgctgtgtgtgcccaagggggggcccacgtggcaaaccttcgcaaagacaagcgtcatgtgaagtgtctgagcagcggagaggtaggcccaccgcgcccggcccactttggcccacaaaacagaaccgggcccacgcgctgtgagcttacgtcctcctgccctcctattgtggctcacgtgggcctccacgtcggacccatatgttctttcaaacttcttccccgccatcattccttctcctctcctctacctttcccactatttttaccaatttttaccattcctatgcagtgtattaaaatgaaactgataaacaaaaccaacagacaaagcagtaatattgatctagctacccatccattcttgagatattattctaccaagaacaaaagcattcctgcatattagtaaaatttgtcctggaaaatcctatgtggtttgaacatgaagcaacataatgtagacagctcatgtgatttggacagatcacttacccgcagaagacaggatttagtccggtctaaaatttctagaatcccacaatgagaaattcccatcccgccttttcgttttctcaactttcaatccaagacggtatctcctttgaattcctgcgttgcctacaaaagatgaggcaagcttttagatatctgcccttttcctatgttctggactgagtaaaaagaaagaggcaaaacagtgacatgattccaccttttgaaatgacttactcacagatggaaatgctccacttctagcccaattacattatcagggaaaatgcaaagttcttgcaagtcactaccactttgtgcagccactttgagggcactagttgcgaagaagatctccaaggatgcacgcagtaacaccagttagtcaaggtagatagagttgtttcctgtacatgaaaaagcaactttcaacagttccttcaaagggatggcaaaggtgagaaagattgaaggaacagcggaggaagatatttattttacagcatcaggtaggttggtgttggtattcgaatttttagccagatcatgcaaacaaaactataacaagtagtaaccaaatttgcctgacaaaactttctctgtttgaatcttctacacttcactttgtgttcaaattcttttagcaggccatatgctccttatttcttgattggaaacaacaattatctgcttgaacactgtggacagacaccgattcagaaacagtgcgtgcgagagtaacatttctttttttgagagaacaacatttcactgtggggaaaagctggccggctatttgcaccctacaattacttcaaaacaagtgttggggaaatattttgagagttccgtgtgaggactttgttgacgcagggccactgttcgacagtgtcacgttgctttcccagcttcaggaatgtacgaagaaacacagacagccatgcgtggtgggatttggacatggaaaaggacgttgaggacgattgattgtcgggcatttgatgaaaggaaacagaccaaaccaggttactgtgttttagttatggaaccagcgacgccttcctctaggatggaaatttttgactagttggtgccaagctaagtgctaagtacagggctagccggtggctactggacatccacaaaagcaattatattatgaaactacacccaagtgactttatgaacacaaaaggcaaagatgcagaacaaaaagctgatatccacatggtttagtggcatatatcagcactagtcagcattctgtcatgtgcactgaaacataagctaagcagcagcgcatccaatgtggagcattattagtacccaaaccccagggtgtataaatctatggtagcagcactgagagttaccttttcaggagcattctccccgtagaaaccatcaaggctggcacataactgagtgttctgaattctggtgctgaagaacaacaagaaaaagggcgattccagtccagatcatcaagctcccccaatgctgggcaatttatactctggagaaagtttctgctcgccacttgaaagtgccgatgattagatttatcggagccgcggtgccgaagcagcacgagtgtggagctgggatgattaccagctaactgatgcccacagcacagtgctggcatagtggacggcatggagtccagcacaccaaccagaaagatatagtcatgtcaggaagaaagaaagagatcgattggtcctaaagcagtgagatgctcgaatccaaaccagcaggcgctgtagaagcacagttgcatgcttggagaagttgaaagagatggttaatcaagcctgtgagctgtgaccatggcggacagtggcgatgcaattataggatgtagttcaccgcagcaacgggcaggcagggttgacagggtgcatagtgcaaccggagacagggtaactgagcggcatcactgcaggccggcattccgtcgaacacttggcgcgcacgcgccaagcgtgccacgacaagcaacatcacggagacatcagacatcccatggcgcggtggccggtagaggcctgagacgcaacagaaacacaagcatgtttgccccgccagctcacggcgaaatccgcggcgcccacgcagcatcgaagaggaagaggaagagcaacgccgcggattcgcacttccgcagagcgcgaggcggaggaggagagatcgaagtgggctgggcatttcctttcagttgctgacttagcataaatgagcttgaatcgcgcagagcccgtctagtagtgggctttatattcttcgtgagataaacgtttaaggtgggctttctaacggacagttgactgagcccgtgggcctatattgacaagtgggccaatacgcgttatgagtcaatcaggtcaacggattgctgttgttgcggttgaaccccacataatgggggaaggtaagttaacacgtcatcattgactaattgagtggtattttatgtgattattatgtcaatcagggtcggcagggatgatacggaagtccggccccacgtttttgcttgatttcccctgtctagatagacatctatgctaatttagctgtcgttctgaacttctgataaggtgtaaacaatgccggttggcaacttcgtcaagctcgatctcctcttccgattttgagaagaaaaataataaaaagcatcaagcaagtgtccttactgctactgctataactttaaggtcccattatttggctttttccctaataagccaaaacggcttattagagaaaaaaagtaaatttataggtaaaacttttatatatgtattcttggtgacttaaaagctaatgctgaaaaagaaactacgtcgaaaatatctcaaaaccaatcttaaaattaagtttaaaagtttaaaatttggttttttctttggcttattaggccatccgatgggagccttatacagcagcagtagtagtagtactaggtatgagaataatgaaaaaacgttgaactctgatttggtttgggagcattcgtgcaaccgccagcctaggagtactatacctcctcagaaaaatagctgttccttttggagatattgaactatatgccacttttagatgtggcaattaactatttgttactgtacccccatgtcatagacacatgtggacccacatgttattgagataggagtggcaaatagttaattgccaaatctaaaagtggcaaatagttaaaagccccgttttttttggtatacatggctagcttcatatagcttaataaaatccaatatgatcgactgatccgctgcatagcgatatactccctccgtttcaaaatgtttgacaccgttgactttttagtacatgtctgaccgttcgtcttgtgaaatatgtaaaactagatgtgtacatgaaaatacatttaacaaggaatcaaatgatatgaaaagaataaataattacttaaaatttttgaataagacgaatggtcaaacacgtcctaaaaagtcaacggtgtcaaacatttttgaaacggagggagtagcatgatgatagcaagcacaacagtagctgcacgacgaatcagccgctaacttatggtcctgctcttttctccaacaagaaatgaatgaatattaagattttcgtggtacgcttttcaaactgctaaacggtatgtttcgtacgaaaactttttatatgaagtttgctctaaaatatcatattaatatattttttaagtttataataattaaatctcaatcaatcaacgtaaaaaacttaattttcatcttcatttctgcaagaaaagaacaccacctgaaaatattactcctgtagtgatgcagcgcatcgcgggagcggacacgcaggttacagatcaaatcgacctgttcgcttttggctcagtggggcccgattaacagccgcttggcttgcccgccagttcagctctgcagcaccgaacggaattaacggcctggccgactccgatcggcttgcaacgaattatttgtttgtttgataaggtaaatcaaatattatttttttaaaaaataataaaataaattttggttcaaacaatgcaatagaatttagaatttcgttgagaaaacacatttttaaagatgtggagcacatgatcaaccgtctaaacactcgtcagcgacaaatactactacttacgttacgtgtaaacagcgaacttgattgggcttccctccgtttggttggtctggttttgccgaacaatcagtctcatgacctcaccaaagttgctgcgccattcacccccaaaaagaaaattaaaaataaaaaaaggtaagttgccgcgccattttctcttgtcgtaggttggcttttgacggatcgatcgatccatgccaatctcaacattcttttcgtttcttttatccacaggcgggatagctactgctctgctctcttccttgcagcatcgctttcgctttttggcagcttgatttatttgttttatggacattaattccggtttgtcatcgtcgagttaattaatactggtaagcagcaattttattgcaaagatgcacggccatgtacaggacgacttgatgctgcctgtctgaacgtacttacgtacatgtcgtagcgtgtacacatacagtacaagctaatatcggtcggttcacacaacgattttgacttttgtgatcgattgccaagtcagaagcatactgtattcgctactagtaacagtgatgtttatctagtttactatcatttgaactgtggtcaaaccaaacctgcagaaaacgcaagttggatagaataaaattacctgctggtttgttgtagtagcgcacaggcacacagatgccgcatatggagtatattttttatacgaagatttggtccccgcatatcgctcactcgcacgtactgaggctggcagaaagagaaagcgtccgagtctcttttcatcatttcgtctgccaacgcaaacgtgcgtgtgcacgagtcgagaacaaattaactagacttttctcatcatcatcatcatcagatgcaacctgctcctcctacctatagcttccaagttccattccagctcgtatatcagctagctgggagtatgatttatcaggagaaaaaccagtacaagcaaaacaaaaaatataaacatttagtacggcttttatactttttttttgatagatgcggtggccgtgtgtgtgtccagcccggcgacggcacgcagcggccggcgtgcggttactggagcagcacacgaactaccacgaatagtcgcgcttcccggtgttggaaacgcacccaatttggccaacttgcccgtggcgttttactgccaaacagcagagtaggtaattaccgcgcgcgggattaaattcagagctcgtaatcacgacgcaaccaaccccgttgtcccagttacccagtacagcgcaggcatgtcggtataaataaataaataaataaacaaatgatagtaatagttaaataactaattgattaattaataatactccagctgcagcaacggcaacgataatattcccggcgaaataaaccccattcattagcaacggggttgtagcggtattagcgaataatagttgctgcagcggcggccacccagccagccagcctcaaccccaagccctccaaccccaagagaggccgcgccgcgagagagagagagagatccaatccaatccggcccccgtctccccccctcctccacgccgcggcgccgctccggttgcttgctcaggttggagtggtcgcgccgccgccgccgccgccgcgccgcgcctctcgattcggccgcgcgagcagatccgagcacccaacggcggccgctgcgcgcgggggggttcgaattctgcgccgctgccgttgcttcgcgtctcctttctcagggtgtgctgctctgttcgcttcctgcaggggggcgggctgctgatcgaaatgggcgggcgcgtgtccaaggcggtggcctgctgctgctgccgctcgcagcaccatggagtcgtcgtcgagagctcggagaagacgggtgcgtgatatgcttctctgcgccttccagaatgctctatctatccatccatctatctatctttccccctttttctgctgctatttttggagctcgctttcccttttccagaagctgtgggcgctcgcgatcttactttttatttgtcccccgagtttgctctattttcgcctagatatggccattaattcgttaaattgggtcgacatctccgcatttggaacgttgttaaactgactccggtagccattaatctgttccacctatccatttggtggtgatatctgcgttattatggtcaaactatttctgatttatgtgcgcctgtttacatattatatagcgtttctgctagtgatttgggggtgctgattagttttgttagttctgcatcttcgagtgatttttggctgcaagcttgtggtaatggagtaatttgagcggaatacatgtttatctgtagcggaggaggaccatggggagtcgtatgagctgccggcctttcaggaattctccttcgagcagctgaggctggccacctcaggctttgcggtggagaacatcgtgtctgagcatggtgagaaggcgcccaatgtggtgtacaaggggaagctcgacgcgcagcgtcgcatcgctgtgaagaggttcaaccgttctgcatggcctgacccgcggcagttcttggtatcctattgtcttcaccttaatccttttgcattgctaacgatgtgcgtttgcttggtgccaatggtagttgggtacgtggtggttattgtgggaatggtagattctgttctatttataagtgcatgaattggtttctaggtttgggttgtctcttatcatggaggttgttgatgtgtacctgttcctgagatgatatgcatgcttgttctttacttatttggcttttgggtggaatatgatggcttgcagttcaaattgtggcatctgccaactgtttgcacaacatatcttttttggtatgattattagattccaatactaaacaagtatcagacagcaatcattacagctagtagcaccatcattttgtggattacatgtttgattgctacatcactccattaattgctatgtgtgagttagtgtctcagtaattataaacttactattacctgttgttaacattatgtatttttgactgcattagttctagctcttcccgtggacaatgctttatatgccttgttattttgctaactgtcacatgttaattcaccaccatgccatttgtttctgattgctattgtacatactattaaaatggcaagtatagaggttttcttccacaactttaagcagcccattttccatattgatggcattttgttgtgtgagtggatggtggaatctacttcctatttgttgacgcaactttttgtttgattacccatatatttttgtggtaaattctctaagatcatctaataatccttttggtggaaacaactatgcttcaggaagaagctaaatcagttggacaacttcggagcaaaaggttagcaaatttgcttggctgttgctgcgaaggtgacgagagattgcttgttgcagaatacatgcccaatgacacactagcgaagcatcttttccattgtgagttgccatgcatttcttgtcgcatgccttagaacttttatgttgctgtcatcacatcaattagtaactgggttctgttcatggttacatttccgcatcatatataaataggatatctagagtagcaactgagagtaaattggacatgctgctttaatttcttttcataacactgttcaccatgacaattagtacttgccacgtgagagaagactatatgttcacttcaaagactcgtgtactctgtattggagctttctttttggcctctaagttcaccaatgcatctgaacttttggggagattccttgacatactttttccaacaatcgaaactgcatttcctgccatacatcttttataatgtcttgcattattaatgatgcaataccagcaatcttgaaattgatgtaatatttcaaacttattattgtatgatttcccaggggaggcgcaagcaatgaaatggcccatgagattaagagttgttctctatctggctgaggctttagaatattgcaccagcaaggggcgtgctctgtaccatgatcttaatgcctacagagttctctttgatgatgtgagtatcatatagattgtttttgtaacgtgatcatctgtgtgttttgtaacatttctatgttgtttacatggcacaggactgtaaccctaggctttcatgttttggcctcatgaagaacagtcgagatggtaaaagctacagtaccaatctggcgtttactcctccagagtacatgagaactggttggtaccttcttacttttcaaacatcgtaaagcttaattagtctttctttgtgagtgttataatctgcacatgatctttctggtcgtctaataacgttgttgcataccctggtttgaatcttattatcctttaacctttaaagttagtagggtcaacttttctctggagcattccaatactacgtggtttgaaattatgttaaatttttgcagcattttcataacttcctacattggattcttacagtttgaaccgtaatgattttcgtagtgcttctatccctttaaatgacgtttggtttgattttagcagaattgtacatctagaacccccccccccccctcattgtgcttggtggtgaattcatatttggtcaattgtgtctaagttcaagtgttcaactgctgtaaaatatgaagtcttgttacttttacattacaatttgtctcactcactcttttggtttacctgcaggacgtatcacacctgagagtgtcatttacagctttggtaccttgcttttggatgttcttagtgggaagcatattcctcctagccatgtatgcctttgagctttatttcatctagcaccattttacacttcctgcttttgcatcctgtcatgactgaatattttttttttctatatgcatccttgaaagaagtttagcaatttaaaaatataaatatgtacatacaataataaaagcataaatatgaatcctaaatatttcatatatacattatgtcattcacaatgtgtcaatactacttatttgtttagacttttgaaggatgaaaaataatattctcaaggaatctaagtaaaagataaccttttctttggaccactataaggacctttatcgcactatcaaggtcattaaggctgctacttagaacaatggatacagcaataaataagacttggcttcgcatatcttcatcttcaacagactaactaatatgagtgcaaatatgacaggcccttgacctgattcgagatcggaattttaacatgctgacagactcctgtttagagggtcaattttcaaatgaggaagggacagaactagtgcgattagcttcaagatgcctgcactatgaacctcgtgaacgacctaatgtaagatctctggtgcaagcattggctcctcttcagaaggatcttgaggtgaatatctttccacttccctttctcactatggcactgttgagttcaggtctcctaaaattatgttgagaaaattacgccatgaatttcaatttgttctatttcaacctatatatccaaattagttatttctatatctaaactcttcatatatttagtccctccctaagctttccacgactgacgccatttatgcttgtgtacattttttattctcagcttgaaagttaatctatcaaaatattataacagggtgattttggcatcctcattggacttgaagttctataatattgtaattgcagtaatgttgaaatattttgcagactccatcttatgaactgatggatataccccgtggtggtgcaacatctgttcagtcattgcttctttctcctcttgctgaagcttgttccagaaaggatctgacagcaatacatgaaatcctagaaaagacgggctacaaggatgatgagggaacagcaaatgaggttttagttttttttcccctcttctttactttctttagggtttgacatcattgccagtatgatttgtgtggtcttttcgtgagaatctttgtttgtatgtcaatcttgatggagcattctcagaatttacaagcaagcgaatcttttctataaaatcatttgtactgttagtcctcatgggctcattgcatcttttatgtcctacctcaagaaatattgttatcgatggcatgctgattgcattttgcttttttagatgtctgttggaatacattttagtgtaagaattctcttcatgttcatttcactttgatcctagagcaactatagttgacatgattttatgctgatctgcttgtcatctccttagttccagtgtgttaaagcaaaatagtcagttggaaagtcaccaaatattctgagtgtgacatttacatagttgcagcatgtgacgatgtgaaaccagttgtcagtcggatattgtgagtagttatatacgtagttgaaactttgtcatgctgaatgatttagcaaccatcctcgttatattgttatgctgttgcatgatccattgttttccttgtttgctgcagctctcatttcagatgtggaccaatcaaatgcaagatacattgaactcaaagaagaagggtgacaatgcttttcgacaaaaggacttctcttctgcaattgactgttattctcaggttgattttgcatctgtgtttatattctatatgggtttgtgagaagtgtcaggagagttgcatgatcaaatgtaattagtattcaacatagtatgaacagttccatttaatctttttttttttaaaaaaaaagtgtatgtgaaaacaacaatttctggaccgtgtgactatctgtaaacaccatcagtccattgaaaaggaaaaacttttaatcctcacagctatttttgactttgctcccatttgttgtatgcagttcattgaagttggtacgatggtttctccgaccatttatgcgcggcgttgcctgtcatatctgatgaatgacaaggcagaacaagctctcagtgatgcgatgcaagcgctagtaatatctccaacatggccaactgcattttatcttcaggctgctgctctgctttctttaggcatggagaatgaagctcaagaagcaatcaaggatggttgtgcccatgagacaagtagcagcagtggacattgaatatgactgaacaaatttgtagttcagaaaatgcacataacttcaggtatatgcttctaacaagtcctactactgaagtaactcagtagcccaagtaatcagtataagttcagtgtttggataaatgtgatgaatttgactttagctactaggttaatcataaggttgtaaacatctttgtgcaatgcagtttctgttgccatattgtggctcataacactaacaccaaatctgctaccatatttggtcacaaatggcatttactggtgtagccattaaatccatcagtgccatcactcggaaaaaacttatatgcaacctgaaatactgttatttgaacttacttagaacaggcttaagatgttctatgaacaattgatatttggaaggaaaacattaatataagtgaggtattgtttgccatctcttttaattcaccgtcattctgcttgtggcaggtgttttggtgtgaacaatcattggacatggaagcagctgttgttcatttgtcaatttggctaggggtttctttaaccttgttctgatttgcacgtgcggaaggtcgtccctcgtccatatgttcatgtaggatgtatatatggaagaaagcgacagcagaggccctgaaagagattgcaaagacattgaaggtgaataagtcctgcagacacgacattgatgggggaagggcaaaacttggtcttggttcctcctacccaagaaaatgggaaaacgaaaaaaaaaaagggattgttatcaaaaggcgttgttgatgtacatgtcaatcttgctggtaggcgtgtaaacttgtacagcaagcgttgtgttttctccaggtcatttttcttttctttttggttttgtttcatatgtgttagcccccattggtatattctagagaaaatcgtggaattcttgtcaggcggaaattggcagtgttgaagggcttggttcatttgcaaatcttggacgggctcatcacccccggtccagtttaatgctgtgctgctcaatttggtactagaatataacggtcaactaaaacctctgatgtgtgcgtccctttgacgagtaaaccggtaatgccgcttgagcttcggtaagaactggagttgctggtggtcactaaagctgggagacggcattgctggtggtggcagcgtgatcgatcgaacggcaaacacaacgaaggtgtagagggcgctgccgcatctaaaaccggactgcgttactgtgttagctcgccacggcgagattggtagccggatcctgcacagacgcgctgcgtaggcttgagtttagtcagtatgacgtgctcgaaattcccccagcatgagaggctcaggaaaccgagaaagctgggagtttttcctagctcggcgctggagccaagcaggacagggtactcctacatccaggcttacggcaatattgcggctgccgctgccagcgcagcgcacaatgcacgcacgaatgaaacaccattctgctgcacttgcaatcgatttcggtacgttactactgacccaaagcttttgtttattccgtgtgtcaacgaacgccactagcgactagtgcatctgttgctactatgcccggccgcttcgcgtagcagttgtcaaccactcttaactcggcaactccgctttatctcgcacactcactctgtccacgaaccacaccaccctacccgctgcacaaacctctgcacaaaacttacctataaatccatctcatctattcatgcagatgcaactcgtgcacagctctcatctcgcagccaaaaccactttactatctcgcagccaacctgtagcaaaagctaatcaaactagctatcaatcatgagctccggcgagcctgccgccgtcagcatccccatccacgaccaccatggcaaggccccggccacctcctccgccgtccctgctgctgctgctgctgcgcccgccgcggctcccgcggtggcgccacgcaaggtcggcatcccgttcttccggcgcggcgaccaccaccgcggcagccggtgcctcgcgttcctcgacttcatcctgcggatcgccgccttcggccccgcactggcggcggccatctccaccggcacgtccgacgagacgctctccgtcttcaccgagttctaccagttccgcgccagattcgatgacttcccggccttcctgtcagaatcacatatcatcacacatccaactcgatcacccaaattaaccatcgattatgccattcaaactgatgatgatgatgatcggatgcatatgctttgcaggttcttcttggtggcgaacgcgatcgtggcagggtacctggtgctgtccctccctttctccgccgtcctcgtgataaggcctcagaccatcggcctcaggcttctcctgctcgtctgcgacatggtatgtatcttaatctaagcaatgaaatggtttctttggatcgatagatttggctcctgatgagaattgatttgatgcgtgtactgcagatcatggcggcgatgctgacggcggcggcgtctgcggcggcggcgatcgtggacctggcgcacaacggcaacctgcgggcgaactgggtggccatatgcatgcagttccacggcttctgccagcgaaccagcggatccgtcgttgcctccttcctcaccgtcgtcatcctcatgttcctcgtcatcttggccgcctgctctatccgcaagcgctagcttaatcatcttgctagctaattaaaaaagattgtgcttaattatacatgcatataatatttacgtttgatttctatctgcatgcgcgagcgagtgcgtttttattttcgaattgtaatcctcttctgtactacatgcatttctttacttgtgagcattggcattggcgagtgatcgagcagtagtgcattgtaaaagttcacctgtgcatctatcgtttcactttctttctttcttgtaaaagatcaacgttgtgtgatcatcgtgctctgtaatctgaattgaacagcttgtttaaaacaaacattctgttatctctggtgtcaaacatgtctaataaatatcttattttgtcggcaggttcttttaataatgtcagatatggagtagtcattaatatatgaacacaatgcgcaactcaacaaatttatatagtcttacggatattttttttataaactagcataatattcatgctttgctatggataaaatactcatacttatttgaatatatgtgtactcacttgattaaaaataaaataaactactacataatattataaaatatcatgaaataatttgtacaacatgcaaaagcaattatgttgggctgatgtcaaaatcactgcaactgctattatcttttatatatagtagtattgattcagtcttacctattttgttttttttaaactaatataatatgcccctacattgtaacgggccatgtccgtataagtgtgaccgggataaaacatttagatccagttgttacttacttacttacttgtgctaagtgtgtgggcgcgtggtggaagaaggggatggaaagagaatgactccgtttttaaggtagggtaagagcatgcccaacagttttctaatatttaactcccgaaaattctaaattaggactatcaaaataaaaattaggctcaacaaccactcccttctccaagagaaacctaaaaattaaatcccaataatttgttggtttgccacataagtatggtgggaccacttgagagttgatcggcctctcccctctccatgtacgaacacccgatactcctcttcccctgcccgcaggcggagccgcctcatagttcgtcgcgatcggactgctgttcttatcttaatctgttgaaaaacgaaacattaagagcatactgtagctattcgtgttatcaaggaggtaatcccctagccaatatcattgatccgttgatccctagccaaacgacaagttgttgatcatgtacagctcttctgccgcaaaaaaactgataactgataaatgcatccagatttatttcaatagcaatcagtagcaatttagcagcacttcagcatcgtttcagcggcatttcagaacagttgcagcaatcaacattttagaacatctgcagcaatcagcagcaggcagcagcagcatttcagaacagcagcaacaatcagcattcagtacagcaccagtacatactccacagcacatacccacgaaaaacatcagcatatacttcctgctaatatttactcttatacagttatacttcctgtaaatattttcgtggtctctctctctctatatatatattaactggtgcaccatggagcccaggctccaacttaatccaccgtccatttgctttagaatgcgtgctttttaaaaccagaatattgaacgaattagtgggtttaatccatttaacccgttaggaaagatttgcatcaggtaccattccatttttaattcgcattcatgtatttccaaaggacgtacggattttgaatgtcattatgtttctatatcatagatcgtccaaaaaatcagccccgttaattacgttgaattgatttcttttccatttatatgaatttttctttttttttgcacgtatatatataaaccatccaacgatactcaaaattttacaatttaattagctgcatgcgctccgccggccgggagtacttctaccctcgttgctgcgagcttgcaccatgccgggacgccgccggtcgtccgcgaggttcatcgctgccggttcgtcggcgaggtttcgttgccgtcgccagtcgctagcttcgtcgccacgccgtaatgcgccatcggttgtctgtgagattcgtcgccggcaccccggtcgtccgtgaggttcgtcgtcgtcactgccggtttccccgtgaggaggttcgtcgctgccgtcaccggcgatgacgtggtttcatgtgtaatttattttaatctattcttatattttggcgggttccggctcaactgttttgcaggttgagtactgacaattttctttgtttgtcaagaccttaagacggtgatggatcctactaataattaagttgttggttcatcctcctatagtgatccaatgactgtacacgtatgctgccgcaggatgatcaggagaagatggtcgtaggaagaagaagcactagttggatgcacgcactaggagctagtaggctgttattcaaattaacttgaaaactaatttgaatatacaataattctagagtatacaaaaaaaaacttgtgtcggatacctttgatcgcatctatatgaccacagatttttctagaataagaaaaaacagctagttttaaacatttgtgttaatcacttatcactgatcactgaaagaataataattttaaatgtgaagcactaatattaagacgaatagactcagtcagacaggtttcaccacactcaactcgcaaaatatccaatcatactttcgaaatttaacggaagtttcaaagttccatggttcaattgcgtcggcattaggtatattttgtcgcatacttaattagccacagttatataacgaaaggatttttcaaactactttctccgtttcaaaatgtaagtcattattctagcatttttcatatttatatcaatggtaatatgaatctaaatagatatatatgtctatattcactaacataaatataaatgtgggaaatgttaaaatgacctacattgtgaaacggatggagtatgctatactgatgggaagtgctagttttgcatgtgtgggagatgctatatatacagatacacgtcaatacatacattaactatactaggcatagaatacccaatctgtagtacttaaacataagtttccacattgactaaatttacccaaactatgttattttttttcacgcgcatttagacaggtgcgtacccaactagaaatgggtatttttccaaaatatgcatttcagtgggtatatgaacgtacttcaaatcttgatttcctggaaccatgaggtcccaattcatcatccttgcccaatttattagtttgtactctagaatatattatacctagtttaataatatttcataattgtgtgtttaaaatactcttaatatccatgttcattaaaaaaaattattccacggtcattcaaattaatacgaagtattttggtactatgtatatactccctccgtcccaaaaaaaactcaacctcgtactacgatgtgacacctcctagtacaataaatctaaacatactctatgtctagatttgttgctttttttttgggatggtgtatctactatcccactattccataaatatcagaacctaaaattcatctacatgggcaggatatacgtaccacacaaggcttatatacctacatctacatctggtcagctacctagctagagtagaaaaatacttaactaaaaggcccagcaaatttcaaattcagttcaagaaaaaaaaaagcttcatgcaaaattgtgtgtgtttcagatgcatttagataggtatatacctaattaactagaaaacacagcacacagggcttatacctacatctacatgtaactagttacatctggtcagctacctaactaaaaagcctagctagtttcaatttcagttctaagaaaaaaaaataagcttcttgaaaaatcaaattatttttcacacgcatttagataggtatataccaactagaaatatgtatttttttccaaaatatgcatttttaagggtatatacctagtacgtgtgtttaaaccggtatatactcaaatagaatcatgatacgtcacatacctacctacatctacatctggttagctacctagctagagtataaaaaatacttaactaaaaggcctagcatatttcaaattcagttcaaaggaaaaaataagcttcatggaaaatcaattttgtttcaggtgcatttagataggtatatacctaattaactataaaacacaacaaacaaggcatatacctacatctacaagtaactaatttgtcagctacctagctagagtagaaaaaaaaacttaactaaaaggtctagctagtttcaaattcagttaaaaaaaagctttttgaaaaatcaatttttttacgcgcatttagataggtatataccaactagaaatatgtattttaacaaaatatgcagttttaagggtatatacctagtatgtgtgtttaaaccggtatatacccaaagagaatcattgatacgtcgtcacacatacccaatataccggtatacgtgtttaaatactaaaaaatatgcgtgctctaaatggtatattatacccaattaaatggtacatctaaactgcatgcatgtacgtacctagccgcttggtagtaagggtgaaaacaggacgggtatttcctgcttgaccgcccgaccgtattaattcggaacaaatttggctcagaaattcgggtacccaaaattttatacggatatagggttcgaatacgggttatttttggtggatatgggatcgggttcgggagcgcagtattcgacggatacggaaatacggatactacccgaatatatatacggatagtacccgtattacgtagtctgtacaaccaaccaaccagatttgaggcaagctagccaaaaagccaacaactcaggcccaaaactcaccggcccaatagtattgttaacccgaggaaataggagagagatgaggagaccgagtggagtgattgttcgtctgttcctattcctgggcggcggcggcggctcctggctcctgccgtcacgggctctcggcgacggcgtctcctcctggctcctgccgcggccgcgcccttgcgacggctgccagcagcgccacccacgccggcggcgccgctccgtcaccgcgccggctcccacggtgctcgtcaccaccgttgctgcacggcctgcgtcggttgccatctccgtcgtgccgtcctgccgtgtgcaggcctgccgtgacagccgtgtgcgccagtcgtcgtctcctactgatgatttgagtgtcttgtccttaaatatggtttacgtgaaatggtttgtgttttctggttggctcaagactcttgtgaaatggtgatgtttcctggttggcatttggcaagacatgtttctgagtattatggtattatgtactggagtactatgtggctgtgagcctgtgactgtgactgtaatgactataagtctccgttatgaagaattggtgatattttggcatgtggctgtctgacgtactgtactacttttagcttgtggctgtgagcctgtcacgtactgtactactgtgtcttgtttcctaagcccctaatgacctaatataatcgcattatggatatatagatttgttgaatggttattatctatatggtatttatgattgtttcttcgacttgatatccgaataagtatttgtaaccgagagtgtacgtatccgtttgggtatgtattcggcccatatttttgcccgatattatccgaacctatatccgtattcgacactatccgtgtccgacccgattccgattataaaatataggttaggatatgagaagggtgagatccgacccaatccgacccgatttcacccctacttggtagtacatttgaaatgcatgcacgttgcatacccaaaaatttttggagcatcttcttcaggttcatcgacacaaattaagaaggtccaccttacttttgtaagaaaaattatactaccgaaaaaagtccatactaaatggaattgatttgccataagtactatatcaccaatattaagaaacattttttaaatatggcatatccgatcatatgcattaattaaatatcattatcatcccataattaggctattgtatctgacagcttttgattcgttgtcaccattccatataagaaatcgttactgggtagacccgttaactttcatactcacatcaatcgatctgatcagagccaaatccaacggtatgtagcattggtgcccatacactatatatatatatatatatatatatatatattgtgaggggatctagtgcctggttctcccaaaccagggaggctggctggtcccctctgtcctctgtcgcctgaatgttggaggacggcggttgagcgggatggggaggcaccaacccacagagaccatacctgggtgggcgcgacgggacaccggcaccccgaatcgaggcggcgccggcgacgctacctgcggaagcggtgacggttgtcctccgcctggatccgttgaagaagtgaagatgcagccgtcactgccatagcatgcgccgcacctgcgaagagcgccgactccatggaagctagggagatcgatgcaggcattccagctctctgtggagaagagaacgccggcgacggtacagatcaaaccagcggcagatgagggcgcaaagagaaagagctgcgtggaaacgtttctctgcgcgcgcgcgaggaggctggtttcctgtgatttcgctgattgggggatgaacggacgcccctacgagaaaccatgatttgggaatcataactattgggcccgaggatagggagactgttggattagatttttcaataaaaatcccctaatattaagattgggattcatttagcaaatctgttaggcatgctctaaggagatataaaatcagaattacaggatgggccgaattgtagacgaaatccggcccacccgggccagtccagttgcggaagtaggacgcgcgccaaataacacgacccgagcgccagatagcatcccaaagtcgagaacgagacgagacgagccttatctccaatccggattacacatcgcgtcgcgtccgcatccaattcccgggccattcgaaatccccaacaccagtagccggccgcggcatgcagttcctctcgctctccgccgccgccgcctcctcgccggcggccgccgtcctcccaccgaagccattcaaacccctctcctccgcggcccccttccgtcgcccctccccgcctccgccgcctccgtccccggtgccctcacccgcgccaccgccaccgccgcatcgcccttctccttctcctcccccgaaccccctctcctccaagctatggctgtccagcaagctctccccgccgccccccgagacactagagcagccagagccttctactactactactactactaccccgccgccgccggaaccggaggcggaggcggaggcgcggcggcaggaggaattccggcacaaggggaaggtcttcgtcgggaaccttccactgtgggccaggaaggcggagatcgccgagttcttccgccagtttgggcccctggagaaggtcgagctcgtgcgcggccacgacgatcccgagcgcaacgtgggcttctgcttcctatactacggaggcgacgacgcggacgccgcggcggagcgtgcggtggaggttgacggggttgacttccgtgggaggtcgctcaccgtgaggcttgacgacggcaggaaagggagggccagggctgagcagcgggcgcgctgggtgaacgacggccggaggcgcgagccacggtcgccgtggcacgagggcagggacgaggcgtgccgtgagttccgcagggtggtggaatcacggcccgacaactggcaggccgtcgtctctgcattcgagaggatacccaaggtgtggcttctcatctcaaaatctattttctgctatttccggtgaataataggacatcaattgcatattatgtattttttttgaaaccaaaccaattgcattgttataggtgtacacgtgtgtgttttcaagaatgcaaagcaggtgaagtttttctataagtaattttgcaggaagcagtaccgttcgcataggagtcctacaaatgtcatctgtatttcggaatagggattaatgtgccactgaataggcacatctttattatacaatgcatgtttgaatttacatgttagcaaacttgtcatgaaaattgtcatttcaatgccatcttcagctgtctggtgtagttagcgcatacttccctctttgtaagcaaagttttggatgtcctggatcttacttacccatttctttttaaaaaactgctccatgaggtaatattcattacacaaataccagatgcttcatcttttcctattagatttgatgctaattcatgtagtcaatatatcatatagttcactagttcagtatatttgttattttcttttagataatggatcctttattgaactcattaaatcacatcgaggtgatacaattgtcctcccgacctttgcattataagttataacttttcttgagaataggtatacaattacttcattgagatttctggttagtgagtgagcaactatattttttcgaataaaattataaaatgtgccaattcttaatgttcaaaaatctctacattcatggttatgtgttcacatcttcccaagaaagttcaagtgccacaggagaaaaaaacaggtctagctgatgcttattgaatttattgcattgaagatagaggcatctcataactcatattaccattagtacattgttgtatgcaatgcattgacacttctatcttgatgtttcagccatcaaggagagaattcggtctgatgattgtttattatgccaagcgaggtgataagcatcatgctcgtgcaacatttgagaacatgagagcaagaggaatagagcccaatgcatttgtttttacaaggtaggtttattctttctgctatttgcaaacgttttgttgctgttcttttccaatcatggacaaactggtgtaggataaaatgtgtagccagaggatttgtgtaaaaaaaaaacaaccctgaaacagacaggctacagaatttttactacgtaaagataagaacttacatgagataaacatcacgagggaactgaaagaacagttggtaaggaaccttacacagaatcagactaattggttccttggatcctggtttgccagcttgagataagaaaatgttcactgataaaattgttgacatagaaagccatgtaactttcatggtgtaagcatatatggtgcaactgtttatgcctggtatgttagctttagcaaaatctttatgattgctctaattgctgcttgttgatttgcctcctgcattaaatttacttcatttcatgcagccttgttcacgcttatgcagttgctagagatatgcgtggagctctgtcttgcgttgaggaaatgaaatctgagggtcttgagctgacaattgttacctacagtatccttatttcaggattcgccaaaattaatgattcccagtgagtattttctgctcattgactagagcctgttctacgtactactctcacatgctttgttcagaatgaatgatagatctgttatagctcttttatgcgtagcatattctcattcagttttaaacatttctctgtgcatttggccacttaaacattctctcgtctttcttggcccaaggaccctgactttttgctaatatttttttatcttgtttgaaagatctgcagataacttgttcaaagaggctaagaccaagcttagcagtctcaatggaatcatatatagtaacatcatacatgctcactggttagtatttgtcagatttataaacctcttggaacttaacactgatatgagattgatttaacactaaagtacctgtacttgcagtcaatctggcaatatggaacgggctgaagaactggtgcgtgaaatggaagaggatgggatagatgctcctatagatgtatatcacagtatgatgcatggatataccatcattcagaacgaaaataaatgtctagttgtctttgaacggcttaaggtatagtggaaactgtcttctcatgggtaaccgatctggctttcttatatttctattaagtccagtttggtcctcaatccttcttgtggtctaattttcatttcatggccagcttcaagaccatttagtttacacaactaaaatgccaaaactggtacaaataaccccttgtattcaaatcatcgtgttattatcccattttactgtgacaaagacacattgacaacttgaattaccattgaggttggtgagtcagcacttttttttttttgagcaagggcgactgcccccatttctattacccgaaatggaacatagtagtttacagagtgcaaggaagaaagacatgaagaaacagcataagggctagaaaagacaacaaaaggaagattacaggtttctcattcaacaggaattccacaccaccgtgcatatgaccctccatcaaccgaagccgaaagcacaaaaacaacccctcaaccatagcaaaagctcttctgacatcagtatgctgggccaaaccaaaagaacatcaactttcttttgtgttcctgaagccatgtaccttcatccttccagtcttctcgtcctagtgtaccatccatacttcgagctgaaaacatcatttgctacctgccttattagcctggctcccagaagcaacttttcttgatttgcctccaacatctgcagcacagcccaagtttcaatccaatgacaagtcaagtaaactacatcaatgggatcttaaaacggatgggacctgcctgctgtcctgttctgtttttgctccttatctctccctccagatctggtaatcttatatctccaggatccaagtttctttcagattccgtcagttagctattgtaaccagtcccttggccagacctcacctctggttttatttggagcaaacgaaagtaccaactcaactcaaagatattttggaattcatggctggtaatcaaagaccgattcaagttaagaaattcatttctggattttccagatagtgagcaaaagaaacaatggggcacgacaattgcaggcccatggtaggaagcatagcagaagctgtagtagggccaggagcagtgaagtgagaagcttatctgccctgattctggcagcagcaacaaagtgccagaagtccaggagtgggtgagaaaggagaggtgggaagtgggaatttctggccatggtggtgctgctcagccagaaaccttagtggtgctgaccagcgatgaaagtatggaactaatgtgctttgtgatcatattatccatggaagctacaagaatgaaaccacaccctttcctctcattaatttctgtatgttccttttaaatatgcatatgcattgatgtttaggtgtatgagtatttttttgggaaaatgacctatctgcatatcactgcattgcatatctgtacagtatcggagtatctgggaaacacagatgatgaagttacttgatctgtggatacaactttgtatcatcgaggatggtgtcaaggaaatgaggaagagaaaaaataagcatatcgctgttatcgggccacaccaccctgtggactaaaatggaggcggttttagctcagggatgtaatttgcacctgttttgatatttggaagacctgtgataaatggttctaaagtttaagggtgaaatactgaaacgtaaaattagactacaagaggagttgagggaccagagatagatgtattcataatttttattttttctatctccccttctgatctgatttttcctgttttttgcaggagtgtggctttaaaccatcaataatctcttatgggtgccttcttaatttgtatgtcaaggtaaaagtaattctgttgcgtgctttcttgtcagttttcctgtaattttgtgtgttcccttagtagaaggaaacaaaaaattgtgcatcccagacaagtgtttttttccctcgtaaattatgatgtttaaacactcctttctgcaccattgatttctattcgttatatgactagtattctgaatatctaagagtccttggattcacctttttctgaaagcctaaggcaagggaagctttatgtcgagtttcttatacattgaacatgacaatcttcaactttgaaactcaaacctgcccctttattattaattgtaagataggttacttgagacaactcttaacagtgatcactgatgttgctctggtttcttttcttttctcttttcagataggtaaggttgccaaagcattatctattagcaaagaaatggagtcttgtggcatcaaacataataataaaacatactctatgcttatcaatggatttatccatttgcacgactttgcaaatgctttcgccatatttgaggaaatgctaagatcaggtctacaacctgatcgtgccatatacaatttgcttatagaggcattttgtaagatgggaaacatggatcgtgctatttgcattttggaaaaaatgcagaaggaacgaatgcaaccatcaaatagagcattcaggcctatcatagagggatatgcagttgctggtgatatgaaaagtgctttggatactcttgatctgatgcggcgaagtggttgtgttcccactgtaatgacttacaatgctctcattcacgggctagttagaaagcacaaggtatttttcaagtacatgctagtttcttcaaatctaatcctgtcatgtggcatttactttaaatttgtgtttataggttcaaagagctgtctctgtgcttgataagatgtccatcgctggcattacaccaaatgagcatacatacacaatcattatgagaggttatgctgccagtggagatattgggaaggcttttgaatacttcaccaaaataaaagagagtggtctaaaactcgatgtgtacatttatgaaacattgctcagagcctgttgcaaatcagggaggatgcagagtgccttagcagtcactcgtgagatgagcttccaaaagataccaaggaatacatttatatataatattttgattgatgggtaggtgttctagataagctctttagccaatgtttttactgactagtaacgatctttttaccgactcagtactcagggacgcttgtgaccatttatttatgtgttgactgcatcgaactacttagtcaactgctgtactgactcagggatacaagaaagtattatggaaaaaaataatatagggggtagagaacaacccctcaatatttttagtagaaggttgtggttgaacctgtggagggctagcacagcgaactgtgctgttagccagtaggtcctaatagtctcctcacatgaaactattatgatatttcattggattagtcatacattagttttgaaaatttgtattatatactgagttcatgttttatttgagtcttgctgtaatttatgaagttttataaaagcggtatattttcctttttgcctgtttcgtcacaaatccttttgtgtagatgggctcggagaggtgatgtttgggaagcagaggacttgatgaagcagatgaaagaagatggtgtccctcctaacatccatacttatacctcctatataaatgcatgctgcaaggcaggagacatgcaggtacgagaattttgcattggaatacttagtttcttacttattgtgagttgtaaccgtgtagtggagatagcctgattttgataggatatgtgcacatgttttaaggtagctgaccaaaatattttacaatgccatgactatatgcccgaattatttcagcactacagatttacctaggtggctacatattcaaatttggcacttgtgaatggagaagtattctcttggggccttcttgtaatctatccaattatttttttttataaaatgatttgtttgtagagagcagaaaaggtgattgaagaaatggtagatgttggactaaaacctaatgtcaagacatatactaccttgattaaaggttgggcaagagtgtcacttccagacagggcattgaaatgctttgaggagatgaaacttgctgggttgaaacctgatgaggcttcttatcattgcttggtgacttcacttctgtcaagggcaactgtaatggagggaagtacctacacaggaatcattagtgtctgtagagaaatgtctgagaatgatttgactgttgatcttcgcactgctgttcactggtctagatggcttcacaagattgagaggactggaggggcactaacagaagcgcttcagagaatatttcctcctgattggaattcattagaatttttaggagagccatccagttctataagcatgggggagtctgatgattacagtgattcagattttagcggtgatgaagatgaggatcataatattgatgatagctgaaaaactctagattccagagcctgtttttcttgttctgtgccctcactttttgtcctttggttctgccagagtggatgaccgaacaaggtattatgtgttgaactgttaatatgtgtttaatatgccatttccttttggtgatgtttctaaaaagcacacataataattcttgaaaaggagtctgccaacaatcatttgtcattactcattgccactttttggagttcctggaaattgcattgaactaacactctttgtttccatggcagcaatgtctttgatcaaactgtgccctcacattcagacaccagtggcttgtggactatccaagagcgtttggaatcttatagtgcaataagcgtgagctggctggcctctgctgcgtttcttcaagagcaacagtcagtaacagttctactgggactgaagacacaggctgtcaatgcaacagacgaagcttactcagttatgcgtgtagctgtacatatcaatggctggcacaggtaaatattcttgagatattgacagattcaattgttgtttctctccatcctttcagtatagtccaacttgatataaaatccaattccatatatatgtgtataaatgcaagtaaagctataccacgttaccagttaccacccacaccccttcttggcttgccttttgtagtgtgccatgtgaaatgtaccgaccatgatagagcctgcgtgcccatttttcaacatccaaatgttaggagtggtaggagcgcttataggcatatgcttgaacaccactttgattggcagaattttgtaggggcagcacagtgtgcctacaaggtttggttttgtaaccacatccctggacaagccgttcgatgcttatttgaatactagtacgacaaaccaatctgtgtcgtggtgctcgtaaaagctgagatcatttaaacttgtaagtagaaagttggacgagcttttttctcttcgagagaatgcacaggccctcatgttctttgttttgatgatcttaaaaaaaccatagtcaaggtaaataggagcaaagattggtatcttgcacattattgcgggttgggcttattcaatgggggaattccctattgaaactgaagtacaagtccaatcaagtgctagatgatgactgttttctcatttaaggtttggcatcttccagtacagcagcttcaatcaaatgggccttaacgtagctcagcccgattcaatattacttggaattgcacgcctctgtccaagctgaaagcttttactagtaggacacttgaatgcctgcacaagacggcattaatgctgtgcttatgagcccgatttcttgagactggtgttgagtttgtgcgtatgtgtgtgctatgagctgcgaatcttagctggccggtatctttcattgaatcgaaagtggcctccccattcaagtcttgcccacaagataaaacagtgcttcatttatgcctgttatttaattttgcttagctgcatctcgcttctccattcatacaccataaattctttcaaagaaatcttgattgtattagtgttgtattaggcctttgttcggagagaaaatttcatagtaccaattaccccctccatcccaaaatataataacttctatcactaagagtttgttccaaaataaaataacttatccaccaacattctcttcctaactaatcataaccctgcaccatttaatttttccatctacctccacttctcaaccaatcacaatatcatcat

SEQ ID NO: 13758 - DNA, 3013 bp, Oryza sativa
gttttttttcatgccaaataattcagtgtgatatttgggaattcatacagtattccttccttttatacccactctagtttcaaatacttgtcactagttactacttactactagcttttttccctaaaaaagttactagctttttagctttgatcactcgccctttttgcaaaaatgaaacatatgtatacttaaaatatgttgcattagcgatgtgtgttccataaatacaaccagacaactttcactaataataacttaatctttaaaagttattaatggttaaaggtgaaacattatggttaacattgacaagtaaataaagatggaaggaatacatattttctaaagataggtacggtcctacaggctttgtccagcaaaaaaaaaaggacagttctgcagaacaaaaatattttggtggagtttttaaacattgcatccaacagaagccttatggtatattttttttctatgataagagaatttattctggttttttacttaaaagaagctgcaaccaattattatagaatttgcagaatgaatagctgcggattacaaaattatgaaacacaaagtagaaaactactaagaataccacccttaaaacaaagatctacatctatggttagtcagaggggagtagattctaatccctcgaggggatatcccttcgtatatctttttcttccaaattcgatgcaaatagttgtgaaaaattctgaaaaaaattgacaacgtagagtataatgatacctactagtccaccaaaattcatgttcaaattcgatctacacatcgagaaacaaaaaagacaaatttagatataaacagtacgttactattcatacgctgaatttgtcttttttatatctcgacgtgggagttgagtttggacttaagattttgtgaagttgtatatatgtgttgtatgaatgttgtcaaatttttccagaatttttcataaccgtttagatggtttttgagcaaacgagcgaacatcccctcgagggattagaatagtttcccttagtcagagtatgtttaacgttgtttgctccaatggttataagttgtacagtctctgaaaccagcagccgatctttgtcgatcgaatttcgatcccatcactgccgatgaactgacattgaaccaaaacggaagaagccttatggtatgggtggagaatgaaaataggaaagagacaggaaacatctttattcctaaactagtactccctccgtcccataatataagggattttagaggtatgtgatgtttcctcggactacgaatctagatcacatccctctaaaatcccttatattatgggatggagagagtaacaattaataggaaatgacacaacaggatagcagaaactgaaaacttcctttcattttctggggaaaaaaggggaaatttgacgtttggagctcatctgtagtggagatttaactgttccaaaagtttagaatagtggcagctatgttgatacagcactatgttatcttttctcagcagacgtgctggtaaaaaaaatttagtgcgaagggaccattgctagttggcccttacttttatattactgtaactgatccagaattaaatttctacctattttctttgaaagagcacgaaagcacatatcaataattttggtaatattattcatttatcataatctattttgctatacgctccgaccactgcacaatgacagtatttatttcgcagagaggccaacaggagctataaaatgatgttccgattgctgttaattacctggaaactgtactgtactgggcgagtgatgaaggtaggatggaagcgccaagctgctgtgaacaactgagggaaaattcaggtgtaatttcctctctagtctctagaattacaaggcaaggtatatatttttaacgtttttgtttatgaatagaagatgagctatgcttagattatggattgtatagtacccgcccattgaggctgggctgggtcctccagaatatatacccctgcatgtgtcactgacatcatttggtcgacatgatagaaatatttgggagcaaaccctagtaagtgcactcatagtagggtataactaatactctatttgtataaactataaagaaatgcaagtaccacccgctaactgaattagtaattgctataaggagttctcacgtttatttagccacgtgatcatcaaactgagccatccattggacagaagtgtctgtgagatatcaatggttagtatatgattgtcagtaaaggggttctatcaacgtaactatatacaggatgtgatgatctctagccacctgtaaatatgttttgcaaatactgtactcctaattaaagggagttagctgttgtagcattcaagtcactggtggagaaaccatctttggtcggtcggccgaaatccacaatagtctcggttccactaaaaaccgggactaaagatcatctttagtcccggttgatggctacagcgggcatatttgatctttagtcccggttggtgttatcaaccgggactaaaaataatctttagtcccggttctaaacctatcaggccttgtcaggccccccgggatctttagtcctggttggtgttaccaaccgggactaaaaataggctctttagtcccggttggtgttaataaccgggactaaagaacccgaggatagcgcacgcaccagcccacgcttctctctctgaaccttgtgcatgcgcagcctctctctccacccttatctctttttattttccttccttatcttcatcctctccatccttctccttccatcctccccttctcttctctcaccccctctcctcctccccttgcagaggcagccggcggcggcggatggaggccgggcgcaggctagcggcggcgggatggaggtcgggcatgggctggcggcgggcggccggtggcggcgggatgaaggccgggcgcgggctagggctggcggcgggatggcggccgagcgc

SEQ ID NO: 13759 - DNA, 8207 bp, Oryza sativa
cgccccccccccccctcccctagatccggccggatctggagcggcgggatgggtggccggccggcggcgggatgggaggccgcccggtgagtcttttttttgattttttttatttgtggtttggatgtttttatctgtgattgaatgtatgaatctgtgatgtggtgactgagtatgtgactcgatgttgtcaatgaacctatgaatcaatattgtgaatatatttgtgatgttgtgaacgaatatgtgaatgaatttgtgatgaatctgtgaattgtgctgtggagttgtgatgtggatttggggttcaatttgacgatatgcataccactcgattcggaagaaaataaaaaaaaagcagaaaagaaaaaaagaaaaaaaaggaccagctagactgccgctaccctctctttaatcccggttggtgttaccaaccgggagtaactaaagatcgatttttagtcccggttttttcacccgggactaaagatagcgatctttagtcccggattggtagtcccgggttgaaaaccgggactacaagggggttacgaaccgggactaaaaagcacttctccactagtgagtgcaggcgccatgcatgcatatatgcatgacatggcatgccttcccaatggcacagcacagcacttatatatagcggtgtcggatgagatggaggcgcaccacactcattctcccacaagacaaacatagccttctctcttcctgtacccactcgccattacacagtgcgtcctcctccatccgtattgcactccccctagctatagctatattactcaccttctctctttaagcctgtctagtaggagtagctcgttagctacatataggacgtatagctaaggtttggttagcttggttaattgttagctggtgcgatcgatggccggcacggcggagtcgccggcgagctcgtgcgtgtcgtcggacgcggaggaggaggcggcggtggcgaagccgatggtggtggccgggtgcccgcagtgcctcatgtacgtgatgctctcggaggaggagcagcagcccaagtgcccacggtgcaagagccccgtgttgctgcacttcctccacggcgccgccgccggcgccggcgccgccgccagcagcaagccgccctccaagacctagctcctccatatccggttctcaatctctcccagatggtcggccgccgtccgtcgtcttaattctaacgcatccatgtattatgtttaatttttctctctcgatcgctagctagctgtagttccctttttctagtagtagctgttatgtttttttctgtcattcgatctgtgtgtctttagttaatctgcacctcctctgtagcttggtcgatcgatcaggttaattttgtcaaattagcactattagctagctagtagctagaccagaggatcaagcatgcatcatcccttcccaaatgatctcctactccgtggtgcagttgcatgctttaaccatcctattaatgaatctgccatcattctcaattgttttgcttgttacagtattagttagttgcatatgcatgtgttcttaacgatcgagcgatcgatatgatccatttccatggtttggtttatgtcttttttccttctactatacactgatgaagcaggtttccattaattggagaaggtggttaatttcatcgtctctcagttgattgatcgatcaatcgatctctgctgctgctgcgttacgtacgtactttggcttaattgtgttagctggatggaaaggatgcgtgatgaaaaatcaacctccagctagctttagctagtcaggggacgggaaaataaataccagtagtgatgaatcaaattaaagtagagtcgaacttatggtagatggatggggcgatcgatcgtatcatgaaaaacgtgtgcccgttttaattagagatcaagtggagagtagagtatatggacgcatggaatagcagctgatgaatatgaatgaattgaaaatgaacagagctataggccggcaatcattaggggcagttgagaggaggaattattcggggcttagcatgcacgtcagttcgtcatcaagaacacatttatacccaccgtccttctttcttcttttcttcaggatatttacgagttcctttttcttggcgtgatttctgtgtgcgatgccagaaaaaggccgaatcggtcagtctgagactgaacctggacgctgaccctgaactgcagaactgactgggccgatagattcgagaggatgaggcatgcatccacgtttattttcttccttttcgacgcgtccgtttctactgacaaaaaggagcgctgccatccgggctctgcccacgctgaaactatcaacagatcacgctgaaactatgaacagaccatcagatgctcccagggaagaagccagctaaaagctttggtttgtgcatggaggggagagccagcgatcgactttatcctgtcactgaatttgcctggaggatgacgttagaatgtggagggaagagataatacgttagtttttttttaaaaagaaggataatgtaaaggtgtccgcaaaataaaatgtaacagaaaatggattaaaaatgaaaaactaaaggattttgttttttagtttcttcaatagtggatcaaaaggattaaagaataaaaatactgaacgtaacgatgcagcggtggagtcagatattagagcatccccagcagctactctaaccgatcctccatccttcatttggcgtatagaaggggaaaaacggctccaacagatgcgctactaggcactccaaaagtgacggatgcgccaaattaggagagagagaagaggcaaaaatggagtgtctctcctctcacgcccttttgcaacagccgcctctctcgctccaatccggacttcagcgaccatctccctctggcgtgaccccacctccatcgccgtcgtccccagccggcgaaggagagctcccttgcccgtttttgcttttttttttcagcgaatcgtggagagaggcgtactagatctggaccgtcgtccgccgcgtggccgctgcttgccgctggcgtgcgcgtggtccctcgtccgccgccgtcgccctgtgcgtggcctccgcttcgccagctgccgcccctcgccagccgccgtcgcccggcgcccaccgccttcctcctccgccgcttgccgccgccacccctcgcccgcttctcctcgcttcctccccgcttctcctgcgccgcttctcgagagttcgagtgaacagtgaataagaagataagggacatgtgaaaaaataaaaaataatataaatggatggtagttgaagtatatactattaaaatataagaggatgagatatagagcatgtaatatgaatgatctgttggagttgagagaaatataaaggagaaatcttttttaaatgaccatctaaataggcatatggaggatcgaatatggatgagctgctggggatgctcttaaatgttatggctgagttgaggctcaactgaacaattgctggtttcctctaaaatttacgtggtgatttaagagacttaaacttgattttgaaggtcctagggagccacccccacattgttcatacggtatattagttttttttttgttagaactttcatatagtcatcgcttatttctctatcacgctccccttcctgcacctaggagatttcctatggtaaatcaccatattgatcttctgggtcgtcacactagtaaaacgtttttcactcccagaaggggaagtaaaccctgcacctgcacgcaccctcttgaaaaccgattatagaggaggaaggagacagtttaacaagtggagagatggcaaaacacaggagtttgtgtacatgggatgtttggtattcctttcgtttcatattacaactcatttgactttttttatatatttttttaagtttgacaaaattatcaaatttatagaaaaatattgtagtattttttaaaaaatattatcaaactatattcaatgttagatttaataaaaactaatttcatattttaggtattattaaatctttttataaatctatttaaacttgacaaagtttaattagaaaaaagacaaatgatttataatatatttataatatgaaacagagggagtttgtatgagatattggagccgttgatgtgcaagtccaaccctcaaataatcagtggggattgtctgcagtactacacatgcagtagcagccgctgatatatgggaccgagtccacctatcagccactgccactgtaaatgcagcattgtagagcatccatgtcccccctgtaatagcccaagtcgcctggcaccgacgaacgaaaaggaaagccgaaaaggatatatgaatgcaggctgagggaggggacagattcgggcgggccggccggtgcgtggattgcacgcacgcactccctccgcaagtggccgcacccacaaaatcgccctcctttttatccctcccgcccacgctctcacacccgccggcttctccttgtctctgctctccacacgcggagtggaggagggattaatcggaagcatatcaatcggcggccatgacgatcggcggcgcgtcctccagcgtcgtaggtacgcaacgcatgcgcccgaaccgatcattccttgcatatcttggatggatgctgggttttgattgattgattgatccatcatatcgcagtagtgccacgcaacttccggttgctggaggagctggagcgtggcgagaagggcatcggcgacggcaccgtcagctacggcatggacgacgacggcgacgacatcttcatgcgctcctggaccggcacaatcattggaccactcaacgtacgtacgctcgcaacccccccgctgtgtacatatatatttgcattgacatcctgctgcagattgatacttctcatcgatcgaccacgcatgtgctcactgctgcatttttcatcatctggttggttgcattttcatctgggttgttgattggttggttggttgcagtctgtgcacgaggggcgcatctaccagctgaagctcttctgcgacaaggactaccccgacaagccgcccaccgtgcgcttccactccaggatcaacatgccctgcgtcaaccctgacaccggactggttcgtatgctaaaaattccctccctttgttgtttaccaccaccacctgcccattgcacatgccaccacttcaattccctcatcttggtattattactcattctgccttctaatgaccaacgggtaaagcacacaggaatatatattctgccagcaaattgattgctgcccacctgaacatgctctgattttgcaagtttttgaaagaacttgcactgattgatgttatacatagtactgtttgatagtagttgcttccaattagattaacggtgtgcttagttcacgttaaaattgaaagtttggttgaaattggaacgatgtgacggaaaagttggaagtttgtgtgtgtaggaaagttttgatgtgatggaaaagttggaagtttgaaaaaaaaagtttggaactaaactcggcctaaattaaagttcagcagcaactgtaaatctgaaattctgatgaatgttgaagtaccacctataccatacctttgtttataacatactgatcctctgcatacttgaaatgctgctgactgcggcagcaagatctatgaactgcgtcactgcatgcattcctgcatgtcatgattcctttgatacgcaggaaggaccgaaggatgtttgaatcatattgctgcctgcacgctagtgtctgaattttgccaggaaagatcttcagtttcaaacagatagacattctaatgctgaagtgatttcaataggttcattaggttgtaatgatgtgattgtttcactggaaggttactgaatttcacctgaaaacactgcaaaattatgcagaaattgataccatagacacatatagctagaaaggttcagaatgttagtaagttattactgctagtacttaccaattcaattacaatttaaacctgtgggttctgaattctgattacacacgccttaatgagatggtgagaattgattgtaatcatttcactttacttcatcaggtcgaaagcaagaagttccatatgctggcaaactggcagagggagtacaccatggagaatatcctgacgcagctgaagaaggagatggccgcgccgcacagccgcaagctggttcagcctccagaagggaccttcttctagtcataccgtgagatgttcgagggcatgttcctgttgctgctgctgctgctatatactcatataggattggattgctatctctgtccatggcacgcaccgttcgtaactatcacctgcccccaaatctgtcacctgaaaggtagtagtactagatgtgtatgtagtgcagtgttgttggtaattactgaatcgccttgctaatgcctaatggctgccctgcttgctatcatatgcatgccaatgtgaaggacaggtttggcttggtttgaacgctgagagagattgaataacacgagacctcctgtatctggcaccgtatagactcctatgatttatgcatgtgtgttaagactaacaagtattttatcccggtgccattttcttggcgacatgggcacctgcccacagcccattattagcgggctcgtcggcttcaattttgggtgggaaatggcatggggctttctgatttgggttggcacatgtctgaattcagaattccgcacgaggtagttgcaagcaggttcagcccattttagtactacggctgtgttcttactcatctcactcgtttttcgcgcgcatgctttttaaattgctaaacagtgtgtttttttaaaaggtttctatacaaaagttgtttaaaaaatcatactaatccattttttaaaacaattagctaatacttaattaattacgtgttaatgaaccgtttcatttttcgtgtacactgttcgggttgggaacaggtggagcgaacatagccgtacgtactaatataaaggcaactcatatgttagagcaagtttaatagtatagccaactactagctccaattcatctatagccaatctaatagctcattcatacaatagttatatactatactattaatacatggtcccacatggtatacacatactgtatcttggagtctgtgctacagctgactacaaatctgtagcccgctgctcttctctctcctcattatcttcttaaaatatatttgcagctggcttatagcctgcaattgtaccttctcttatagaaggaaaaaaaaagaactcaaaagctgtgatgtgggctggaagctcactgtcactgtaggtcgctttccggatgtggaaaaggaacagagcaaacgaacgagtcgagccgccgaaaccaataccggatgagccatcaatccatcatatgcaccggaccccaacgatacgagatgcgtaggcgcagtcaaagttggaccgagttacgtacactagcagtagccaggatatgattgtttgcttgatgtgagaaaaataaaataagtgcccatttgatttataggaaaaatgtaggaattttagaggattacaattctatggaaaaaaaatcctatgaagacctttgaaacaaaggattgaatcctatccaatcttttaaaattcctatggaatggataattctatgcacattttggaggaaagttagcaagagatctaacctcttggaacatttcctctgagtatatctctcttatgtgattcctgcgtttttactgtggtccaattaaacggtcattcctgtgttttttctctgttttgtaatcctctgttttacaattatattcatatcagaatcctgtgttttttctattcctcggtttttttcattcatacgattcaaagtgccataatcagaaataatgcaaggtaatccttccgatactgtctaccaaccacggaagacgcggatgcataagtgggagtagtgtagaaggaccggccaggaggaagaagactcaccaaacgcgaacgccgacgaccggctggctatttcgttgaacactagcacacgcaaggaacggaatatactcctccaagtgtttcgcatggacggtcaagtcaattccggaggcctgcagcggcatctgccccccccc

SEQ ID NO: 13760 - DNA, 12240 bp, Oryza sativa
  unsure (1)..(12240): unsure at all n locations
ccccccccccccccaatcccattcgattctcttcagccgccgccgcaccgcagctcgccccgcgccgctggctaggaaaaaacaaaaaaacgagtcggctcacctcacacgcacggcgcacgggccgggcagcgtgtggcccgcgacgaccgcgaccgcgaaagcagcaacctgcggatggagcagcggctagcgcttggcgtgagacagcggcgaggttcccttccctccctcgtcccagttgcggttttggttttccagcaaagcacagcacagctgcacgtacaggtacagggatgggggaagaaaaacgtgtactagatggccaccgccaaagtgagagcgacggtgcggtgcctgcacactagtgtacggcctaccggactaccggtggactaccgaacgcacgcatacgggagggaggagtcggggaccgggtcgttgctgctcctcggtcggtcagcctcagcctcatgagtgatgatgactagtctactggagtagtactagtggcctcgccaagctccattggttttgttttgcaacttcaccacgtcggcaattaccgcaacaagccgacctaacggagggggtgggaacatgtatgcaccgaacctggtgcatgtccacgttcagcgtactacctctcaacttggagcatctctgcttattagtgctctgttttggccggggtgcactgcacccaaataccaactagcaccaccagaaatgtgtcctccctatactttatactctaccagccgactagagtatactagcactactcctactttatccgtttcacaatatagacaatgctagaaagtcttacattataaaacatagggattatataattataaatgaaaaaaattactaataaaatattagtacagaattccgaatgcgtacgtacggtatcgcacatccgctgcagcagctgcggaattaaacaaaccgggaatgcgtccacctcccttgaactcaatccaaataaataataataaaaaagaaacccacaattccgggcagatgcctctgtgtctgcaacacggtcaatccacgcgcgcccctaaccccaatcattaaccccgtatgttaacgcacgccataaacgcagacgcacggccaccgtccgttcctctatgcgcacaaatctcaaagctccccacgccgctttcccctcacgctcctgccgccttccgcgaatggatgcgccggtggactcctataaaacgcaagctctcactcgccgcagtccaaacaggcaaacgcactcgcatctccaattcggtccgaatttttccaaattccaattgctcatcgcgcttcgaattcgttgccgagatccatccaatctttgagttaagacatgccgtcagagttcgtcgccgccaggaagaagccgccgccggagttgttgttcgccgccggtcggaagaagcagcagccgccgccgcctggcatggcgttcgtgccgtcggagttcgccgccgccggcgttggcaggaagaggcagcctgcgccgccggtggagatacgccgggtgtgggcgcacaacgtggaggaggaattccggatcatccgcaacgcgatcgatcacttcccgtacgtgtccatggacacggagtttcccggcgtgatccaccgcccgaccaagcaccccgccctgctcaccgccggcgaccggtacgacctcctccgccgcaacgtggacgcgctccacctcatccaggtgggcatcaccctcgccgcgtcccccaccgcggcgcccgcgctcgccttcgagatcaacctctccgacttcgaccagcgcgtccaccgccacgccgccgagtccgtccagctgctggcggagcacggcgtggacctcgccgcgcaccgcaggcacggcgtcagggcgagcgcgctggcgccgctgctcatgtcgtcgggcctcgtctgctcccacggcgccgtcaagtgggtcaccttccactccgcctacgacttcgcctacctggtcaagctcctcatggggcggaagctgccgaggtccatggccgagttcctgaacctggtgcgcgtcttcttcggcgacgaggtgtacgacgtgaagcacatgatgcggcactgcggcggcgagctgtacggcgggctggagcgcgtggcggcggcgctgcaggtgaagcgcgcggcggggcggtgccaccaggccgcctccgacagcttgctcacctgggacgtcttccggcggatgcgggagctctacttcctcaagcatggcgtcgaggcctaccaaggcgtgctcttcggcctggagctcgacatggacatgcccagcaacaaaacaccctcgctgccgctggtggcagcgagatgatacgatctcctctcctccgctgtaaaatttgttgattcgtcgtctgcaagaaaggatttctttcggcagatgtacagtaataataagagggaaaaaaagatggtttaattgattggttaaattcggttgattttctcgtgtggtggtttaaactttcaccgttaaaaaattgggcggcttcccctgttgtttgtcatgatgaaacggctatagagaaaaacgcgtcgtatgaacaaaaaggcaaaaaaggccatgcgcaccgtgtgcagcgcagcgaatcgcgtcgcatgttgggagtcaaacgagcagcgcgtgtcattcggtcaaagtgcatactagtgtactatggtcggccgggtttagttccaaatttatcaacnagtttttaactttttcatcgtatcaaaattttcctatataaaattttttaattttttcatcacatcgtttcaatttcaattaaatttttaattttagcgtgaactaaacacacctatgcatgaagaaggaaaaaaaaaaggctacagtagtcctgaacttatgatgaatgaaacggtgagattgactcgttttaaggtcagacgatgagtgtgagttcagggtgctagttcatgcgtggcatgctagtttcgttcagttagccgaccggtcaatgagagaaacagtcaaacaaatctgcattatactactagttttctagtccattttgtttcgtcgattacaccgtggctactagtttattcaggacaggtgcttgacagttgcgccggaaatgcaggggggataaggttttagattaatcctgaaatgaaggtgaaggatgaactgtcaggatgcacttatctccattcttttgcagactttctgcataattttccgcccctgtttaagaaaatgaaacatcattctcaaacattactgaaatccgaataagaggcgcatctatgattgaatcccaaacagtggcggatctaaaaagaaatagcagtgaggtctgagcaaactagatagaattacagttctctttccatctacatatggtaaaaaaattagtggggtcttcgtaggagactattcattagtggggtcttcgtgggggctctaatagtcttcatgccagtagtgagggctcgagaccccgccaccccatgctagatccgcccctgatcccaactgaatttgtgatcaagtacatacgggaaatgatgataaattttgtaaaaaaaaaaaaccttagtgtcgcactcgcacaggcggcttgggggcaaaaccctagccacccgcgccgcaacccccctcaccccccccccctcgtcaccttactgccaccgggaaggtggtggcggggaaagcaaccccgacgaagctactcctatgcatgggagacgaggtggcatgcgtcgggtacggagaccggcggccggagtggtttggcgcagcggatccatcccgctggaggctagatctggcctccccgcagccagatcaagagaggacgacccctgatggcggtggtccggtagaggtgcggggccacgcgaggaaaggcgtgcatgatgagaaggcgccgtgcgaggaaagcatggtcatggatggcacgacacggcgggcggagatggacggtgtaggtgatggctgcacgacacggccggcagcaaggaggggacaacgtaggcgacaacacggcggccaccgtgacctacgatcatgaggccggcgtttcagcgacggcgaaggccgtcgctgcatgtgtccaccagagtccagggctagcatggctggcagtggggcgctggagcggttgaggtcgagttggcagaggttgtgcaagtggcggagctcggggggcgacggtggcaagtgtggtagggaggtttgcaggcgaaaccctagcttgggactccccagcagcaacagtgacgtctaagacgccatgaccttccggaaggcgctgtctaggtcatgttccttgccttcgtctccttctctctgattggtctccgacggctcttggttgtcttcatcaagttgggcgagagaggagtggatctccttctctgttgctctcttcctccccttaacccctccacatgagaataaccgaaagcctttcaacattctactaggttgagtcagtgttagacggggtgtttgcaaccccccttgttggcctagtgacgatcgatcacgcttagcggcagttggtttggtgctagtgttttctctagtgtgtggtgtgaggagctgcgaactctcggtggcgttgtgtttgttttctttgtttcttttctgattacaatcttttagggttataattttataattttttttttgctatatcaatatgaactttatattatctggtgtgagtcgtaaaaaaaatttgaaaatgatgacaacaatgaaatcatacacgatgacaaagtttgaatggcaaggtttgtggactgaccaggcgctgaaaggctgaactagtttgttcaaacttttcagaggatcgatcatcgatgtgcttgtgtaaaaagaagtgaagtcaccagatgatcgtaccctatttctgtctcaggtgaaagtccttctttgcctcgagccaactagagtactgtaataaagaaaaaggttcgtcaaggaggagtagccctgttttcgtcatattatggacatgtcatttcacatcaatcagactacctcgacaaaatcagaagaacctctttcgaattctgcacctctgctgacattttctttgcttcatgtgtagtgctattgaaagctcgcagcaattgtgaaattcttaattaccgtgcgcataatgcagttgaataaaaatttctgttcagaatgttaattactctaggcatcaccatacgattatggagtttttgcttaaggtatcgttctgaaatacaatacagaatggaggataaggcaagagacgaacttggaacctccaaaaaaacaattgtactcaactctaaaaatgaactacttttcgggaatacgcaaaaggattgcgctttcgtattaagaagaaatgaactacttagtcattgtttttctcatgcacgaaaacagttaggtgtttgttaggttgatgacaaggatatgcttgcagagacgcctacattctcagaaaagtattaagctgaaacaattgtaccagatgatgatgtctcattatctgaatgctagcatcatgtgggttgtttgtactacatgtaagagacaaactaacgatgcccaactccacaatctaaagttagttggtgcctggacctgctttctgcgttaggctgcatctcatcacagtgcaagcaaagcaagcacatgcatttgtttatcgcggacacgcacgagaatcataagaaaatcaccggctttgttgcgcgatgtctcccaactgatgacctcatcgaacattttcagtttcatggtcaccttccttttgaattgtatacagctcaaaatgctttattttttttgttgaagttctcaaaatgctgttttgggccacataactgaaacaggcttcaattcagtacttattcagggccaagaacatgctgatgaatgggcaatgtgcaaatcttatcccatttttttatgtttgtggctagtgtagacattagattctcgaacatattccttagggactgtcaaattttattccatcggatcaacatttaatagctgaagcacgctcatgtccaagcacatctctgactagaaaaggttcaggttttacagttctaaaaaaagctcaggcagctgatgattagctaaacaatcattgttggtccaatggacggatagaagggatggattaaacaatctaggatcgttgatttgatccccttatcataccagtggagcatatctggaaaatatacagcctcatttgatcaatggaatgagagctctattgctgaagatccttcctggaactctgacacgctacatccctttgaatttgtgtaagccaattgagcccagcaagagaacaagcccagatgcaccctatggctataaaacaatgagatagtgaccatttgagattcagaatcaagatttgatgctccaatcttttattttcctctctccgcctatcattgttcttgtagctgtctttgcagtggatagcagacaaggaacagtatatactgtggaggagggacatgtttttgcattatttcatctgatcatttgtctttccacccttgaaagttgtactaatttatcttgctaacaaacagtaagtgttcatcattgatccaggaaagaaagcacagtacctaaggcaccctcactggtccttgcctctctgcagctgctacaaccaaccaggagatatatgaacaggcaatgtattactgtgtccagacctattgccacttatgatgagaaacaaaaaactgcgtttcttcatgttccataacagtggatctgttagctagtaagaagcttatggcccttgcaacagtacacgttgttctcctgtattaccctgcctccaaaatttactgcaaacctgtcaagcacatttttaaaaactgctgtacatttctatcaacttcctagttctgaatcaaggtcatctcgtttgtattggagtttcaaaaggaaggaacaaaacttcctttgcttctcgattctctgtaaatgagcttgaattgcagttagcctgaaagtgtgaggtggagaaacaagaacccatcaacgtgaagcatgtgtttgaggcgatgacaagacacttatcctgtccattgcagctggtgttgattccgcgatggaaagctgctgcaaagcatctggtgatgtgtttttgggtaatctaactgccagtaatactatttgcaaacagtccatactgcatgcatatgcaggctttcagccacaggcatcttctctgcagcgtactacagtgtgcaagtaggcaatggcatcaaccagctttaacactgactcactggtactacgaaccaacacacacaatgctactcagcaacaaaagccagtagcttcagctaatcgcagcacaacacctcagtaatttttgctgcaataaacagtcgtttctgtgtctttgggaagcagctgcatgccttgatagttgttgctcaacttaacataatgctaaaactgaaagcagagaggagcatgcatggagttcctggtggtacatcagtcgacacgtcgcattcagcggtgaaacgccatgatttctcttttgtcactaactgcatgttttgctaagcaaatttatgccattcagacatcaatttatgccagctttttttttctttggtgttagaacgagatcctagataagatcttgttgcttgtctacggcatgaagcaatcaacagcaatttctctgtctctctgaatgttgtatatgctgcaacttgtaactgactggctggtacatatacatgaagccatgtttaaattgttcacagaaatgtttggaaatactagaatctcgtataccaaacgtgatcctagaagatctcatttctttaggaatacttcatactagttcataacagccacctacttagtagatactactagagagtaccattaatgtatcacaagtttcttggttcagttagaatgatgccttcgctttgcttgttttctctttcatgccatatctgaatatgcagacatcgatgatcaatgagatatagtactatgagaatcgcagatgtagaagagaaagaaatatagagaggtggaactataataaattcggtctcgtggttaggcaagcttgcataaataatcttaaattaattttggggtctaatcctttgaataaaaaaaatacatgcagaaaagagtagtaaaacactgcacaatggcaagttggcagtacacaaaaggaagtttacgacaagaggtcgcgaccatagatacaaaatcaggacgggaacatcagagaaacgcatttagtatttctgatatcatgtctttgcctttatgtactgccatttctgttcattaaacttcatgagaagacataggtttcagacgactctattcatccgtcattacctctgaactcaagtctaaaggctaaaacagtgcatggcctgcaggcactagtaaagatgatatcatatcactatatatatcagttgagttgatcaccattatctaattacaaacatcagttgagttcatcagctagtttatttgtgcaaaccattttgcttagggagatcaagaaactaaagcatccaattaattaattgactgggtgagactagctaggtaggtcgagacatgacagatgggctaagctaggatcttggcaagttcaaataattctctcaagcatcaggcacggagaagtacacatgaaaagcaaaaagaaattcagcaaacaccgcttgcatgtcccccacctcctccctcctgcatgcatggctgcacagttcttgcattgacagccgcatccaccctatatatgaatcaatatatatatgatccaatccatttatacaatcatagaggacaagtcggccaccatcgcagcagcatgtagtattcatttctgatacgcatgcacaaggggaattaaactatagagctactagcattttctgctgcctgaccggcctgcgtgtgatcctggatttcgatcaattgtgtgtcagggaaacgtcgctgcgctttcttcgtgtattgctggtagagaacaatgcgagcagtggactaaactgtacatgtataattaatagatatcaagctagctagcaacttctacctcttataaaatacaggaaaacatggatcagatggccgtgcgattacacatgatataattaattaattagcgcgcggttccacctcccggtcatgtaattcatccgtatcaatgtggtatatatgctgtttgctgctggccattcatacatacagccacgactgcaaatctgcgttctcaaaatgacaaaatggtacgtacttggtaccttaccttacctgcatgcgtacatttttttttatgctccagttgcagcgtaaaccgacaacatacaagtttcagttataattaagtagcattagtatcagtagctgccaattaagctgtgtgtgatgggtagctaacatattagattagacgtgttaagtgcaggtagctgctaattaattaaacaacatgcaatgcaagagaagaagaagacaggctttcgctcgctcgcatctttgatagctacttgcacacgccgcagcagcctctttaaaagcacagctaagcgcagctcgctccgaccaaaaggccaactcagtttacagcgacatccgacatagcctagcttaagcttcatccattgatcgatcactctcacacagctagctgcacgtaagctagctaggagttagctagccatggttcggaagcttgttgcctctctcttcctcggcggcggcggcggcggcggcggcggcaatgatgcctgtagcctgtcgtcgtcgtcgagcacggcgtcgtcgtggcaatggccttcgtgcacgcaggcgaggacgctctccttcgccaggcacgacgccccagcaagcgcagacgacgacgacagcaagcggcggcggcagcaggaggaggaggaagacgactactgcgtctacaagacgagcgtgatgaacccggccttcttcctcgacgaccactccacctgccgctcctactcctccgccgcctccgccgtcaacgacgtcgtcgacgacgacgacgaggtgatcatccgcgggctccggtcgtcgaaccgccgcctcttcttcgagcccgagtcgacgagctccatcgtcgtcaagggacgcgccgtcgacgccgacgcggcggcgttcgacggggcgacggcgatgtccatcgactcggccgacccgtacggagacttccggcggtcgatggaggagatggtgatgagccacatgagtggcgggggccatgactgggggtggctggaggagatgctcggctggtacctgagggccaacggcaagaagacccatggcttcatcgtcggagcattcgtcgacttggtcgtggcgctcgcgtcttctccttcctccgccaccgcctcctcctccgccttccagctgcctctccagaaaggcagccagattaactaagctaaggctatagctcatccatgagcacaataattactactgtattagctagctaggtagagcaattaagcgagagactacgtttgattgattgatcttggaagcatgcataatgtatgccatggccatggtatgattgatgctgtagcagtgttgactggtgtgtgtgtttgattgggttggagtgagatgcattgctgtatattgctgctttgccgcgagagatcgagatttcgtcctcacctgtcaaatgtcaatgtgtactacgtactccattctgcgtgcactagttgttacccgtcgttttctctcctgcatcgtcttaatataatctatccatcatgttatcaacaacttgcgctagacattgcactgtcaaaaaaaagattttcgtgatatagtgttcttaaatgatgcccaaattcatcttagatcttacaagggctcctttagagaacagtaattttacgaacttttgaaacccctctatttcaaaggagggctaattaagcctctaatttagatcgtgagaaaatgttcatgttaatttccacattggaattgaacatacttttctcgtgaaatttaaacgggacatacgtacataccaaaaatatgctattctcgcgaaacgcgctctattgtaagatgcgggtatactactgttaagtagtactgcctcatccattcactactccctcatgcaccctggggttcaggaacgcaggactcatggctcagacgcagcagaagttcattttgaaatgccatggcagctagtagtatgtactgcttcactctttcagtgaactctgcagactacctgccactcgcgccaaaaatggccgcgggtagtctaaggaagtaacaacatttcaaaatccccacgcctatcaacttcgacaaatttgagtgttgtgcgaaaaacaaagcaataacctaactagctcgctcaaatcaacttcagagatgtgcttatagagatagtgtgtgcgtgtatgttcatagctacatgtgtttatacgagcatctacgtatgtattgtgttttttctaaaagaaaagaaaacaactttggcaaattttaactgaaggccgtatatattatttacccatgacttggttgagcatggaaaggaaaggatgatagggtgtgcatgtgaaagacgccaaaatggagacactacgatttggatggcgcaccacgaagccgggctcaagaaatttgtttgcatgtgtgggcgcaccaatatataagacgccactgtttgatgcggcctcaaccaaaccacaacagcctagccgaaacagtgcagctcttggcccagctatagcagcatggcatgcatcgatcatcagaaaaagaaaaagaaaaaaaaaacaggggcccttgcactcctccacactccaaaaccagtgatccccaggccgatctccttaatagttgcatgcagatttcaagtttgagatgttctcttctctcgaaaacaaaaggatatctccacaagctaacaagataacttggctactggaatagaatcatagatgagtggcagcagaaagcaaactgtttttggtggcatcctgggaggaaatcacgggggcgatagcggcgaactctactggcaaacgccccaaccctacaaccgaaaagataccatgggagaggctacaatgaatggcaaggaccaggcaacactgcccaaggggaggcagaaacagcgcccaaatcatatgctg

SEQ ID NO: 13761 - DNA, 26719 bp, Oryza sativa
  unsure (1)..(26719): unsure at all n locations
agacttttccttatctttcctcctttgtttctccttcttcaccttgtacatcgtaattgcctggtttcaaatttttagatagatgctgttagttcaccccgtcaacaaatggcaataccaagataataaattatatacagattagttcaagatatttaatcctgaatattaccctgccaacatccatttgatcctcagaacttttggccagcagagcattcaagattttgtcattttgctgtttctcctggttgcccattccttttccttcaacaacagggaggaactgcagaaaagaatcaattcagataatgcacttataaaatcctttaatggtgcatagttgcacataaaaggcagggaacttcagattaaaaacctttctatgtttgccaggattttttggaggtttctcgccaggcaatttttcatcgaacttcccaccactagctgttgctgatgaagccatgccagcaacatcctcgagatctttctttctagattttttgggtatgtctgctttagttcccgtgataggcaacgctgttgcagcaagttgtatatgactgcaaataaaaaaaaagacatattatatgaaaaacttgagctgccattgtacaaatgtactttacgttgcagatttacacaaggctcttggtttaccaacacagaaaaggaatgtacaagataaatacaatgtctactaggaaaggataacaacctaggcaaagcaccaactttggctgcttttttcaagttttctagtctgttcttttcttgcttttcaacatgcttcttcttatcttcccttctttgagcaaaaggatcaacaccaggctctgtagcgaaaagttacaacaaaaggggtatcagattggtgaatcaggattaggagacatgcatatttcagaacaagtgtcattgcaaacaaggaccccaaaagaaaatgactctatctaagatgaattgagggcaagcattcaatatttagaaatggtcaactaaagtagtgtacgagcgctagctttaaaacaaataaaatgttgtatataagaagaagagtgtgtagcattgataactgcaataggctattgaacaaaggaaaaggtaatatccttgtcacagaagagggtagttaaagaaagacaaattactaaccatctgtcgccttggcttcaatgattggaatgtctttatcatcattaacacggtcatagccataagtccgcttccaggtttgagtttgctcgtcccattcacgtttgttcttcttgtgctttgtgatccctgcaagtagcattcatatatccatcgagaagtgagaacatatggacattaatgagaaaacatacatttaatattaggcaacaacaagaacaaaacgtttgctttttaaaaaagttcacctttcatcttcgcaaactgctcccatttagtagggggcttcggccttggtagctggagacaagaaatataagttaaagaagtgaaacactgcaataaatcgtattctccagtctgtatatgtgactgtacatgcacacatcaatataaagaactgttcgctcagcatgtttctactcttatggattagtgatttagtgttgtccaaaaaactagataagcaagaaaaaaaacattgtgccagccgcttgagttacatgttaagatttgacaccatatagagctaactttagctgcatcaagttggacataactacgaaattccgtcacaagactcaataacagtacgaacatgtgagaatctcaatgttatggccgcagcaagtcagcaaggagaaccatgtgaaccatacaaggagaactatcgaagtatcaatttcattcacacgaacgaatcacactagtgaagctaagcttagggctccacatacatgattatagcagatcagcagcagcaaatgatacttgggagatcacaaagattggagaggagtatgcaagcgataggttcgggtcttacatgcttctcgcgggggaagcgggtggtgggcggcgggaggcggaccatggggccgtcgcggtcctcggtggccggcagcgcgaagagggcgtcggcgaccgcctgcgccagctccgtccccttccgcaggcactcctccctcagctcctccctgcgcgcaaccccgggaaacttggtcacggaatcaaagcagcacggcacaatagcagtagcggcgatgggtgcggacctggaggaggatgcggcggggaggtgatgcgacgggtcgtaggccatgaggttgccgaggtccacctcgtagttggtggcggcggcggcgggaggtgctgctgctgcttccgccatggctgcgccgtcgctcgaggaggcgggttgggtggagggtttggggaagagagacagacgaggggttgttcggagctagggcttactggtttagtaggctgggctgcggcctagtagatgggccatgtgaatcaacgttgacggcccacggagaaaatggtggcatatgcacacgaaataagttcactttaggccccttaagttgttgcggagtgtgaacttcatccctcaacagaaatacaatgtatagcatatccctcgattcacaataccatgttaaattttggtccatctgcaatatagtgaccaatttttagctgacatggcgagtggtatctatgtgggctccacatgtcagcggccctctctctcctctccatctccctctcttccccatctctccagggtgtacggtaggagaggagcggtgcgacgggcggcgatggctatggttgcgttcggcgatcaggctggcgagccccagcgctcgttggtcaaggattttgtttttgtgtatgacatgttcttggtgttgcagggttccataagggtgtgggttggggagccagtttgctccagccttttgttgcaaatccagagcttctcgtcggcaaaacgatgtgctttcttccggtacaatgaagcatgcctacgcgaggtggagggttcgtcaccgaagaggaaggtaggggaaggaagggggtcttgccggagaagagtcccgcgtcaacaggggcacgtcgctctcgccggagatgagagataccctctccgtttttttaatagatgacggtgttgactttttcttatatatttgaccactcatcttattcaaaattttttatgcaaatgtataagatataaatcacacttaaagtactattagtgataaaacaactcataacaaaataaattataattatgtaaattttttaaataagacgaatggtcaaacagatgagaaaaagtcaacggcgtcatctattaaaaaacggaggtagtacgtcactgggcagcacgtcgttgtcatcggagaacatatcgagggggagaaaaaaaagatactgacgtggtactaaccgggtatcagctactccctctgtaaaaaaaaaaacaaaccctagattttcgtgtccaactttgactgtccatcttatataaattttttttataattcgtattttcattattgttagatgataaaacatgattaatattttatgcgtaacttgtatttttaatttttttttataattttttcaaataagacggaaggtcaaacgttgggcaatgaaatcagggtttgtctttttttagacggatggagtactagcctagcattgatacaatatcaataagtatcatatatgataccaataagtatcggctgataggatgaggtatcaaaatccgatctctgtactgttcgaacgggatcttatgatatagcagctcccattacatctggtccgttggatctaatctgatggacgcgggtccatccaaagatgtactatattttttttaaaaaaagtaaaagtaaggcgtgcatggtgaattggtgaaagtggagagaaataaacaaaagctgcggttcctgcctgtcgatagttgtcgcctcgggaaatttctaagaaggatgactactgtacgagttggtttgtgtacgtccatggagactggctaggatagatgcgttgctggggtgtgcggtagatgtgcattgaaggtgcaatatcatttcgtctttatggctgtgtcagttgtactgtgtggtggcgatactcattgcagcagtcgtggcggaggacggatgaattaatcctttctaatttcacgggtgacgttaattagatgcgcggtagaagaacatgcatatagcagaagcatcgcatatgaattcgtcagcagcatcacatggcggtgttgatgataagaacccgcagtggcagggcacgtactacgcttctagtgtctggaagggaggaataggtgcgctactatccaatcatccgagggcgtgccacatgcattggtggcactaattactatccatcatgtttctgtggacgcgcggctcaagtgtacgtgaaagcgtggcatggccgataccgaccatctcgcgcgcgcgcgcgtacgtgggaacagagagcggcgccgatcgtgaatccgccgacgcggctaggactccatccgcggagaccgttcaccatccatgtctccgcgcccgtgatcgagcatcccaaatcaaatccatgaaccgatcgagcgtgcggcccccaccaatgcaacccaacgcaagcgaagcacatatgccaaaccgagccctccgcaatcaagctcaactctgaaaactctcacttcccggtttaagagagacacaagcaaagcacagagagctcgtaggcagcagctagcttgccctgcattgccgatcgatcaacacgcgcacaccaccatggcgaatccaccaccgctagtcgtcctcctgcagctgctgctcctccccctcctctccaccgccatcacgctcccgctctaccgcaacctcccgcccgtccccgccgacaccgaccacccccaccatcacccgctctcccgcctcgccgccgcctccctcgcccgcgccgcgcacctcgcccgcccgcgcccgcgctcgcgccaaggaaccgcgccgccaccgtccgtccgcgcctcgctctacccgcactcctacggcggctacgccttcaccgtctccctcggcacgccgccgcaacccctccccgtgctcctcgacaccggcagccacctctcctgggtcccctgcacctcctcctaccagtgccgcaactgctcctccctctccgcggcctcccccctccacgtcttccaccccaagaactcctcctcctcccgcctcatcggctgccgcaacccttcctgcctctggatccactcccccgaccacctctccgactgccgcgccgcctcctcctgccccggcgccaactgcacgccacggaacgccaacgccaacaacgtctgcccgccctacctcgtcgtctacggctcaggatccaccgccggcctgctcatctccgacacgctgcgcacgcccggccgcgccgtcaggaacttcgtcatcggctgcagcttggcgtccgtgcaccagccgccgtccggcctcgccggtttcggccgcggcgcgccgtctgtgccgtcccagctcggcctcaccaagttctcctactgcctcctgtctcgccggttcgacgacaacgccgccgtcagcggcgagctgatcctcggcggcgcgggtggtaaggacggtggcgtcgggatgcagtacgccccgttggctcggagcgcgagcgccaggccgccgtactccgtctactactacctggctctgaccgccatcacggtgggcgggaagagcgtgcagctgccggagagggcgttcgtcgccgggggcgccgggggaggcgccatcgtcgactccggcacgacgttctcctacttcgaccgcacggtgttcgagccggtggcggcggcggtggtcgcggccgtgggagggaggtacagccggtccaaggtggtggaggagggcctcggcctcagcccctgcttcgcgatgccgccggggacgaagacgatggagctgccggagatgtcgctccacttcaagggcggctccgtcatgaacctccccgtcgagaactacttcgtggtggccggaccggctccgagcggcggcgctccggctatggccgaggccatctgccttgccgtggtgagcgacgtcccaaccagctccggcggcgccggagtctcctccggcgggccggcgatcattcttgggagcttccagcagcagaattactacatcgagtacgacctggagaaggagaggctcggattccggcgccagcaatgcgcctcgtcgtcgtaagctccaatccatggcaatggcgggggcttgtgctgatcgagttaattaattacgtactccacgtacgaaaaaaaagttagttgatgataaagctgtgcgtttatgcagctttctagtagtaattgtattagctagcgtgtcccgtattagagcgaggttagagatgaagcgcattttatgaacaataagatattactagctcgatgtgaatctctttttacaatggcgtggccgtggcgtgtgtggatgcgttcgccgtcagtttgtggttgcaaaggcagattagatactccattattagtgtccgtaagcggaatgaagaaaaagacgagggaaaagacgatgtttgtatcttttccttttgggattgctttgctttggcaaagagagaaagcacgagagagtatttactctacccctctcttgttgtacgagttcttggtagtgtaattctcgaagtgtttgatctgagatcgctagatcctgcgattttttttgggtgcaatctggtacgtgttgtgtcgatgggttcattgctgcttctgaccgatggagctctagaattatcctaccaacaactcacgttactgttgtggcggtgtaaatataagcatgtgccgcccatttgcagctgcagggtcgctgctactacgtgtctgcttcacatatgcagtggtagtgtggtacccttttcgcatttaccgccagcccgtgcatacagtactgatgtcgcatatggggggaaagctatagcagtttttcttggagtagaatatgataaaaaaaaacgagtatggaggatagcattcgcaccgtacaccagctctctctacaggaatgattcaaaatccagaattatttcttgccaagtggccaactgagtcaaagttgtactacaacaaaaagaacagaaactgaatttattctgctgctggtactactagatgtttttgaaaggaaaaaaatgaggcccatgctaagatgggctcaccatattcttgtagtattgtgggcctcaacagtaagcccagtatttctgaaggaaccaggggaggcccgtagtacagacagcccaaaaggaggagacgaggccgaaaggcccaaaagaacgagaggtacaggtccgcttctgtttagacagaacgtactttctctctgtgaatattcttctgggtgtttccatctcgagcaagtttttttggctacagaaaccacagtttcgaccgaccattctgcaattgaacagcctgcaccataaattcagtggctatatttacagtgggagagaagcacacaagaaagatttttttggccatagaaaccagaatttcgaccgaccatactgcaattgcaccgtctgtaccataaattcaatggctatatttacagtagaagaagcacacaagcgatttctttgcccccccccccccttttgtcatggtatagttattaccagccttttttgtgtttctactggtgtttaggtaatcttatcaaagaaaggaataaaaaaaaacaggtgagctgctcagatgaggttttagttgcatcctatctccatgtgattccgatcgttgtcgttggaatttagcagagcaccggggcacacacgtttatgaatgcggcatatatgcttttcgctgtcctgcttgtcaatcgtggtcgagtgctggagaattatccaaccacttcttaattaatgattttcacgaataatttcaccgagtagttttgatttggttgcctgcttcacaggaaatcggtaacgcgctatcgtgctaaagcagctaaactggcaaactgctactaacctgaaagccgggtgttagttgcacaactgcacaagtgccctgacttagaaggatatcgaattcagaagctgctggcctgtcgcgagtgcatccgtcaatgaaaacgacgatgttgtttgtgtctctatgcttggatgacaacgacgcaaacctaaataaaaacacaaaagaatcgctgtcaccacgcccacacttggattagttccaaccattagaagaaaggaaaatcctcggcaagacttggatagatatccatccaccactccaccagcaccaaggagaggagaggcactgaaaagtgaaaaggagatgctctttctgaaacaaacgattttctttctttctttctttcttttgaaggtaaagttttgaaactttttcattatacgattatgtggggtgctcacctgacctgtgaatttcatcacgtcacggcttgcccgtggcaaagatcaatccaacaaatgaaaaaaaaaagcagagaagctctgatgtatgaacaattgaacactggtatctcagtaagaaggcactcgtaataagtggcacaactcagaatcaaccaaggaatcataatagatgtcactcatagaagtaataggtgatcctgaataaaatctctgaatgtatcaaccaacatacagtcatatatgatctgaacagcagtaagtaagccgtacccaaaagaaaggggaaaaaactaagaagaacaagacatggatcgataatatgtgcatgacaagcgctagctacaagggctagaagatatgtaaccacctaaaccacagcgatgtacagcaacatccggcgagctaatccctcatcaacaaatcgaaagaaacaaaagaatccatccgtccatactggaagcagtgctggctaatagtaatccccaaatgcgaagcggaaccaaccatcgaaatcagaaccagactttgcagtcggtgcgctggaatgcgggggcgttgggggcggacgctgggacggtgatggggcagctgatcttggccttgggtccgggaaccttgaaggcccagaccttgaccctgagcttggcgttgagcttgacctcgatgtcgaacttgccggcggtctgctgcgacctgaagttggcggcggtgatgtcgccttggagcggctgctggcccttgaaggcgggggagagcttggtggatgcctcggtggactggtagaaggagtcgaggggggcgtagccgaagcgctggccgtcgaagagggcgagggactcgacgttgtcgtagtagaggccgacgcgcttgttggggttgcggacggtgaggtcgacggtgaggctgtaggcgagggcggagttggtggagagggtgaactgggtgagggcggcggagtcgacggtggcggcgatcatgtgggggcggaagatgaggtagaagatgagggcgaggacgccgagggtgacgaggagggagatgaggatgctgcagaggcagctgaagaggccgcacgccaggcacttgcacgggcagcacaggcacgacaccgcgcggctcgccgaacccatcgccgcctcctaccttgttgcccccttgccgagatctgcgacggagagagagagagagagagagggggggggggaattgaacaacaagtggaggaggaggagacgatgcgggtttgtggtttgtgtacgtgtttgtggtggatcgggtgggttataagtactccaggtcggggtcgcaacgacgcgtttataataattgtgtaaagcgcgtggccgattaactgctgatagcctcggctgcattgcaggacggcagcaaccgcgaggagtaattggcaggtgttgttgttttttggtttgggttaacaaagtttggccgggtcgtggtgtgatcgcctcgccctcgatgggaaggaggcgaagtggtagtagtgggcgggcacatgacatggtggtgtgtgtgtgcgaccctgatgatgcggggagtgtggtggagttgtagccgttgtggcggcgtttggctggtggttgagaccccaacccacgctccgctggatgcctggtctttgaccggacaccactttaaacgcagggaactctcgctttatttgttttgtcctataccttaaaaaaaagaaaaaaaaacacgcgccacgcttttgcaggccaatttctttttgctgcagcaaccaccacgaggatattgctaatattttcgcatcccaaactctgcccatgatgatcaagattatatcaaattcttaaggtttttttttgttaatggatgtttagtccttgctgacgccgtaccaggcgaagacaagttgaaaaataaagggcccaatcgagagtgagggacgggaaataatccttttggcacggaaaacggagcaggcttatcggagaatgaactcctccaccagaaaatgagatattggaaggaggccaccgaaaggaaagagcaaacagaatgtgtagcgtggggacacaggctcgtgggaacctgacctcgtttgctaagtggtcgtaggcttcccaaaatggttgggaacccatgatgggaggccctcttcgagctaaaagtttgaaaggtcgcgacatgcaagcaaggtttatgtttgctttattcatataagcgattctttgctataagtgtggggctacgattactagctctatcctagccctgcgtcaagctctgggcgtcgtcgacgtctggggccccctgtgctggctcttccgtagcggttggctttggccccaccggttggctacagcactcagcttggcttgatcgtgggtgaagattattggctatggaaagtttagttctcgcactcgcgcgaagataatcgctcacatagaattattattgcttatatttatctctcgcccatctcttcctcgcggtcccgcggtacccacgtgtcgcgcgctggtttacctcccttggtaccaaaaagtttgtattcgcttcatccattcaaacgattctttgctaaaagtgtgggggctacgattcctagctctctcctagccctgcgtcgagctctggtcgccgtcgacgcccgggccccttgtgctgactcttctgcagcagctagctttggccccgccggctggctacggcgcccagcctagtttgatcgcgggtaaagattgttggctatggaaagttcagtcctcacactcatgtgaaaataatcgtttgggtagatgaagtagaacgcaaacagaggttaacaaaaggcaggggcaagcaaggtacgcggcgtaaggtcacgggcccgagagaatctaacaatgtttgctgagtatatacaggaaataagttcacggcctaaggtacgggctaaactcccgagcccacagcgcctcgaaaatcgggaggaaagtgggaagttaaggcgacgtatgaacgtgactaaactcccaccgcccaactcccagaatgataggacagaagatcgggcccacatgtcaactgactagtagattggcgtcaaccctgaccacctgggaaaggttttggtcagggctaacgccgggggctactgtcggtgatatgggcccgggggtatcatatttagagggaggaggctgcccctcccaatgccacgtggccctcccccaaggggagtcaggcccgaagtggggtggtggcctctcctacccaaagactaattggaggaggctgccggaggggggatcgggccagaggtcgggcggcggcggccccctctcgtgactaaaaaanccgctcctccgacctcttctctaggtcaccatgtacggtgggttaggtgtccgcctacatatgcctacctacccgtatttatggcgacccgagcggtcgcggcacgccacatttaatgcggcgtgcagtgtactcaactggtctgtaactggtcgaatgaccgatgggactggctagtgcgcttgtgcgctgctcgtgtgtcaggcggcgtgcagcctgacatgtcccatcaaataatgatggtgagaggttctcatcctcttatcccagccggagtcggccctcccgctctgatcaaagctaggctcccgtttcctggtgtaataggagcccagaagtcttcacccattaaatggtgaatgacttgggcgccccccgtgtcaggcggcatggtttggtaggccccacgaccgaggcgacgtgtatgcagcttcaaagttaaggaacaagacatgcatttaatgcaaagattgtaatacttctcgacgaagttaggttgttgggccaatgtggtaaccccttgaggtataaaaagaggtccaggcctagtgagagagggggggacttccgagcgaaccggcacttgggtctcgcaaccccgagcacttgtgttctacactcaatcaatcaagcacagtagtagggtattacgctacttagcggcccgaacctgtataaaccttttttgtctcatcgtctttgggggatagaaccccctcaagatcacacagcttcgctaccaagccctcgaatctcacacgctgcccccggccgaactcacaaaggggggcttcacggttccctggtggaggagatcactccccgacatctaacacacgagcagcgcacaggtgcactacccagtcccatcggtcattcgaccagtcacagaccagttgagtacactgcacgccgcattaaatgtggcgtggcgcgacctctcgggtcgccataaatacgggtaggtaggcatatgtaggcggacacctaacccaccgtacatggtgacctagagagggggtcgggctcccccgacccctcgggggagggccatgtggcgcctggggtagccttctccctctagtctcgatcagggagtggccgccaccccacctcgggcctgactccccttgggggagggccacgtggcattggggggcaacctcctccctctaaacatgatacccccgggcccatatcaccgacaaagctattagcgcgtgattaattaagtattagctatttttttaaaaaaataaatcaatatgaattttttgagcaacttttatatataagctttttgaaaaaatacaccgtttaacagtttggaaagcatgcgagtgaaaaaacaagctgacaggagcggttgcccgcaggaacgagcgcacccaaaatcaagggaaaatttgaaccatgccacacaaattttgatatgccaccctgacacacatgtcattgactcatgtgggtcctacatatcatttagatacgggtggtatatcttaaattttaccgaattaaggtggcatgattccaacaaaccccaaaatcaaagaggaagaagcagtataaaccgcagggacacagcctgctgcgctgtacgtgtctgattgcaacggcggggggcgcgcggcattgtttatctggggcgactcgtcaccgttgaaacgttcgcttgtgccgcgcttgcttgccactttcttcgattcactcaagcccacgtcgctcacgtgtcgctttcaatatagatttgtttagcgtttcaacgggaaatttcgtccaaactctaccgggtattgagctgtttagctcaaacaagcaatcgtttcgtagtcaatttatcgcgcaaagacgcgtgacgcgtgaagacttcaccacgaattttccttttcctttgattaataactagtatgtttctctcatataatagcatatatgttttctcattatattattcaaatatattaaaatgacgacataattttaaattttgcaataactttataaaattgctaatgtgtaatattcatattgtattttatatacgtgttagttattaattatttttaatatcaaattttagttatttgtaaattatatatattcctatatggactctagactcgtcttttaattttcttttttttaattctgaattttcagtaaaatgtatttctatatagactctatactcttcttccaatattatttatttttatttctgaatttttattatttctaattgtatttctatgtggactctaaactcatctttcaatattctttaatttttaatttcgaatttcagttacttctaaattgtattcctatattgactttaaactcttcttcccatgtttttcttaatttcaaattttatttatttgtaaattgtattttttacggactctaaactctacttttaattgtattatgtttattccaaattttagttagttttaaattcctatatgtactttatactctacttctaatattccttattttttaattccgaatttctattttttttttcttaattgtatttctatatggactctatactctacttctaatattccttatttttaattccaaatttctattacttcctaattgtatttctatatggactctatactctacttctactattccttatttaaattatatatattcctatatagactctagactcgtcttttaatattgtttttttaattccgaattttctataaattgtatttctatatagactctatgctcttcttccaatattatttatttttatttctgaatttttattatttctaattgtatttttatgtggactctaaactcatctttcaatattctttaatttttagtttcgaatttcagttacttctaaagtgtattcctaagctcttcttcccatgtttttcttaatttcgaattttagttatttgtaaattttatttttatacggactgtaaactctacttttaattttatttaattttattatatttattccaaatttgagttatttttaaattcctatatgaactctataatctacttataatatttcttattttttaattctgaatttctatttttttttcttaattgtatttctatatggactctatactctacctctaatattccttatttttaattccaaatttctattattttctaattgtatttctatatggactatatactttacttctaatattccttatttttaattccaaatttcagttatttcctaatcgtatttttatgtggactctatactctacttctaatattccttatttttaattccgaatttcaggtatttcctaactgtatttttatatggactctatactctacttctaatattccttatttttaattccaaattttagttatttcctaactgtatttctatatggactctagtctcccctctaatattccttattttttaatttcgaatttcagctatttctaaattgtatttctatttggactctgccttttctttttcttcgattaatgtgagaatttctaggccataagagcgaacgtggaggctcctttttctattcctttaataatataatagatcatttagatattagatatatgaacataagcgaaagagcctgtagcctagtggttacacgagcctcagtggaaccataggtcacagtgggttcaactccccatgagagcgaattttttaggatttaatggctttgtgctttcaatggtaggtgatgcaaccgtcgacagcgaggtgttctgtggtgtgtttgcgttgtagtgttgtactgtgtattttttttttaaaaaaagaagatatatgaacagtcaacctgctcgcgacttctaagggccttgaaacagcagcctgggccacaaacggcccgtccgatagtgtgacgatgtggcccaagctgagcaccacagctcgggctcattttcgcccatgcgcctgcagagctcggcgaggggcagaaggcccgcggattcccagtaaccccgcgcaagaggccagcagcccaatgcgatccgcgttagcgcgacgggccgtaactgacccagtcaatgtgtgtgattgcatttgcatccactttcctgctcgtcccagtcgctccgtcgggtggcacaactggcaatccaactctgcctgttccttcctccaaaattttcctctttcttttgttcaccagcgctgcgttcaccaaatcaccaatcctatattcagtggccggatgggcagatgtatgcatgcatatgttgatcggcagatgctgtatcgatcacaattcccaaataaacggcattttcaaatatcgtcattcactcaaccatgtgctcaatctcatattctcatcttgtttgggatacattgccgaatatatatatattgactgtgatggagggtcttcccttagaatagcagccaatcacccttgcctttttcactttccccctttcgaagaaacctcaaggaaactagcagctaaagtcactcgcacttgatcaaaagctctttctttgcaggactagactacagtgtgctactagtgcctcactctaccgctcatcctaaccttacccaccggccaccacgtacatacatacctgcttccctgcttataattacctgcttatgatcaaccttttcaaattcgaatacatacatgcatacgtactagcttagcttagctacagtacatatatagcaggtaagcaggcagtacgcccccaaattataagcccttatgggcacgacattcttcatgcatggagccagctctatctctgtctcagcattatatcatcatctcaaccacacagaaaggtacagttcaatatacatagcaggcatggtgtacagttagggcccatggattctttcacaacccacctcccttaaatatttttagcacaaaaaaaaaactactaaatttcaacccaaccatttttggacccaaccctcacattttgttggtcaaaatgttaggtccattaccaccctatgtacagtataagaacctcttggggttctcgagattgtaagaagcagctgatgagtatcaaacttttgaaaatttggaaaaaaatcaggttttttcaacttttggctcttaatttatattattttggattttacaactattgattatgaaactctatgcaaacaaactaactatgtggagaagccatagattatgaaataagttaaagttgctataagttctctaaaacccttcctccatcctaaaatattactatctaagataggatttgacctatcgaaaatttatattaatatattttttaagtttaaaataatcaataatcaatcaatcatatatgctaatggctcgtatcgttttacgtatatgaattttctctttttttccctccacttaaaaacactcttaaagtatgtgtactgtataaccaaacctcaagcctcaaagcaggctatcgatcgaattgattttgatagggccagcaggtattctgcagaatatttttgcaaccatgctctgcaaagggcaagcagctatagctacctacgttggtgcgaggcaatcgagcgaaagggacttgcaactgaaagcgttatctgctactctccattctcctgtaccagtatttactaagattaattaaagatggtgatctaaatctatatagagaacatattttttgaagagcagatggtagtagtgatctgtatacgtgtgtgccaccaactaaaactgtgtaagctactatgagtgccctaacaaaagcacatgtagcgtttggtttaatttggtcgcatccaccaaccatgccaaattggcacgcattttaatcattaacacgcgagatcacaaagtgtatgtatggattataatgctccatcatgcaattaaattttacttgtattagaccatgagttggtcgatcatgacgacactgatctccatagtagaagctttagcacccctcatctagtctccatgaagaactaacagagaccactttacttactacttgtgaaagaatcacaagctagtagtcaatgaagtatactaatactctctccgtttcaaaatatttgacgccgttgactttttagcacatgtttgatcgtttgtcttatttaaaaaaattaagtaattattaattattttcctattatttgattcattgttaaatatattttgatgtaggcatataattttacatatttcacaaaagttttagaataagacgaacggtcaaacatgtgctaaaaatttaatggtgtcaaatattttgaaacggagggagtactagctgttaagtcatcacatgctgtgatgctggggttgacgcgtgcttagagctagcaaagtagctttccataattccgatgataaatatataaaaaggaaatgcatgacatatcgtcaatcactgtgcaagaaaaattggcaaaagatggcgaaacaaataataagagtgagtcgccatcggcatgtgcagtgacgtgcagtggctccccggcacacaacggggaaggccagctagtagcaatctgcccattggtccacactcgtaacaaactctctcatcgatcgatcgctagcttattagattttcgttttcaaaggagcgctttactaaactaaaagctgatcgatgaggtccaagataaaggtcaaatatctcaggcacaagctaacacgaatatagtctcttttcttcaattttttttatagagagaatcgaaaggcaagacgagcaaaacacacaggtgtacatatgaacattttttttaattattgatgtactcacattggaatataattattgccaaatgcaaatcgaattatgcagacacttcacgtctactcccagctgtacgtctattatgcatcttttcagaataccccaattttccctttcactccaagctacactagctccaaaccaactacggtctaaattaagaagctagtactatcatcgatcggtttttcttcattgatatgagatgattgattccggtgagaaaaattaagcaagaagaagaagagaagccgtgaaactaattaaaaagaagaagagaaggaggaggaggaaatgaagaaagaagacacagctagacatcgacggcgcatgcagctgcttgctggaagcggaagtagccatcgccgccgccgtagttgacgccgtagctgcccttgccgtcgttgacggtgaggagggcggggcagttgacgcggaggtggtagtggccggagatccaggtgccgaccttccatcggacccagccgtcgaggcggatgtcgacgaggacgtagccggcggtctcgtcctgggcgagggcgacggcgaggttgggggggaggacgacgtggtcgagcgattggaggaagggggaccagacggactggtcgtagtggccctggtactccacggggagcctcgtcggcaccgtgatggccacgtccttgtactgcgcgtacacgtccaccttgtcgtagtagacgcccacgcggccgttgtcgttgcgcgccgccaccgtcgcctgcatggtggtgaagaggtaggcggacgccggcggcgtcacgttgaggcacagcacggacaggtcctgcaggtagaaccgcggcttgtgcggccgcagcgccagccacaccaccagcacgatgaagagcgtcaggagcaccagcgccaccagcgcccagcacagccgccggtgcaccttctccttctcgcactcgcaccccttgtgccccccacaatccttgatcaccgacatcccctctttgctctccttgatcgatcgaaatggctgggaggaggtcgcggcagcgggtggggagggggtttatatatgagctcagatggtggtgtggctcatgtacagcaatggcaggttgattgattggaaggaggtgatcagcatcggctgacagtgtgagcagagcagggtaggttcagttgttggttgctgctgctcacttttgggtggcttactagactttgcacggtcgcctgctgcttaacttaatttcagctttgtaagcatggtgtatgtctcaaaggggtggattatgatggtggagctggtgatcgatggtggtgagtggtaagctccaaaagaagctatgattgattgaaaggtaatcaagttttgttaaggactcggagaaaacgcctttcgtcgatacaaaaagtgaaaaggaaggattttgattctctcaaaaggaatccatcagcgatggaaattaaagggaaggaagcagctaaaaggaacgttgggcgcagcccgcaggtgagcgagtgcctttgcatcatttggaaggtgtgtgagtgtgacaaggcgcgttaaaccttcttttgcacgccacacccacatacatcaagttataacgggcattaccaatgtcatttagtactagattgaccttgctttccagtaggttagcaggtgcggcactagtgatcagcacaaatgactccgcgtcaaacagagctagtggactcgtattgcatacttacatgtccgatcttctgacgtgcgcatctaagcaccaacaagtccagataatgacgtacaaccgatcgtttcattcatgatgttcgattgcactgaagactctagtttttacgtttgaccacctctgtaacataactacacataatagcgaactgtaccttagctatcagcaggtaattaaccgagcaaggaggattcattattggctgtaagagagtcaccgagcgggtagggtgtccacatcagaggaagagatccaaaggaaagaaaggtaaacaggaagagaagaagccgtcccatagaaagataataaatgggtcccgtactctcacttccttgtccagttgcctagctaactgtaatcttcattcatatcacattctcacttcaaacaaaacaaagaaaaaaaggataacgtgcgactacactcctgtctactgttcaccgtaactcagaaaaatggctaatttacaagcatatggctataagagtttgcgaatattaggtgagatagagaaccagaagcacgcttgcgattctatcatccatgtgccaacaaaaccccagcttaaagaatgtaattaacgagtgtggaaacaaatcagtcaatcacagtacaatgacaatagatcgaaataaacgattgcctagccagacacgtatatcagtgggacacaagcacacagcatggaagcttcttatgctacagccgtccaccatgtttgagcttgtgcggaaatgaagggcagagaagaagggttgttggcaggtagagtccaaaggacagctcacatagggaacccatgttagggacgtctcttaagccaaatgggctcttgttatatgctatgcgcactgtaatcttccaatacataattgtattaagaaaagtatgattagatgcagtgaatttgtggtaccataaaggtcacataggagtatctttcacactaatgcgcgagactttgaaccagccaaccagagtttctgataattgattgtctccactaggacataagatgcaaggaacggtgcgccttccaattactgtacacctgatgcctgccgtataatcactgctaaatgggcagatgtcgactaatagcatcaaatgccaacggcagtacgcgcagatggttacgtggaaatacaaagagctgttgcattaggggctcacctgtgcagctgcgctccaagttggcattcggaaatatgccctcgtggtttccatgcgctttagctatggcagatgatgaataaggcttggagcctgctacctcgttcgctgacttcgcctacaggagtcaaacctgagacgacaatgtcatacagatattaattaggggaaacagtaaagtatgtatttatcttataaattgacgaatgaataacctacatgacagcccgagtaacaaaagtttcatgccaaacgaatcataacagcaggaagcaggaagttaacagagaaattttgccttgccaaatgttatctacaagctatataactgtaggtagcacggtaaccttttttttttaatacaattttgtaatagaagttaacatcctcggcctctactatagcccaaaactagcatgattaactatgttaccccgtctccagtgacggatctaggaagaaatataagaggagtctgaacaaactagacaaagctacagccccctcttcccctctacatatagcaaaaaaaaatattttagtggtgactcccatagttctcgcgcgccaatagtagactcaaggccctgctacccccatccgcccttgccataatccatagtctcagatggcaaccaaaactagcaatgcttatctacccagccaaaagaaaaaaaaactagcatatgcttaattaaacaatgatatgaagttccggcaggagtcaatgggggaagcttcaaccatgaagcgaacatagagaagtaattatgcaagagaaaatggtaaatttgctcttttctcacaaagttatgtacctcttcctgaaaaagtagtactacctacatcctttaatgaattaaactaaccagcttcgtacaaaaaagatcggagggagtattatacaaccatacataaggtgatggggcatgaatgcacgacacctctcgaaccaactccactaactgcgatattgccatgaaactactaacaagaactcgtccttttctatcaaaatcactacaaaccgtgcaacttttcagtctgatgacaggaaattgaaagatcacaagaatgataggtgactccaaatatgcatgaaacatataatttgcactcaccaaatgaccaaattaagaaacaaagacagaatccattaatcaaaacaattccaaaatttaaatcactgtttgaagcagaaaaatgtggggaaagaatataaagtttgcctgaagcacggaccacctatgcgccaagcctctataggacatgtaataagtgaacgagagcaccagaaagtcctgcagccacaaaggtgttatcatatttcttagtctgaatacagtggattctcatccacaatgtcaccataaaggcgataaagttcaatctgcaatcaactttctgtacattaagctcttgtatcttcacaagtttattaatgagaaggggaaatcatttatgcaggagtaaagaaacatattatcccgtcataggtggggtcatactcatgcatctcaatataccaagagaacctaacagaatgatcctaactaaaaggatggatatggaagaactagaatgaagagagcaggtgcggtcctggtatatactgtaatgatgatggctgattatggttcttctgccatggtcccaggcaatcagattcaactaatttgcactaaccataaaaatacagtagttgtaatatacagttttaaaaacattttatttgaagaaaaataaagcatgcacactagaaatacaacacaaaattgtaaacaaatgaggtggaagaaaatgtttggagatatatgttcattctagtataataatcacccagtgtagccacttccaatagtgagctagcaacctatcttcttcaaaaatgcattcacatttatgctacataaaaattgatgagaccatgaactcagttaatcctatcaatacgggtttaacaattgttgtgtgccagcagtgccattaataaagtggaatgtgatagccatttacatcatttagggtccacaatgacatgtaaattaaaaagcagcatgcaaactgctatacttcctgaatgagttgtagaagaatactttcctgtaagtagtctccaaaagatgtgaaatattcttcaggtacaacctatacttatcctactagctagccattgaccgtcatgccactcatgcatggacgctattggtgaatagagtccacgtgcaagagttcccttgtatgtttgaaataggaatttttacaagtcagcgtcttccttttgttttgataaaagttaaatctaattctggacagtctccatttgcaggttagtgagttcgttcaaaaatttgcaggttagtgtaggctaacacctaatacccagctaccacatatttgatgggtgggatcgatttttttctcaataacctaaactagattaaataaccactgtccactaggaccaatttaacactttatcttttacagtttttgaggagactcttatgacttggtttgagaatttgagtcttcaggattggagccaacgctaacatgcatctctcaagaggaatgcaaggctgatcatgcagttagccacttggaacagtttacagtctacggtttgtttctttttcataaaaaaagagataaatgtttagacttggtctgaacctccaggcttagagaaagagtatgtcagtccaatgcaaacatgcacaatgcaggcagcaaacaaatgcaaggagaacacctggttattgaacccaaagttaaatttgcttacaatggatttggctagctgtctgaaaacaaaatcaaaacaagatgacaatacttaacaggtaaaatgcgctatgaaactaaaatgcacccctttttgttccaacacactatgacactgcatagtacagatagggttcaggaaggtctcttgacttacagttaaatgggatgtttgatgcaatcagaatccctgatgacctgatcacttcgtaacttctttgcaaatagattaccaagagcttgctcaagtgattctggagtgtacttcatatattttaaagcgctgtggctgttctcaacaagaggcctacatgatgaaaacgataaccataacataaccaaaggagaaatgtcttgaggagcttgataaagaaataaaacaaagtcgtaaaaccagagcaaattggaaagtacccaaagtgtttcaggaaagatctataagcaggtaacaatatttcagcaatcataagaattagggaatctcgtaaatctctgtcaggaacaccccagttcatctgtttctggcaaatctcttcaaatcgcatgttgaaacatttcaatctgagaagagttagaaaaaaaagaacatagtaaatcgcaagatgaatcaccaaaaactgagtacatactacattgattatattggtatttcagcctaacctctccttgatcacagatctggaggttgtactgttcttaatatttctaaaacttccttgagtgacatcaattgaagagcctactgatgaagtgagaccttgagttgatagacactccaatacctgcaaactcagaacagttaaaaaaaaccttgtaaaaatacaagagatgctcggttaaatcgtgctgtcaagctttttgtgatcagacctttagccaagcaactcttctatatcgagtagcatgttgttgcacaatccttcgttgtctttcaatccaatcagcacctaataaatccttcaattctgatctgagaataagaaaatagttatatcattcagctaatcagatttttggtccttatatgatatctactgacctgccaatatacttgacaatataatggatgttgttcatcaaaaagaggtgccccagagcaaggtccttgtattgctttgccttcatagctagattggtctccagagcatgtattgcaccaacaatttgagagaccacatcagtatctttttcatcttcaacacagggatctccaaagatctgctttattgatgattgatagctgcatcagtttgatagctgttaagtcagatagttgctaacggtattaggccatattctattggaggtcatatgaagaaaactcccaatccccagatttcacttactcaaaaagaaacttgatataatcagtgacatagctggtcatataatgcacagccccatcaacagtcgtactcgtcaccgagtgattcagaatgtattccatgaaatcacctattgtctttttcgcagtctgtgcaaggcttttagttaaagtaagggcagatttctggttttcagagcatgcattaccctcaaagattgcatcaacctaacataaccggcccaagaataatggttagttctttgaaatgagaaggcatactcagtcagaatgaaacttacttctttccctcatattttggccctttgaacaaacaaaatgtaactatgtacacagcaaaggtcagatatcattgttctttcaccttggattgaagttccaatgttgccttatacatatctagaagtatatatagtttgtctggcaatatttgggattgaacaacagcatctccaaaactgagtagaattgaaaggctttagctgttacttcagcaaaacaatggtctttccatgtatactttccttcaaatacttgatcacacagaatgcgttcagcgccgaaaagcaactttacctgttcgaataaatagtcagatattactgccaaacaacatcttgcattttaaactttatgcagtcaaggcaagagcatcactgtaattcgggagaattgtgtccactcggcgattttagcttccatgctctgagcctcaacttgctgcatttcttcttttgtaacatattcaactcccaagcgcttaagagtccgttccaaagttgaactacgaatttctctgtgggaatgatggaaaatgtgaacaagcaaaatcagaaactcagaagcaaaatattgcaagtagaaaagactttagaacttttgtagattgcacctgtatatttccataaacttctgatggcaatcaagttgaattgatttctgtgctaactttgagagcaaagtcaagtaacagggatcaacgagtgtaggaagagtgcactcagcatactgttttagcggtgcttcagaatatccccggctgatgggacaataaggtcctcac

SEQ ID NO: 13762 - DNA, 8029 bp, Oryza sativa
  unsure (1)..(8029): unsure at all n locations
tggattgctttagaaagcaattcgttaacacgttcgtgaacatcattaccaactctacatcttatcttggaagtaaaaaagtattcgacactagtcaacttatcaatcgcctcaagataggcattaagatcctcgtttggtctgtccaataatatcacatgttctgcctgtacacatggaaaatcaatcaaatgtcagtaataaggaacccaattctaaaaggtaaagtatcaagcaatctaacatgatcacccataaaaaaggactagagatttttttacgaagacaacaaccaaagagtattctaggtcctagcatgcatttatcagagaaatttgcatcatcaagcaacagaaacgagtgattagaattagttactacccgcgggtgccctaatgtaaaaagtgaatcatggaatgaaagcgagaacaatgccggtcgattgctactccacatcataggcgactatgacccaaaacctcagatcaaataggcgggtaggtacacagtgcagaaaagtaggagcagaattggtgaacagactaggcacagaagtagacccgcagcaaagctcggattgaaattcgagaccacgccgggggaaccgcaatcgctctccgcccaaaacccaagcaattttaccgcacaagccaagcgaagcaaagggaggagagtacgggagggcggcgcacggcagatgcctcaccgcggcgcgccggctccgtcgcgcttgctaggcgccgccggcattgctagccctcctcccattcccctcctccggcggtcgccacgccggaggaggctgcacgccgccggccgcatatcgagggcgcaatattgggcccggattggggttgtttagtgggcctgaggtggtttatgggctggatgggctgtagactagtaactctgtttatcgtgggcctccgcttcaatgccaggggccggcccatcggacaggcctcgtccaatatcggctaaattcaaacttgtagtagtaacaaactgatcgatcgacggaggagggggtgaacaaatatgaactctcatcatcagctaatctaatctgcacctgatcgaggaacgaattgaagctacattagattacctcccttacaaggtcgaggtggcgcacgatcgccccggccgccgtgaggctcctcctgatgttgtcatgaaccctgcacgcgttgtacgtcctcttctgcatgcaaatcgctcacaatgagattctgagattgatagatagatagatttaaagatcaggaagaacataatcccttacatgggcagggcgcatggcctcgtcaatggcgaccatgtggttgttcaagcgagtgcctatcacggcagcctccttttgcatagcttcgctgctctgcatcgcctgtcgcaggagctcaatcttcgcgcggagagcctccgccgccgcctcctcatcggctgctcgctccatcgatctcactgcccctctctgcctactgctctctcagttgaagaagaactgaaaggaaaacagaatagaacaaatgacggctttatactcgcggggtctggtggtgtctgcatctgcatgcagagataagggaagggcgcttttgaacgaaaggacgctggttttttttccgtatctctctcgtacacattcttatcgctagtccatgcacgttaacatcgggtcgcttttgtatccaccatggacatatatccactacgccaggttcgatccatcgcatctgttcaaagtcctcaagacaccaggatttagatcatctttgtttataggctctttgtttagtctaattctaaacaaataagcagttttttgtttggtttttttaaagctataagtcactcttacaacggtaagtcaaaagttatgttgaagaaaattttttaacttccgtaagatgaagcagtttttttgtttggtttttttaaagctataagtcactcttacaacggtaagtcaaaagttgtgttgaagaaaaatttttaacttacgtaagatgaaggtatgtctcttttattcaatttaggattttaaatccaccgaattataaaagatataagctaacctaaataaagagggcctaacaactggttcatatcttctgttttccatagtaacaactaggagtagagtgaattttcatttgagttttccagaaaagaagaaaataaagcacacatgtataatatttcttacgaacacctgtaaaaaaaaaactgacggcatattttgatattaccgaagtcacccatgtgctttgttaaaaaagtaattacccataaatataaagacttattattatttactgctccgtattaagggcatgtataataatatttatgaaaacgacactaataagagttgactcctgtttttttttgacaaattggtcattttataaaacttatttcgaaactagaccgtgaaaaaaaaatacttcaagcaaatagaccgcgacctcaacgccaatgcttctggcgctgaggttagcaaaaaaacgcttgacgctaagcacctgccagcgtggcggccaagccattcccccccgccgatgtggcaggggtctgagcatggagcccacggcctttttttttttcacggtctagtttcatcagtttttgaaaatggctaatttgtcaaaaaaaaaatcgagttgaccctgaaagctcacaaacaaggagaatacaggtttgcctttgtgggaaacagttgcgactatactcccgcaactgcaaaatggaggcactagaggttgcattaacattggacaattattgcacactgctgatactgaataatgaatgcactaacacgagtttccaacatatcagaacgaacctagcacctaccaaatcaacaaaaacaataaatggcaactaggacagtatctatacaaatcatgcaccccagcaaggaaaggtgcacatagcaacggttctgagcagcagcgctacacaaacaaaagcaatgctaccagggtcccaatttacagagaatgacatcacatcgtcgctggtgtatattaagcagccacataccccaatcaagtacgctcttgttttccttcaaacaaattggcaagcagtagctcaacttgctctggtgtgtgcttgacatattttccgggtgccttgctgttctcgatgagaggcctatagattacaagtctcataagctccagggacaagaactcttgagtctagtgaacatacatatccatagaaacatagaaataaaagaaaagagggaaaattcatggtattaaacaaatgaacagatggcaatgctcaatcatcaaaattctgtggaccagggctacgccggttttaggacaggcaaatttgttaaagtctctttcttaaacggcaaagcagaggagatgcaagcaacaattattttgccgagggacagtcggtcaggtccaggtctgatatcagtggcatgtggtatgcaccaaagctgggcctggtgaaagcacccggaacactctaattcctactactgactaagatcttagtcaggggctgctgttatttctactaacaaactcataattaagtgccagcctaaacagtcaggattcaggtctagatagaaatcaaaaggagaataaggagtgtctcctaaacagccgtgaagtgtatcaggttctagccttctagggataacgcctttgcaatttatattgtaaatttgtaatgctagtaaataattttgaattcataaagcaccaaattggtaggtaaatataatcttcatggtttttttaaacctaattaaataatataactggcacaaacaagaaaatgcaccaactcacatttgacaaactgccagaaacaaaaacatgagcaggagagtttgaatagaaaataaaggattagttatggtccttgtccatgcattaatatattatttacatgtaatgaagtttcaaagaaacatacccaaagcgctttaggaaagatctgtatgcaggcaacaggatttcagcaactgcaagtcttagtgactcacgcaactccgtatctggaacagaccagccacactgcttttgataaatctcctcaaatagcacattgaaagacctgaatctggttacaaaatagtgggcaaaacactgtttcagaaattgtatggtaaaacatcattcatcgaaaagcaagctggaataattagtgtacatgaccaacctctctttgaccgcagctcttgaagctccactgctattgcctccctcacttcctacttgaccactacctcctgatgaagtcaaaccttgaccagagaggcattgcaagacctgtaaaatcggaataatgcatagatctttaggctcactcttcctattaaacatcaacaatggtaacaaaatgcaagagaaacaaacagtgagttttgttcaaatatgtctagcaaatggacctttgaccaagcaatccttctataatgatttgcattttgttgtacaattcttcgatgcctttgaatccagtcatcccccaataaatctttggcttctgatctggaagaaagaaaagagagcattaaactatacccactcatccagttactaacctattggctattgcgaatttgtttataccttacttcataagaacatacctgcggacagatttcacgatataatgaatgttattcatcaaaaatatgtgcatcaaagctggatccttgtattgttttgcttttgcatccagattattctgtaaagcctgcatgatactcatggttacagtggccaactcagaacctgttccatcttcccttttgaactcctggaagagctgttttagagttgactggtagctgcgaaagattaaatgttgtcattttttttgcaaagctatagccagttgcagcttgacaaaacaagacattctgaaagagcatttaataggtacaaaattggatatagataatgtttgcaagaacggtacaaaagaagttcagctacattggagtgatctatttgttgtcgtatacagctggggaaaaataatctggtcttggtgaattagaaggctatccaatagaagagatacagcagcaacgattgcaaaacacaaatatcagcatactggtggataggattgaagaagaaatgcaagaaagtatagcaatgcaactatcaaattacaggaaagattaagtgcacatgatcatatacttactcaaataaaaatttgacatagttaatcacgtagctcgtcaaaggatgcactgtcccatcaatatgaatattctttgttgcgtccttttcaacagcttcttcaaagtcactgaaagtcttctgtgcagtttgtgctaagcattttgtcaaactcaatcagactcacgcatttgagagcatgattctccaacaaagatggtgtcaatctacacaatccataaaaaatgtagatattacttatttccgtgtcaagaaaatagcaccatatctaaaataaatttacattcagttgacagtctaaattctccatagttagttagttactataacatttgtctagtgaagtcgtttttcattaaagaatatgcaaacaagaaagtccaagttccaaagaccttggtgaaaattgatttctggtaaaacggcgaacttcaatatagatggaccaacagagaaattttggaaatatggcaccacactgtgtcatataagtatgataatgccccatgcacttctcatactttgaaatctgcagtgagaagtttggcattttgccccttttttcacaaagcattcacaatatcatttaatcatatgtttcttttgcattttatcaacccaaaaatatcaagctgttgagatcagtactgcaggattacgtcaaccataaattggtccgatggcataaggagctcaaaatttttagaaacttaaaaacagatcttaactcagcatgcacacacttatcatttcgcagttctgcacaaaagggttgtggctggccaatgaaacaattaatagatagctatggtatgaatcagaaacttacatctgcttgaagttcacacattatttcatacatgtctagcagcacaaacagcttctctggtgatcttttactcatagcaattgcctctccaaagctgagtagtgtagccaaactattcctagttatttgagcaaagcacttatccctcaaagattgactgcactcaaaaacctggtcacaaagctgacgttccgcggcaaaaagaagtttaacctgtttaaagcaaaaggtgtcaccagaggcatgttgcaccatacagtagataagagaaaaatccttacagcaattcgcatgaagtgaatccaattccctattttagactccaaaatttcccatggcattttctgcacttcatctttgctcagtttttcaacacccaagctcttcaaacttgactctaaagcagaggcacgggcttcgctgtgcacaagaggagaaagtgcttgagtattttgccgcataggaggtagttagcacataggccatataaacaagaaaaatatataaaggaatgcaggagacaagtgctttaaacttattcacagggagaacattttgtttttcctttcagctggaactggcagtccaaactaaaaaaatcatttttcatggttttcacaaaggccaaaaaagtttataaatatactcaaattgacaagtatgaaaatagctcgcctagccttgcttctatcttcaatcaatcaatctagacaaacatatgtattttcaacccgtttcattattcatgtgagcatcaaaaggacaaacagaacaaaaaatttccagatattacaacaaatttagtgtctagtatccatgaagtgatgaatagatatatagcctgaaaatatttatcttccttttacctgtatatttctgagcattgttgttggcatcccgcttgtaccaactgttgtgctaatttagccagaaaaggaatgaaccttggctcaataagagcaggggggctgtatacagctgcttccgagttttgctgattttcagaatgtgattggttttttccaccttcaggatgagattcagatgatggtcgaagcgtacttggaaggcaatcaaaaagacgatcaggctcgataggtttgctggaatcagtcaggagggtgcaaaatgcaagttagatgatgttggggttaaaaacatttaaactaataatgagacacaacctgcgctgagtcaattgcttctggaattcatcttccatcttcacaagggccttagaaaggagggcattcacatggttgagcacaccatcactgcttcggtagctcctatttgagctaaagaaacgctcaatacttctcaaccgatcaactgcatctagaaaaccttgaagattttcatgtggccccttctgtatttcacgctctgcctgcacagatgacaataagtcaataactgaaatcggacctttctccaaagtaatccaacactgaaaaatagctaggtacattttttggattcaaggtcttcaaaaatcggtcaaaaggaaaatccatgtccaaccatttagttgccaaacccaatatgggcagccatcaaggcacatattgaaatacaaatacttactgtaattcatgttgaagaaaacaatttatatgcataccgccacatgcaatggagaattctccttcctaatgtatctataacaaatacatgtggaccatgtggtaccaaaccaacaatacgctgcctcacagtgatgtatacaaactataattcaagctataattgcccccaccaacatgcaggcgaaacatcaaagaccatccagagaaaggacaaaggggagtgaagctcttttaaccaaatgagaaggattgggcatgctccacagcactcctgagcactgctggttcatattcgggagcaaagatgcattttagaaacttaaaaaatgaagggctaatccaccgnnnnnnnnnnnnnnnnnnnnnnnnnnnnnnnnnnnnnnnnnnnnnnnnnnnnnnnnnnnnnn

SEQ ID NO: 13763 - DNA, 5256 bp, Oryza sativa
  unsure (1)..(5256): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaagcactttgtcaaggctgtggtggatgtgtttgctgatcaatacttgagagcaccaactgctgaggacactacaaggttgatggctataaacactccaagggggttcccagggatgctaggttgtattgactgtatgcattggaggtggaagaattgaccaacaggctggaaaggacaatactcagggcatgtggatgggccaaccatgattcttgaagctgttgcatctaaagatttgtggatttggcattccttctttggactaccaggttctcttaatgatatcattgtactacagagatcaccactctttcaaaggcttacattagggacagctccagagttggagtttatggtgaatggaaataaatacaccatgggttactatcttgctgttggcatatacccttcttgggccacttttgtgaagaccatttctaatccacaaggtaacaagagaatacattatgcaaaagttcaagaaggagtgagaaaggatgttgaaagagcatttggtgttctacaagcccgctttgcaatggtgaggggtcctgctagattttgagatacagagaccctatggtacataatgacagcttgtgtaatcatgcacaacatgatcattgacaatgagcgagatgaagatgtagattttgactatgatcaggaggacagtgaggtgttgaggaaggaggaataccaacgacgtaataaacctgtgttagaaaaatttctaaagatacataaagaaattgaagaccgacgggtacataagcaacttcgagatgatcttgtggaacatttgtgggcgcttcatggtgctcggtagtttgtttcattgcattttctatcatgtgtgggttatgttcattatttacttctaggatatatcatttccatgtttgaaaattttgaattcaattttgaatcgtggtgtttgaaattgcaaatttgaatatggttgaactccatgcgctagaattatttatgtttaaattactatgtgttaaactagatataaatataaattctataataaaataaaagagaaaaaaaataggggctaagatatggaggctactactagacataaagacatatttagggtctagaacattgagggcagcccccatttaacttttagggactcgaaagtaggggctactgctagagatgctctaaccctctccaaatccaaatacacaaccatttccttttccggagaaaatctagaggaaaaaaaaaagaccttttcagtatcctccctcgacatctgaaatgtcaaatcggaagagacataaacagaatttgcagacacagcaatcaaacttaatgaagaccacaagatatataattaatttataccttctccgttgagctttcctcttcgagactgaccggccgccgctgttcgccaccacacactgcccataggacggcaacaagctcgcctccggcggcggcggcggccgccgccgccgggagcgactggtcgtcgcacgccgcgcggagcatgagagacgcgagcgcctgagacagcgagtcggagatgtccgccaggatcacctccacggcgccggagctcctccctccgccgccgccgcctcccgctagcatcgccttgagctggttggtcgacttctgcgcgctgcggatgagcctctccgtcgccgccgtgccgcctccggcgccgctagccatgtcaaaatgaggggaataaagtcaagtgtttctctccttctcgtgccaatggtttttgatgctggtcgatcgatggtggcgagtgtgcgctagtacagagggtaactattaggataatcaatgtatcttgcactttattccttttcgatactgtcagactcacttttgtctttgttaattactccctattatacattgacttttcctagctaacttcttaaatttaatttaatcaagtttataaaaaaaaatagtagacgtattcaatacaaaacaagatcctttaaaactaatttggtgttataagcgtgtggttaaatttttatataaacttaattaatcttgaactaattaattagagaaaaaaatttaaaacatatatagtactaatccgagtgatacccttttaaatcagtgaagatataccgtaacatatagagatggtaatgggcgatatgaactgatacccgacagattttactctattactagtcacatattatctaatttttgtactcattggtctattagcggctaaaaatccttagctgttgagtacatgggacctgttctttagtcagtcatacctataaatctatgtgtaaaaaaatgtgtgccattaatgtattgtctaattcttatatggtttgtttatttgctttgaatgttattaatgttagaattacggtcttctgtgatgaagctggtatcaccatcaagctcagaggactaatgctacctctattttttaatttgtaggacgctgactagttaatgtttaaactaaccagtgtcatataaaaaacaggagggagtattatttttgaatgatcgattaatttttatggatgtcgatagctattgatcatagaggtgacaggaacggtgaagccaggcggcggccgcctgaccttgcccggaaggtggatccgccgcgcggaccatcttatgcaccagctgaaagctacgtggcaattttttactagtaatttaattcttacgtgtttatcaaatttcagctgagtcgacgtgtacaacggcagaccatttgtatcaattttcatgagcacacgcgtcaaatgttttctacggtcaaaaaacgcaagaggataagcgcgcgtctaagttctgacactccgaagcctggtatgttattctcttcgtccaataatatacgttctaatataaatgaattgtttatctagatttattctactaggatatactaaatccacctaaagtgccttatattatgagacagaggaagtattgtatagcatatattttataaataatgtcgaatagcaagtcaagtacataaccactcgatcttaattaggacccatttggtaaagttctaactcctaaatttagcttcaggagttaagggtctatttgacacagctccagctccacctctcctggagctagagcgtagccaaacagtttcagctccacctaaaatgggagtggagtgggtggagctctctcacaaatgaattagcgaggtgaagctgggtttgggcanntncacnactctactccagacctaactcctggagttaaatttaggagctgcagctctaccaaacgggccctaagtctggagtggagttggtggagctgcctaaccccagctacaactctctagttcattttgtgagaacgcttcacccagctccactaccatttcaagtggagctgaaactgtttggctggacctaggagaggtggagctggagctgtgctaaacagatccttactatctgtcgagcaatctttgtgtagttgctgcactgatggagaaaggaactttagtcccggttgtgcaaccgggacacatgatccgagactaaagatgtctaacagggactaaatatgcataccaagttaaaaaaatgtgtgggatgtgagatttaaactcaagatctctcacctcagccctcacgcacgttaccattccacctgctacacactaaagatcgattttttttttatcccgggactaaagatactccatctagcatcaacccggacttaaaaatcaatttttttcctggggctaaagatcatcttttagtctcggttgatatcaccaatcgggctttaaaaattgatctttagtctcgggtggtagatcgttgggggcctgacagctgttgaacctttctattcgaaccaagacaaatatgatcttttggcatccgagtaatgatcagttctccagtaatgtagtcttgcttcatggcagtaatgttttggactggaaaaatgtatgatcccaccatatcctatgtaaaaataaggtatcattgccacaatgcttaagacaagaatatatatgaagatgggttacacatctagatgtaaaattcctaatttaagattaggcccaccataccctataaccactctcaccatatctggtgttggtgtgcatgtgtggccttatgatccattttatggcacattatagatgctctcacccactgactctttaagtagtggatccactactttaaggcattagaggtcagggctaagggcaatggtgctaaccttctcgttaactcagtgtgtcacctcaaatctcatttgccatcgcggtggggtaagtggtgttgtggatagcggcggtgtggattgctataacgtgttagacctctgcgctagaatggatggtgctaaaatcagggcttattttttaaaacatttaacgggtctaatcttacaataatatgtttttataagggtaaatggtcagattttcggtagttcaatattatcgatcatgaacaggataattttagccaacatttactaatattactgtactctcgtcgtgtcataattgtaggaactcgagatgatatttggctgtaagtttcacatttacttatacgcgattcggtcaaacatttaaacttcaaatgtttcaaaattagaaccaaatttagtctaaatgccaaatgtttataactggtgctatacccgtctcaaaattataaaatataacaatttttagttcacttgtccgtattcatagctaaaaattacaactaaaattttagggtggaggtacaatagtatttatatgttctctccttctcatggaactgatttgtgatgctaatcaactgtgcacaaatgtgatttgtggtcttaggccccgttcgtttttattaggatataaattttaccagtatgttttttaaactgttaaatggtgtatttcgtaaaaaaaacttaatt

SEQ ID NO: 13764 - DNA, 8854 bp, Oryza sativa
tcaaacatttaaacttcaaatgtttcaaaattagaaccaaatttagtctaaatgccaaatgtttataactggtgctatacccgtctcaaaattataaaatataacaatttttagttcacttgtccgtattcatagctaaaaattacaactaaaattttagggtggaggtacaatagtatttatatgttctctccttctcatggaactgatttgtgatgctaatcaactgtgcacaaatgtgatttgtggtcttaggccccgttcgtttttattaggatataaattttaccagtatgttttttaaactgttaaatggtgtatttcgtaaaaaaaacttaattaatcattggtttggctttgttgttttaggtattcgtacctaggccctgtttagttccaaagtttttttttccaaactttcaattttccattacatcaaatcttttatacacacataacttttctatcacatcgtaccaatttcaaccaaatttccaaatttcagcatgaactaaacatagccctagtctttttcttcatcattatctaacggggccttattacgaagtactaggactgtcaaatatcgtgcactttattattttcaaagattttctcgatgcacccttttctgccaaaattgtttcaagtcagtcaagatggtgaccagttattacctacgtggcatcacatcgtgctcttatgtggcatctcctgttctagctagcaaacagttggatatgcatgcatgttgcaaatttcaactgagcgccgacgtgttcacggtgcaaaccagatgcacaaaacttaatatcagacgccaagaaagatatgccaaaaagcgcaagagatttcttgtctgaatctgacgtgcacttcggatttaactaattaattagattttgttcttttatttttgctagctagtacatttctcctttggctgaccacttaattgatactatttgggtaaaagtttccttgcttgaatttaatattaattgtctcgatctatcattctgacatcgactctttgagccaatgtcatacatccaatctcctttcaggaattccttcaatatttgattctctattctttaaaaaaaatgtgcatacagttaagaaatcgatatctccgggtcaaagcttcagcaagcgaacaagctaagggctctttttaaccataggaatgaaaaaaaaggagaaataggaaaaacataatattctgataggaatgtaagggtaaaacagaggattacaaaatacagaaaaaacatagaaatgatcgtttgattggaccatagggaaacacaggaatcggataagagagatagactcaaaggatttttaccaagaggttggacctcttactaagtttcctccaaaacctatacgcaaaaagtcattccatcagaattttgtaggatttggaaaactttaatcctttgaatcaaagggccgtataggaaaattttctataggatttcaatcctatgaaatcctatgaaattccttcataatttctttgattgaaagggccctaaggtagtatgccctggacaaacctgatgtgccttgttcaggtagaatcaatttctgttttctcagaagagtgtactgtaattgtaatttgcgcaagcccaaactccataacagtgtttatgctttactgcagcagtacaattagtaatttgagtgctttcacatggtctctaccgacagtactgtactactcgtaaaaacgaccttaaacattgattcatgtattctactatatgtggaataatgatacttcaagtaaatcatgttgcgagctttgcaattatttttaaactcagttttgctcgtcgcaataattgccttaagaacaaatagtgaatttagacttggacgataagtgatgcagaaatggtgttagttgtgcactgatagcaggagtgttcgcctgagtcgattaagaaccgaactttgtgtcacccactattgtttaccgtacatccacatgtgctagttatgggatagacttagttgattaagttatttagggtctaaccttatattttggtaggccggagtagtatgaattagttttagtggtgattaagaggagctaactatttgcccgctaagggtaatccaggcaactatgtttatccaatataatggtatagtccctcatggggaaacatatgtgtttgacgtcatatcgttaggtttaaggcgtgggccagccacctaatagctctaggtcattcacacttgtcgttccagtgcaaagctaggctttgagtaatgtaaaggttacgttgtaacttctagaccgcattcaacacgtagagtgttgtggtaccaatgggtaccggacaaattagagtactcacattatgtagttaacgttgtacaaactttgtaaagtgtaaaactgttaacaaccaaatttggtaattcaagtatcggagatgaagataaaaccgaagcggaatccaagacggagatcgttctggaaacagagcaagaatcagttaaagtccgaatcagctaagatcagaatcggcagagttcgagtcggacaaggttagccgattaagccgattctgacaatatgactcgatatatgacatcgggttaggttaaagtgctaaattcacatggattgccatgcatagattgagttctgaaaaggcaattgtatctattaattaggatattttatgtaatttccttagagatatgttcgggaaaaagtctgccgtaaagacttatggtatcttagagtttgttatagataagagtcgtgtccgacatggacatattttgtaatctcgggtataaatagaccccgagccccatgtaatcaatataacacacgttcaataacaatctcggcgcatcgccacccatttacttttgtttactttcgacgagttcttgcttttaggttgagctgcatcagtttcgatcttcaactagaggtaaaacttgttatggcggcttgcgttctcgggattagtgcttccatctttatgatactctaatcttgtttatgtaattcgtcgagttatcatatattctatataatctctgacaatattgttatctaaccttcaatcggctaacatctaccattagaaggcagtcgattaggttaaatagcaatgttggcttagattatatagggtatctaccatcctatgaaacatccaatggcttgattgtctagatattgttcttctcttcatacttatagttgcatcagttgagtttgaccttataagtcgtgattagaacaatgatctctagcctgcttttggttgccgattagggtagtgtcgggatttcagccgatcttacctgatttagctttatattttatgtgcttaattgatatgctagatctgccctttatgttaagatcttaatacaacaaagtatgttaggcttctgtttgatatattttacttgctttaatatcttgatatagagtagtatcagagtattagccgatacatgctaggtctatctgatcggctatgttataagcatctataatcttattgttaatatatattttgatctaagtgatttatactatctcggcatggcgaccgatctatcccaatcacttgatttaagtatatatcgacataaggattatatactgttaatatctacagccgatcgaatagatttagttcttccttacttgttcatgattgccgatcgacttaaatatgacatcggctcaaagataagtgatacgtcatcggcggctggccgattggctatcatttatggatttaactgcggtttctttgtctttatttctcgttgattgcaggatcaaatcaactggcacgctcacgaacctaaaggcaagattttttggacatgcactggagttaagcagatctcccaggccttctgtttctcgcatcaacaaaaactaatcgattagccgtgctcatgtttatgcgcgacatagtgtgggtcattggcatagattttgtgttttataaatgcttttgaaagtgatatttaaaatgatgttgatgatgatacttgtgtatgattgacttgctgctgaggagggtagcaagcatgctacttgtattatgatgatgaatatgatggtaatatgtcactaatatgatgctataccatgataactatactaagtcttgcaaatgcttatttaaaattctgttgcaaaatgtttgtgaaattatttcagcttaatgcaattatgagaccataaatagccattccttggtatttagagcttgtatgtatttaggattgtattgccttgccagtacattaaacgtgttaatgtattgacacttgtttctttgtggtatattttagttgtgttgcaggtagttgagtgcagcgcgttccgttgatctcttcaggacggttcattagtggtctacccctagttggcttgcttatgggtctttggtagataaacttccgtgtgaaccactaattataaggccggtcgaccgtatgtttcttaaacttagactctaaattatcaattttttataactccttgtttatggatgccatttgttttgatgaaagtgccttggtatgttctatgcttatagaatatctagacatgagtgtggattgttgaacaacatagatattctagaacttagcaaattaagtcaagtctcctagtatgtgtaacacatctggttgccaccttcgaatggttaacgggcatgtctcagactgaagttgaccggcacgctaagttttactacctccgtcccaaaaatgtagctatttctagcatagtgccttgttccaaaatgaaactatttcttcacctacctcctctcaaccaatcacaaccattcttcttcacctactttctattttcaaccaatcacacacttcctccaatcattctcacatgctttcttaatacccgtgccaatcttaaaaataggtatattttgggacggaggaagtagaaatatctcttttgcttactatttagcactacatagattatattgaatggtgtttaattgtgatcatagggcacattgaggcttgagtgactattatgcatgtttggatcccactcacccaaaataatgtgatggtcgcattaaacattagactatatattttttgggtgctctacataacgacgctgtagatcccttgggttataaaaggaggggtcatgccactagaaaaagagattttcaggggaaaaaaggaaaccctaggtagaacagaaaccctagttcacttcacaagcttgtattgtacacttttgcatccacatagtctcaaacacgggagtagggtgttacgcttccgagcggcctgaagctatatactcgcttgtgttcatttttacattttcgcggtaaacaaactcgaactctgttcggcccctggctaaatctccaatggggggaggagggggggtcctttctgccctgttgtaggagtaccgatatccgatatatacttttgtggtactttgaaccaccccgactgtcttctcaagcatatgaacgacagtcctgtacgctggctcctattcatcaataaactccctatgttgtagactgtttcttcaacatatgacaaattggatgtacacaaataatagagttgaggatgatccaaagtgtcacaaaggtatactaacccagtccaaagtgaaaacattggttaaatggtggttcaaagctaaacaccggtaataaaatgttgtcgaaagtgaagtttactttaacctttttatatacacattgcatttattttgtttttccattactccatattgatttcattttagtttcatattctatagaagttatacacaacttagtgcaattagttatgacatgggctttggtttatacaaatcaaacacgtttatgcaccaaaacaaacaactgacaggtaaatgtacgtacctcgtaaaggtgtactgactatgcaatttacttgttcattaattttatttagctttaaaaatcaataagtagatgggcagctaaatattttgcatgcttaagtagatgtgtgaaaaatgattataacatatcattatatcaatacacccttaaaattgaaataaacaatgaaaataactaattagtgttattagctaaaaatcaatgattagatgagcaggtaaatattgtgtatgcataagtatatgtcgggaaaatgactcttaatacacgcctaaatccctaaataatatgatatgctgtatatttttctccaatttttctagcatgggctgtgctggagtccgcacgaaacgccttctgttgcaggccactaacgggctagcagcccacttcggaagatgtaggaataaattcactttgactcccttaaaagtggcccgaatttattccatgatcctaaaccgtaaaactattgaaaccggtacaatatatttgactaacttgttggttttggaggacgatttcgctgacgtggtgatgctgacgtggcagggttgacctactctatgggttgacatggcatttagttagcaattgaattaaaaacgtatatgtgaacctatttatcattcacacgcataaaaagttgtggggcccactgacatgtgagccccactgacatgtgggcccacctatcatcctctctctctttttcttcttcctcccatcttccttcctaccctctttctctccccttttctccccttcgaccggccgccgccgctcggcggccggtgggaactgaagcggcggcggcgatgggagctgagattagcggcggaaacaatggcgtgggcagcgccgggaagcatgggggaggtgaggatgccgaggaggaaccagttgaggctgagcagcgggacggtgttggaggaggagaaggtcggcctgccgccccggagcgcggcggcggactcgcggaggaagaagaagcgcgtgacactgcacatggacacgcccatcgtggcgaacagccccaccagcagcggcaggcacggcgcgtccgccgcccacgccaccgcccccaccaccgccgccatgcccaggctgaccaggctccgccgccgcgccaccgccttgccccgccgcatctgcacggacgtctcggaatcctactcctccatggtcacctccgtcgcgacgccaccgccccctcctcctcctgagcggcggcggcggcggcaacttcctctgcttcgtcttcccggtccttcctcttcctcgtgttcgacgggcgcgtggacgccggtaagctctcgccgccgtgtgccgtcgacggcggcttcttgtcccacatggacttgcccctttactcgttgagccgcatgttctccagcttgagaggcttcagctatggcgccgcaccacgcaacaagtagctcatcagttccccaccattgatgaacatctcaatgcttgacagttgacactactttacttacctgggtctcgaggagagtgatcctggcaaaggcgtcgtcgtgcttctcctccatctcgtcaagaatctcctccatggccttgctctccttgagcgccatgctcagtttctcctccagctccctattctcccacaccaacctctctatctacatctgcatctcccccaacagcccgtgcggtggcggctagccgaaggggagagaaagagagaagggaagaagaggggaggaagaagagagaggatgacaggtggggctcatatgttagtgggccccatattttttttttttgtgtgaatgacaaacgagtcccatcccacatatacgtttttaattcaaatgccaactaagcggcacgtcaactccacagtgtaggtcaatccgccacgtcagcgaaaccactctctaaaaccataaagggagtcaaattacacctgtttcaatagtttgggggtggagatatccggttttgcggtttaagatcatggattaggttcgggtcacatttaaggagtcaacgtggatttattccgaagatgtagcgcgtagcctcgataggccgaattcctgttccagcctaacaactatgggccccgcgcgggtcggccgcaatttcgtcctggcccatgtgaatttggccctgaaaatatctataatagaactgaggcccattgttgcgcgtgctgggctgaaaagaagaaatggagaaagttggaaaacatatcacgtatggaaaaagtccagtttgactcccttaattgtacaccgaatctaattcgtacccctcaaccagaaaaccggatagaacgactccccgaactattgaaaccggtacaatttgactccctcagcggtattggaggacggttttgctgacgtggcgctgacatgacggtgttgacccggttttcgtcccacgtggcgcttaagtggcattagaattaaaaaaaaattgtgggacccatctgtcattcatatcgtgggacccattgacatgtggggggcccacatgtcatcctttctctccaacccttcttcctcctccctctctctctaccttctctatcttttctctccttttttctcttccccatcggatggtagtgccggtgaaggacagggggcggcggtgccggcgtcggggacatggggacgcggtggggcgaggaggccgcggcggcgaggaaggcacgagggagcgactggggggaggcggcagcgaccggcgcgggcggggatgtcgcgcgccgggagggggggaagggggggcgcggtcgtagctgccggccgcatcagcggtggggacgacatgtcggggatacggggtcgcggtggggcgaggaggccgcggcaacgaggaaggcacgagggagcggctggggggaggtggcggtg

SEQ ID NO: 13765 - DNA, 17889 bp, Oryza sativa
tcgtcctcgtcacgagtcgggccacttccttgccgccacctccccgatgacgacccagactccggcttcgcgcccgacgacccggacctcctctgcaactgccccgtccccgaccgcctcctcgtcgtctccgcgggcgtagccgccaacctcctcttcgccttcctcatcgtctacgccctcgctcgcccgccgccgccgctctcgtctccagcgtcctcggccgcagatggggaagggggagagaaaggggagagagagagaggaagggaggaggaagaaggattggagagagaggatgacatttgggccccatatgtcagtgggtcctacaatatattttttgtgtgaatgacagatgggtcccataattttttttaattctaatgccacttaagcgccatgtgggacgaagaccgggtcaacaccgccacgttagcgccacgtcagcaaaaccgccctccaataccgctgagggagtcaaattgcaccggttcaatagttcggggagtcgttctatccggttttctggttgagaggtacgaattaaattcggcatacaattaagggagtcaaagtggactttttcctatcacgtattcacgtgtgaaatctaaaggggacctgctctatacttttattttttaaaaaaaatatttagaaaaaaaaacttatgataaatcaacgttgtcatgagcttgtgacgtttgttggttggcctcttacgacaaaataacactcgtcacaataatattgccactagactaggttacgacgatttgtagttcgtctcattgatgaaccccttatttttgtcgctaagttacactatcccatagagagcgaaataaaactgaatgacataattataaatagcttcgatgtcaggaaaaattcttcgcaaaaggtcatgtgtgttgtagtggacggattattgcagaataatcagtgcaaggatcagcattttggtccttttgaaaaacttatttcgtaaatagatccctagaaaaacttatcctaaaaatggtcctttttggggcgcccccctgccgacgttgcggggcgatgctgaggtggctagggggagtgcgccagagtggctgacgcccacccccctaaattttttatttttgttttatttgtttgatatttttttcacgcttagagacacacaagaaccaaacataaaaaaaattgaactcaaatggacgtaatatgtgacatgtagaatttttcctctcctctcctctctctctgaactagtgcagaggaaagagatgtgcaacttttttatttttattttatttttttgatatttttttcacacttaggaactcacatgaaccaatcatgtaaaaaataaactcaaacggacgaaatatgtggcatgtgcaattttccaaagctctaccgaaaaacttctctcctcgaaaacacaatcttacaagcggaatttggaggttttaatatcgccgaacctggcgaagcttgggagaatcggatgtaactttttctgtagatgtccatgcatatattatttgtctgattccgagtccgtatgagaaagttacgcctattttaatagatgacatattttgtccgtttcggtagagttttggaaaattctatatgtaacatattttgtccgtttgagtttattttttatacagttggttcctatgttctcctaagtgtgaaaaaaatatcaaaaaaatgaaataaaaataaaaaattgcatctctatgtactgtttaacttatatatgtcatttcatgtggttatagtggtagagtgcattatgtttaacatgctgatcaaagggttttactaaaagaattatggtctaattttagtgaaggtacaaagtagactaagtggtatgctagatattttcagacttagctaagtggtagttctagtttaaattttttttgtggttggttgtattgtgatcctgagtgtgaaaaaacatccgaaaaaataaaataaaaatgacaccgttgcaactccgcacagagaaacagggatgcagccgccggcgccagcacggctggcgccctcctcctgccacgtcggttcacgtgcgccacggtggcaggaggacggcgccagccgccgtcccgttggatgacggcgccagccactctggcgccccaaaaaggaccatttctggtataagtttttttagaggtctatttgtgaaataatttttttaaaaggaccaaaatgtgaaaaatccagctgcaatcgccatagagcaagtgaacgggagtcccgagaacccggatcgcatagtatacttgtatataaatagaagaagttttcttctaaacttttgtatcctgttattctaagcaataagaaacacaccaggttagccccaatttccagattgagtgtcattccacattttatttccctttgttctttgccattgcaggacaactacattcacccgcaaggtgttcgattgaggttctaggcaacaaaggaattccaaagtattgaaagtaaatgtgcaacatattaattataaactgaaatgtaaaaattcgaaaatgtacatttttctgatcgtttttacaggaatatttttatggattgtcttcccaccgtcaccgtgatattatgcataatttatctacttaatttataatcttgtaggtcctgtcatgccatatgatactacaggacagtgtacgtcgtcaatgcgtacaatcagacgggggcagagctaaaataaaatagagaagggtgacacttgcttaatttactctctttagattaagtttaacctgatgcgggtgtctaaatttgtattgagtgggatacacacataatgaaaataagtgagatatagcttaaaaaaaatttcttgaccgggttcctggtacccctccaatactctagtactcgatgctctccgccttcgacgtcgccatcagctcctgtttcgtcttgttgcctttaaaaaaaaagcgttgccagtaagggtgaaaacggtacggaaatttccgagaattccggctaccgtttccggtttgcgccgaccgtttcagtcggtatcggaaatggaaacggtaatcgcttttcggaaatggtagcggaaatgatatggggttttttccgaccgttttgtcggtaaccgttttttatcggtaatttccgtcaaatttccaacaaaattccgaagaagaaagccgactgggcctggctagcaggagcaggagcagcccattaggcattaagagactaaagcagtcgacatcgctgacgcgggtcgcagcctccttcgccccgatggcctccgtcgctgccggccctcttttcctcccccatcctccactgccggcctctgtgccgccgagccaagcgccaccgcgccaagcgccgagcgacgtcgtgccgagcaccgccgcaccgccccggcctcctcttccccaccggcaccgcccctttctcctctctctccttcccccaccgccgcgctgcgccaggccgccatctccggcgcctctctcctctcgggcgcgcgtgaaggagccgaaggcagagaagagaacgggtgagaaaacagagaagaaattgagagagcaggagaaggaaccgagagaagagaaggataagagagagagaaaagaaaagaaagagagaaaaacaaagacagtgggacccaccggcgggccccactatcttgactcttctccgtgacccccttacctggaaactaccaaaaagtctagtttagcatgaagcttaattacaatggtagttatatagtgtcaacaaaaaacttaattacaatggtagttaccacattgtatgctttagccatattgatgttgaaatatcgttgaactttttatattgtttgtcgaccttattgtcaacttattaatcatcgtataacggtgttgtgtggcagcgtgatgatgcaagggtgaaattataaggtcatcttcatacatagttaaatgtgggatgataccacagttcgttgtttccgacatgaatttttgacttccgaccgatatcggtagattcccgttccgacgattccgtttcagatataccgacattactgatatcgttactgtttccgagtagaccgttccgattccattttcgagaaaataaaatgaaaatggaaatggtatagggtttttccgaccgtttctgaccgttttcatcccttaccaagccacagatgttggtttcacctttccttctcgtgccactgtgaagtgattagggacaagcaatggagaagctgtagtcctgcctgatcatgcgtgttaaatgttgtcaacagcgcttgtcgaaacatgaattcggcaataataaaagggggtagcgcacgagacctaaaagtggatggatgcagagacaaggatttagacaggttcaggccccctcgttgagaggtaataccctacttctgtttggggatttgaatccgccatgtatattatagatctgacgatctagttgtctcatgccccctagagggcctcctgcccaccttatataggatgggggccatgattacaagatagaaaccttaaccaatacggtatcggtttcctaaatctactttacaatcttatcaaaccaggactttaggccgttccataatatagagggaaacataatacccaagtcatgatccgttacatatttcatagatataagttatcccctataaccagtcggataactatgccgtatgggtatggggtacccacaatcttcacagtagcccctgagaccttcacagtcgaaaagataatcttttctcgaactagattactccaaagataagtgcttcaatcatcttcgccatggtctcccgagtacttttaccaaatcagaagactgtggagggctgaaaaataattaaatgaaattttaggtgcatcgactagatgcacctaataggtgtagcccccgactatgtggttagttgagcaaactgaacatatagtcaaagagtaaataatccaaccaactgagtgattcttgataattatagtcaactaagtgacttgatagcatatacggtgtgaatccctaaataacatgatccaagtgatataccgactgctttgtagaatatgatgcgtgcaacctaaagttgactacatcattgaaaattcacatagcaaaatagttataaagaagcttgtatgttgtgaataaagaaatttccaaagtattgggcacacaccatgcgcacactgctttaacagatgtgcttaagtccctaaaagacacatggtttcaccacacatggaaatatatggcatatgtagtgtaacatccgagtaaataaactcataaaggatttaccaaccgcctggaaaatgaccaaaatatataatcagcctaagccataatattggtaaataaaaatgcacacttacgtgacaaaaagcaatgatattgtatccaatcaattgcttgataaacccaaacaacaccttgactatataaaaaagtcagcgggacagctatataaagctttactgttcgacaccttttaagatgcattgtaccaactcctaaaaagttgagtaactgtggtataaaaggattttaaggtattgggcacttgatcacgcgcactttgacctaagaaaaaagtgcctaagtccctaaaagaacgtgacaggtcacacctgaaaatatgggctgcagacatattaggcctaggccaaaaaatatgccttcgacaccctttaaaggatgacgcatgtaacatgctctcgagtaataaatcttccgggtgatatagaccaagtgtagctcatatgaatagcttctaatctgagtgattatcccttatgggatactccaaaatagatataataattgaatcccgactggcgcaagtattcggttgataacccttactgggaataataaatagtccagtctttgagcatagaaaatagacccatgatcatgaattcatgttgcatgtatccggaacaagtccaaattgaaggtataatacttgtgtttgagctagtaagcccctgatcatatagcttgtccttttgtcgtagttacaatggtccattgatagtagctgacgcagttggcatagagacaagacgaccaatatagagataatattgcccaccagaggtggcaaaaatattggtggtggtgaagatagtgataccaatcaaaagtgatgaagttgtacaaccgtggaggcgaagaaaccagtcgacagcagtcaggtcagccagcaatgaagatgaaggcgcccaacgataaagttgtgtagccatggcagcgaaataatcagtcggtaactgatgaggcagctggttaagaagatgaagatgcccattagtggcgacataataagccatccatgaaggcgaggataccggtcggtggcgatgaaagcaagccgacggtgaagatgtagacacgcatcaaaggcgatgacgaaatccaccaatcatgaggatgaagaaaatagtcggcgacgacaaacgcaaccgacagtaatgatgataagtagcaatcatagatgattgactatgatgacgaagttgcccatcaaacagcagtagaataggctatgttgaagaggcttgacaggatattgatgaagatgacgatgtcggtgatccagtcaatagcagtgtagcaactgatgataatgatgaagatgctcatcagcgtttgcatagtaggtcatccgtgaagatgaaataacaagtcggcgatgaaagtaggtgatgacagaagcaaccgaaggtgaatacgtagtcaccccttagcaacagcggagacgtcagggccgatgaagtagaggttctgttgatgatgtcagtgacaataatccttcaaattgttgagaagatgtcgaagctcgaatagtttccttgatgcaagcatgtgcataatgaagactgatgcaacgccccttgatttataaagatggcagtagaacttggtgctataactgttgcagatgctttacttagaggaaagtatatgctgttgttcaactcattgaatctgatctgagttgattgtttgatgactccaaactcccagacatgtaaatttaatcttgacctaccggtgtaataattggagtcgctgaagtaaaatgccagctctgaagcgcagacgaagataataactcccagagttgactcgttgattgattgattgcttcatcttgtcaaattttgagagtcttgtatttgtgtagcccccaactctttgattagttgggaaacaactgaacatagagtcgagaactgtagcttcttgtcgtcgagtagccatcacttgagtgaagatatgtattgaggatgtccggagagaaatcttgaatattggagcaccacttgttgtagtaaaataacacggcatcatatttggtgacgcataccgagatgtcgaagctcttgtagacgtcatggctagtgaagtagcaaaacttgcgaagtagcggcaatagagtttgccggtgccgaagacaatgaagatgaagtagctccaccatggtgacaaagttgcatagctgtgatgaagtgaacacgagtcggcggcgacagaaccagttggcgacggaagaagtagaataatgacgaaaacggagatgttctttaacggtggtaaaataggccagccatgaaggtgaagtcacaatgggcggcggtgaaagcaaaccggcgatgacgatgacgccagtcaatgacgatgaagacgcgcagccgtggaggcgaacaagccagtcggcgttagacaaggcgaccagcaatgaagatgaggacgtccatcagtagtggtagcggtataaatcaaccgtagaggcaagggcactagtcagtagcagacgagatgaccggcggtgaagacgataaggccaatcaacactggcagaatcatgtagccatggaagtaaagaaaccagtcggcagcagacgtagacagcttgcgttgaaggtgatgatgcctgtttgcggtggtggcgacgtggccaaccgtgaagacgatagcaccagttggcgtcatatgaggtggccagtcggagaagatgtagacgtcctacaatggcggcataataaaccaaccgtgcaggcgaagacaccagtcggcggcggcgaaggcgagccggcggtgaagacgtagacacccaacaacggcggcataataggccagccatgcaggcggagacaccagtcggcggcgacgaaggcaagccggtcggtgaagacgtagacgcccaacaaatggcggcataatagaccagccgtgcaggcggagacaccagtcagcggtggcgaaggcaagccggtcggtgaagacatagacgcccaacaaacggtggcataataggctagccgtgcaggtggagacaccagtcggcggcggcgaaggcaagccggtcggtgaagacgtagacgcccaacaaacggcggcataataggtcagccgtgcaggctgagacaccagtcggtggcgacgaaggcaagccggtcggtgaagacgtagacgcccaacaaacgacggcataataggccagtcgtgcaggtggagacaccagtcggcggcggcgaaggcaagccggtcggtgaagacgtagacgcccaacaaacggtggtgtgaccaaccaaccgtataggcgaaaacaccagtcgacggcggacgaggcagccagtcggtgaagaaaacggcgcccaacaacggcggtgtgaccacccaatcatataggcgaaaacaccagtcgacggcggacgaggcagccggtcagtgaagaaaacgacgcccaacaacggcggtgtgactacccaaccgtataggtgaggacaccagtcggcggcgacgacggcaagccggtggtgatgttctgactgatccattcctgtaacataggagataagcttaaagccatgaatccctttgatgcatatctggatctggatcctgcagaacaaatatataggatgagtagtatctgatgtaaatacagtacttgagaaagattcaagtattaaaagtgtttataaatatgtatttctcctctcgtcaattttgatttccccgagcagatgactcattacgtttaaacactctgcctgactagtcatagccaccaagcaccgggagtcggcctaggcacttcccaaacatgcatatgagtgacatgagttcgtcattaatggaacaaagtttcacgaatcaaaatttactactcgggtatttttgcaattgttaagagaagaaaataaataaatttatcttatctctatgcttttgatttattccgaatataatacttagcatcttgcgttactcggtccatccaacgagcccccgggtgctaggaatcggcccaaaggcaactatccatcgacaaaccaaacggaaagcataggaagatagaactccataactcgatagtcacttttgtactcagattatgtcgcaagcaatcaagataaatattatgaaaattgttgaaaaaatatgacatagcatctctagcccccgactcactagtcaatggcgaaccaattgatgtagtgagttagaggaaaagaaaaatatcatataaagaagaaaattaatgatgacttagctttgtaatattctccttggtgacggagagatgaccgatataggaacgaagtcatccgtcaatggcgatgaaataagccagtcatgaaggcaaagacatcaatcggcggcgacgaaggtgaccagtcggtgaagacgaagatgcccatcaacggtggtgtgatcaaccaaccgtataggcgagaacactagtcggcgacgacggaggcaagccagcggtaataacgaagacataggcccttccagactcaacgccatgttgtactgatccggtagtggtttataactcaagctcatgatgtcagaggagtgcttgaagggaaaaccggagcatgttttgatggagtccgagataatatctcctgatgatgtcagccaatatatcatatatcctcacgtaggagtatggtgctaggactcctgatctgattagttggcaaggtagccatatatgctcacatgcgtatgagctggatggaaatattaattggtgtcccttattgaggatagctcatgacaaccaattaacgatgtgtatgcctggcaattcttctgggatgtagatgcaaaaccaatagctctggaattgatcaaatgcatagcgttcgttgcttttcccagagctggggtactggtaagtgttggggctcgtgccgaccacattcccagtgctttccttgcatgccgagtgtatttttgttttgacctgatcatccagtagtcagccgagtccgagaatgatccaatcagctaaatccgagtctggacttctattgtacgcctggtataagatcaatacgatctacccatatagagatgtgtgctcagtgagctgatgtcttgatctcccgtgacaatgatcgaaagactcggaggtcagaaccagcaacagtacatgcaaggcatagattaatttaattagtagttatatcagagaccaatctaataacgattagtagattggaacgacgaacctggttattcttgtaaccacaaagtgtagctcctgaagcagagatctttgtggagatgcacaggagatatcggtgaccccgacgattgaagcctccaacttgatgacgtaaatctttgatcgccgttctctcgactggttaaaacccaagtcgaagagggagagattgttggagtcaccatcaaagaagacgaatccgtcaaaaccgaaagccagccttcggggtgaaggaaaatccggccactcctgatcttgattccatcacacttcttgacggaaaacttgacgcacccctacctggcgcgccaactgtcgaaacatgaattcagcaataataaaagggtagcgcacgagacctaaaagtggatggatgcggagacaaggatttagataggttcaggccccctcgatgagaggtaataccctactcctgtttggggatttgaatccaccatgtgtattatagatctgacgatctagttgtctcatgccccctagagggcctcctgcccaccttatataggatggggggcaggattacaagatagaaatcttaaccaatacggtatcggtttcctaaatctactttacaatcttatcaaaccaggactttaggccgttccataatatacagggaaacgtaatacccaagtcatgatccgttatatatttcatagatataagttatcccctataaccagtcggataaccatgtcgtgtgggtatggggtacccataatctccacagcgctagttctatcaccagaaaccggatgaaatcaattcccaatgcctcctaaacctaaaattgacacatggtatttcccttctttttttttgagacggtcgctagttagatgagggtttgtatgtgtgttacgcgtgcgtactaacacctcgaaggatgttgtctaatttgtcaagtgtgactgtgagagtgacttttagggattgggattttgtggatttggaataaacaaagcctatatatgtagtgaaggaatcatctggtttttttttgtttgtttttgggaggaggggttaaattaattatttcgtatacatgtgtcaatgaaacaaactttttatccagttttactaaaggaactccaaagtattgagaggaaatgtacaatgcattaattataaactgaaaggtaaaatattttttttttgaagaaaccgacggtaggagatctaccggaatattataagaagagagttgaccttgttaataagaaaaaccgggctcaaaaaccttacaactgcatagtttgctaaagggaaactgacgaaaccttacacagaagacagagaaaaaagcctgggacaaacgaccgaaccacaaaagtgaccgagggaagagcaagaccttcaaggcgaagcctccaaggaggggaacaacgacagaagccgctgccgacgcctgcccaaaaattggactgagttttcacccaaagggggagagagtccacaaagcagcacctccaagaaggatacgacacccacaagcgtcgatgttgccgattctggaagacaagacagggctttcacccgagactccctccaaaggaggatctacaatgggccagagcaaaagtgttgtgttatcgttgcccagctcatcggctaagcccgatgcagcagctccgactccgccaaacacaaaactctggcactgaagataagcacaccgctccaactcggcactacgataggttcacttagtcgcaggacactagaagcacttgcgaggcccaagagccctgactacagacagactgaaccaccttcatagacgaacacttctcctcaaccaccgaaagactccacggccgagactggaagcagacggccaaaaaaagggaggagcatcaaggaggagagaaggcatcgaaggcatcggtgtcatccatgtttccggcgaggaccccggccttcgcaggacaccccttacagctgcgacaaaccacctccaacttcaccactagcacagagagaggagcactggtgtaagaagcaaagcaactaaacaactaggcagcagagctgccagggaggaagcgagaagaagggagacaagggtggcggacacccccttctgcttgcaaagaggaagaagccaagagaggggagggtggttgtggctactgtcgacaccggaggggtaggtgtggcgatggggggcggctggcgagccagtgtagccgacgcccccagcgacgcgcctcgccgatcgggagccagcagatgtcgccatgccgcctcgcaagcgccgtcctccgcgccaccacgcgcgcaccggaccacccacgcgcgcgctggacttcgccgcctcgcgccgccacgcgcgcaccggccgccgccaaccttgccgcctccgcacacgccgccccacggcgccgccgccagtactccggccgaaaaccggagaggctggccagatccggcgacggcggcgccggatctgccactgcctagcccagaggcctcgccgccaccactccccgacgccggcgaacgtctcctccaccgcgccttagaagggacgccgccgcgaagaaggccccgccgccgccatcctagctcgccagccggcaaaggagagctccggcggcggcgaggtagggggaggggggagggggagcggcgacggaggcgcggcggcgacgcggggggagagttattccttttcagatataacagatctgaaagctaaaatatacatgttagctgttttgcggtctttgatcagtttgtgacaaaaactcgaacctataagcgatagctagctcttcgcataatatcaaagcgaaacatatgtatcgcaaattgctgggcatcactgctagctccagctgacaaggaagtgcaaactacaaaacactgcgaaccatcaattcctttttggatgaatcctgtatgcatcccatgcctaactgataccaggaaacataatctatgctttttaggatgaagcaggtaaaagtttataagaacttggttttagaaaactctacaccatcatcggacaattcgaagagcattttcagacatggattcgattcgtggtgctcgttcaaatagccaaggataaatattttgcctcaaaatcaatttacacgtagatccctttcttctgactagttctgtttgattgttttatttattcttatatgtgtatgcacagtatactattttggtaattttaacatatttcaaaagataccaggagataccatagtttctaatatatataaattaattttgatatcctcgaatgaagtaccaaaaaatttaatataaaatttagataccttgagatactttctcaaatactgtataatttctcataatattttacgtgtccacaatataagaccatatcgtccactctttaccataaaaaaacataatggattattagaggattccaaaggaagcaatgatacaaataggcacatcaggcacagtgggatgtcaattatacaaatttcacattgggctttatactaacacgtctaaactactaagctggtttttacttgggtaaccagattgcacacttccatccataagtagagggaggaggcttggtaagatcaggcggtgtttttctttaaataccaaaacaagaaacagaactgatcgagaggtggcatcaaatcaaaattgatgtttttgatgcgttgaacgtaacaggattagggacaggccatggagcagtttagtctttacctactagtgagagggttcacactgaaactaaggcacatgctgaatttattttgaaaatacatgagatcattgaaaagatgactaaaaagtatagaattaattgctggtagtaaaggtaagcaagaagtgaagtttgaaccgggtgatttagtttggttacacttgcgaaaggatcaattttcagattttagaatgtctaagttaatgcctagagctgatggtcctttcaaaattattgaggaggttaatgataatgcatataaacttgaattgcttcctgagtttggggttagtcccacttttaacatttagatttaaaaccatacttgagagaagaagatgtacttgagtcgaggacgactctaattcaagagagggaggatgataaggacatcactccttcggatacacacaacaatcctccaccggtcattcaaggaccaataacaagagctcgcgcgagacaattgaatttagaggtaagctcgttcctattcttctttgtatgattttgagaatatattgctacctaataattataggaatcatggagaggacaaagagacacttagggtgtgtttgcaacccctttttctcaacccatctccctcgtttttcgcgcgcacgcttttcaaactgttaaacggtgcgttttttacaaaaagtttctatacgaaagttgctttaaaaaaatcaaattaatccatttttaaaaaaaatagctaatatttaattaatcacgcgctaatggaccgctctgttttccgtgtctattgttccggatgggaacatgaaccagcgaacacacccttagagagggacttagaggcgcggaggatcatcaaggacgtccaagtcaagatggaggcccaaaccaagtcgacttcgagtacgattcggagtccaggaccctctgcactaaaacgggcacccagatcgcatacatgctcggattatggcgttctttatatggctggaaagctaagaagataatatttccaatggttctagtcccacgtccaaattctttccaagtcaacaggaatcgaccgaacaatttgacgtcaagaatctgtcccggtgctgcgtcaccgtatttgggcatttgggccgtgtatcgtattggaacccattagggttgcatcaagggttgtttgcacgaccgtaaactctatatatcagtaccagccgtcacctttagggtttaggtttttcttagattattctgttaagaacactttcgccactagatcggtttgtaagacaccaacttgtgagcttaatcattcatctacaattttagttgtattcttccttgttcttgtttgtgttcttcgattcgcaaacagggattagccttttcggcgaggtcttccgcgtttcgatacgggtgataaccagaggagacgtggtgctacgattgcggggctcaagagcgtgttcgttcagaagccggatcgggctgtgtcgcgactccgctcaaattgactgcctattagaacctttcggaagatcggtaaccctcgtccacatcacaatggaccactatgggctgcagttgctactcacaatgaggaacaaactataaaacttggcgttgtcatcggagaggcagatgaatccagtatggctcccatgcctaattgatggataggaagaggaatctgtggtgctttggtttgctggtatccacaatatactccgcaagctttgtatgttacaggggacatgagaaatcactttaagacgcgctctctaggaattgatgttacagaggaagcaatgatacaaacaggcaaatagaaacaacgggatatcaattataggatagacgatctgaagttctgaacgtactcttaaacttttaagtcagaactatcctctggattgaatgaaagttatgggctataaagagaagttcaattcagcagttgtaataaagacaaaatggtactttttttcttctttgattcagtttaagaactagctagtaagcaatatgtaatagtataataaaaaatacaaaaatttcgtttatacattttcaagccactttctgtactttaccagctcaacttactagttcgttgtaaaattgctctatcagtagacactggataaaatcaattcccaatgcctccaaaacctaaaattgagacaaaggtaatcggatgctggtttgtatgtgtgtgtatgagtatgaacgctcgcatactaacacctcgaagattgttgtcagaattgtcaagtgagaatgacttttaaggattgggatttggtggatttgggaataagcaaagcctataatgcaggcatcatctggggtctttttttgtttttgggagaggaggggttaaattaattatttcgtacatgtgtcaatgaaacacactttttttttccaatgatactaaaggaactccaaattaaagattgaaagtaaatgtacaattcattacttaactgaaatttaaaatatccatgttagctagctgttttgcggtcattcagtttgtgacaaaaactcaacctataagccaaacatatgtatcacaaattgctggcataactgctagctccagacgaacagcaaactacagtacagccaaccatcaagtcctttttggatgaatcctgtatgcatcccatgcctaactgataccaggaaaaagatgttggctaaccgatgactcagctcctctcacgcgagcacacacacgagaatgaaacgcaaacaagattaatttcttacaaaagaatctgtgctttttaggatgaagcatgtaaaagtttataagaacttggttttagaaaactctacaccatcatcggacaattcggagagcattttcaaacatggattcaattcgtggtgctcattcaaatagacaaggagaaatacttgcctcaaaatcgatttacacgtagatccctttcttcttattactccttccgtcctaaaataaatcaacttctagatttcaaatttgtcccaaaataaacaacttctaccttcttacctgccaccaatccgcaaaacgagaaattttattacttcaatacccctcacctatccattattcaatacaacattcacgttaattaagagtattgtggtcttttatttctctccttaaaagctccttgggaagctaaggtttgatttatgtagggatagagggagtacttctgcctgattgctttatttattcatatctgtgtatgcacagaataatatttgagtaattttaccattgttaagaaggtactgagagttaccatattttctaatgtaaattttggtattaattttaatgtaaaacttatgtacctcaagatattttctcaagtactgtataacttctcataatattttacatgtccacaatataagatcatatcgtccactttttaccataaaaacacaatggattattagagggttccaaaggaagcagtcatacaaataggcacatcaggcacagtgggatgtcaattatacaaatttcacattgggctttatactaacacatctaaactactaagccggccggtttttactt

SEQ ID NO: 13766 - DNA, 17383 bp, Oryza sativa
ctagttctagcaacaaacgcaggatgtaatcgattcatgatgcctcctaaacctagctaaaacctgacaaaagcgaaattaagttcattatggtttcagattgaaggggagagggaagttacagaagcagcaagaggcagggtggtggggaagggttttatattgagatgtggtagctggatgaagggtttttttttttaatgtgtgtgtatatatatatccatgcgtgcatggtaggctctcgattggtgttgtcaaatttgccgaaggagaatgaattttaggaattgagatttgaagtattcaagagacaagtgggaaaagaaccaagggaggtaaattgggggcctacatgtgtcatgtaaccggaaaaattcgaaaatatacatttttctaatcgtttttacagaatatatgtgtttatagagagaagtgccaaaaatataccatcgttgcagttaactgctctacgagttcgcttggctgctcagtgaacgggctgggcgcagcagcaagttcgcttgactgcccatcgaactggctggctaatggctaatgacaccgttaaataccatgattacttgttaattactttataatgatattagttaaaagaaacttggaaggaaacctgtgcggatgcacgggcacctcacttattatttatgaaaaaatgctaaaagaaatcatatctcagtacaaattatttaaataaatagaaaaaatatctatgttgtaaaatatacgtagacttaaatatagtaaatattactttgtcttgattatgaatggcaccaaggctttctttcatgctgcctctaaacatggatctcccattgatgtagatctactccttaaaaccagcatgaaccataatttcatattgtctaattcactatcggcatcctcatacataattgcatcgttaagtaggaagttgagttttatcgccaatcgatttaactatatgtatgttcttaccatacttataaaaatatagtaagctctgttatccatgctcgaggccctttagaaaagaacaaagagaaaacgaagatgatgacaatatttttttaatgttatgagttgttttgcagaatagcgtagacgtaatttatttatggtgttaatttatcaataatacttaagtttttattttttaaaatactatacaaacgcatgtgctcataatgccaacccacttacctccctatgtatgcgcaaccacatatcctattcttataatcacctccgaaagattagatcagcatatcttaaaattggtgaagtcagcaccaaagcaagtattcataatgcgcacacatataccttaccctatgagcaccttcaaaagattggaccgatatatcttaagattgatggacctagtcatttgtttacttaccgggtgaattgcagggaaaatatgaaagacatttgttgctgaaaaatcctgtgcgtgtgtgcaggtgcgtttcctttgtgtccattccggccgtgaactcttgagttcgtgcttcgattcagccgtgagtgttcattctcagttgacgcctattggtggccactaaaaactccaattcgagtacaaaaattttaataaaataaatggagataacatgttaccttatcgttgtttctttacactaatgggattctatgagttttgttggtctaacaggttttgcaagtttaggtcataaaatgtaaacatgtcgggatatttgggcttattcccaattgaattttgaaggagcaccaaaactacctataagatatgaaaccaaatcacatatttgagtataccacattgaagtcaacacgacgatagaacagatatatggtttgtctgatttggaatctggacgaaggagatacgataaccagaaaaacaagccatcttgccaagctgagggtggagagtatggggtcaattggaaggaagagaagtcacatggcaacccagattaggaagaaaaacttaactctaaattttcttctcaccttacctctatctctatcgtattttcaaaactaggaagttgattaggtgacgatacttaagaaactaccgattgaaagcaacagtgctatccatggccgccaacgtcgtcaacaaaaatctcatccatctaccaacggtaagttgacatgggaattaaggatatgcattgcggattattgagaaagcagttcacaattaattcataatgccatcaatatgcctgtaccggacagggccatcattgatgtcagtgtcgccgccagactgcggcgtgatctgttccccgaaagatctggtaggagtagccgacggtgatccggggggcgaggaatgagcaggtgtgctcggtagtgatggtgacgcctccagtgagcttgccagggaagaatttcccctttccaccaccaccggttccttgcatggacatctgccgggtgatggtgcttggtaccgcggtacgaagcctaccacagatgtcgtcgagccagctggttgctcgacggtctcctccacatcaaattcagcagagacctactcgcctgtagctctataccatggtcaaacaacattttcttcaaatatgacaccatgacttacatggatgcgacctcgacgaggatcaaatagtcgatgcaccttgctcccttcttccacgcccaagtacacatacggtgcacttcggtcgtccagcttctcgaggtgtggtactgtgttcttcgcgtgtgcagtacacccgaacacacgcaaatgcgcccgcaaatgcgccaagtgcggcttcttaaccatccacgcttcatacggagtgcgatttcccatcgccttggttggcggccagttgagaattgaaggtacactgtgtggcgcactgcctccccccaaagccagcctgacacgctcctccccttcaacagtgagcgcgccatcaccatcattgacctgttgcggcgctcgccaccccgttctgctgcggcgagtacggcactgtcaaatgccgctggataccagccgattcacactgttgtgcaaactcgccggacaggaactcgccaccgtgatccgatctcagcgtctttatgcgccgcccaaccacgttctcagccaggggtttgaacttggtgaaggtttccaaagcttggcccttggatttaatcacaaacacccacatccaccatgtaaagtcatcaacaatcaaaacaaagtatcggttaccagtcattctcgccggtgagatccacccgcataggtggagcaacgactcgcattctcgccggtgagatccacccgcataggtggagcaacgactcgcggcttaacgctccaaaagaaaacttctggatttttcttgaaattttccggcaagttgaaaccagtcatgtactaccctgtttccataagaaaagtgaaaacaaccaaggttagcctgcaaatgacagtgattatatagaggtaaatataaagtattagtcatggtaatctctgttataaatcctccccggcaacggcgccagaaatgttgttggtatttcttaacgacgttactagaaatataattcccagcaatagcgcagaaatacttctggtatattatggttacagagttcatccgcaagcgcacggatataccattgtagcatttcacccgagagtattccaagggtatcgtatttgtttaatcccgtgggaagattataatagagataccatactaataatttatatattaattgtaataatcaaagtctaagcatgagttaatataatccaaagggtagagtgacactaagcacaagcattcatactcttactcataattatctaagctaagtggaaagaacatagaaagatcatattcctatacttctagtatacatacatattatacatacatcctagccatattattacttagctaataacctctttctgataacctactggtgcttcgagaagccaaccctgattgccaagttccttacgacaatccgtcatgaccatccaatcagggctaaatacggaggactaccctccccaggaaattaacttaggactatatacacgcgcggaggaatacatgtactgagctgtcaccatcagcggcccacctcgcttctacaacatataaccccaaataatgatatccagtaatctaaacaccatgcttaaattaccaaatactattctaatatcatcgtcatgacatagagtcatcgtaaatatgatcattatactcacaccattgtatctcccagataagctagcatcataatgaatataacttgaacatatagtaaagtagatattcatatactcgaaaagtaatacaataccaaagtagtataaagaagaatattctaaataaaatataagtcttacaaaagaagaaaaagctactagagtccccgcaaaaaaaaaagctactagaggcatacccaaattcttccgaagactccgaggactgaagattctattatatttctattccgctatactccagggactatactaaatttgagagatgaaatgatcttcttgtttgaggtgtgtcttgaaatggagagagagtgagccttttacagacaggtagtgatggttatggcggttggaaaggttggtaatacccttcaatcgctatagggaagccatccacaccatccatcaccaaccctggatcgagcggcgctgaggagggttcgaccgaaccatgggtcggcccaaccagcccaggttttggctggtggcctcctcttttgctcccatgtgcagacttgtgaattttggcccaattggtcatgtcatttctgcatttttggcccattcgttgataagtctgattcttgacatcgtccgattgaacgatcgcttgttttgatgttgattctcgtccattttttggtcattctatgcaagaggttagtaatcctagtgctagaggactatttattattaaacataaatatgcattgcaagtataactagttctcatttattttagtaatattgacggtcaaaactgatcgctaacgaccgtcaataaaaccggatctgctgccgccggaactatggacatggtgtcagatcagccctcagcccgagtgctctgataccacttgttggcgacaaacctcggatcaaacactttgtgtgcacactgcagcaatccgacacggcaacagacgagaacatagaatgcagaaagggatcttcagaggaagaacagtgaagtttcagagaacaatcgatgtactggaaattgtggggttgattttctgtggtttttattcaactgaatagagtaacatacaactcaaataacatgactagaatccaaggctcaaatcgcgccatcccacgataccacttttcgaattcaatgactcacacatccgcgctaaactcacgcacgcgaaccctactgacacagtctgcttaaggacttgatcgccgcatcatctgcatctgctaacaaactccagcagacttattccttcaacctttgcaactgctaacttctggaacacgtaggagccacagctgaactaacaaactcaacaacgtgtgactatattcatcgcagcttgttagcaacggccaccggcaccgacgccggcgacctagccgatgtagtacatggggtcaggcagcttgaaggtgcgagcgccctccggtgcacccaagatgtcactccactggtctccgatgttaccgacgatgatgaagccggcgtcctgcagcttctgacgctcgccggacttgtacgccacagccgataactggagcccgccggcgacatgagctgccggcttcaacagcagcttctcccatccagtgtagccctgccggcggaggttcgcgacggtgatggccctctggtcctcggtgcggcctgtcaggaacactggcttgacaccgagctccagcagccgccggtacaggcgcctcgtctccggcagcgccggcgcgctcccctctgccacatactcacgaaagctcgtgtcgttgtacggcgtagctctgccaagggattagtaaagataattataattaattaatttcttcatatgcataaacgtatgcatcgttgcatgcaaggcaaagttaattattcgaataaaacagaagctttcaatggaactgtcgaactcatggtacaggaccgaattcacgaataaataaagttgcaagtttgctggaaactgtacaaacttaatcattagtaaaaagaatttatagcatatgagcgtgcagtgcgtccatagctccatacttgtctaggattaaattttcgatatgatatatatagcatgcagacaaaaatgtatctgtcaagttatcttgtcttcactgttcatatgcatacatgcatcatgcatggtcccagggctatacataagatcccgatgctaaatataaaattaggttgtacattgaagaatttccaagatcaaactttttaattctgtttacttatggaattgcaacatatatattttgtaataatactaagaattgcaaaggatattcctgatacaagtgtaaaagatatgctctcttcacgaaattaaataaaggatgttatacgggaaagcgtaacatgtccttgttcaaacaaaagaaagagcaaaaaaaccttgttcgatctgcttgagccttgatgcaatgttgttggaaagttgtaatatctaaagatttcttctatttactgacaacataggccggccgatttcaactttttccatgtagttcatgaattttgattcacgttcaatagtagttcatcctagtttaacactgtcatcagcaagatatatatccttgttgttcatataatattccatatactttgtcagcaagttgaggggtaaatatattacaagattattaaagtcccaacttcaattaatgaagagtatatatacctactgaaattaaatacgttcaaaatactaattccgttttttatttgacaatgttgaattattatataacttttcaaatagaatgaagtgcacgggcggttcttaaacttgtacagatgtgtcatctagatgactagatttctaacatctcaaaaatgcatttttgggtccccaaactcgtcatgtgtcatatagatctaaatggactccaacccgctccgtgagatgacgtggtataccacggtgatactttcgtgtcagtgggatccacatgcatgctagtcatgtagaaaaaaataaaatttaaaaggagatgagaaaataatgttttcaattttgaaaaaataaatgaaaaaagaaaggggaaaaatatttcctttttttttaatatgtggcggacatatatatgagttctattgacacgtaggtgccaacatggctgccacgtcagcacacggggcgggttggaacccgtttggatctatatgacacacgagacaagttaaagggctaaaaagttcattttgagagtttagtgacctagtttagtgatctagttgatacacccatacaagtttagagaccgcccgtgcactttactttttaaatagtaagaccaataatcaaactgtgtctatgtatatacatatatacgggatgccgggccccacgcggcagccgcacggtgcgcccgaaggcggccacgccggcgcagcggcgggaggcggccccccccccccctttgggcccccggcggcggccttaggcccggcggaccggcggccgaaaaaggggaagggaagggggaaaagaagcggcggtccacggctcaccccgggtcgacggcgacgacggaaacggcgaccggagcggaggaaggcggcggcgcggctcgggtggacggggtcgacggtgctccggcggtcggcgagcgaaacggaggggtggacgaggtcgtcggggatgcggtgaagccgaaggtggcgacgccgaggcgggaggtggtccggggcgacgacagcggcggaccggagctcggcggtgacggcggagagagagagcgacggcgcgagctcgattccgacggggagagagggcggcgagtggcggaaacggtggagggtggcacggggaaggtttatataggattgggagggggagggagctgccggacgagggggaaacgggcgcggaagatccggtcgccattgatggcgccggcgaggttaggggagaggtttccaaacgaatgcgagggagagagggagggaaaaatggggggaaagagggagggaatcacggggaatatttccccccactttattgcgcgcgtggacggcgggaggcggcgggattcgcggtggcggcggcgctagggcacgggcgaggcggcgggagcggcgggaggaaggggatgacgggtgggccccacccgtcagtgagggtggcgggcgggcccgcccgtcagcggcacgcgcgcggggaggaggccgaatttgccgcgggggagaggagagagagggagagagatgggcgagccggcccaagagggggagggggggaaaaggactttttagggtttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttcggggatgtattttagagtcgttttgggacgcgacaagggcgctctccccggtcgcgggaccatggagagggaaccaggaggtactgaacctgaacctgtcctaggtcacatggttgcggtggaggattatattctctgtggttttctccccccgccttctgagtttctacagtctttctttcctccatttgaaccccaattccatcaccttcctcaatatcttttcgcatctttgtgaggcctacattggggtagagccatttctcgacctttttcgcttctactacaagctgcgttggatggaatccaccagggtatctggatgcgtcggtttccgactccgggatggcctaaagtcgcgctatatccccttccaatgcccttcttctcgcagcaagtggcaggcgaggtggttctatcttcaggtagaggattcagatccaatctttgttgttcctgaggaacaaccagacaagattccgtcttggactgccaaacccgccttgaccccttctcttcagttcttcatcaatcccatcgatgacctccgagtacgaggtttgtcgaggtatgaagtcgctgccgacttcattggtaggcggatccagccgctccaggctcgagcccacccagcctttgactattctgggccggaggacgcgacccgagtttctcctcgggtatttttctttgtgtttaatttgacttccttatgtgcatgttcctcctgacttaccgaattctggttctgtctacaggtttgaacagcgagaccatggagcgttgcgtcggacaattgatgatcagtggcccgacaacggtgagtaacgtccccatccccctttgcgagaaggggaaggctgagcatgaagccgcaattaacgtgagtgtatttgacgaccccctttatttttgctcctagatcgcataatgacttcacgcggtgcaggctctccctctgaccgacgtcattggaccgctcttggaccaccaggcggcggcctcgttgaaggagggcgtcgcccaagaggcgtccgacgcggccattgctgctgctgccacgactagtggcagccgtgtcccgaggaaggggaggaaattcacctccgtgctcggcagccgccggaaagcgtcctcccatcggtaagtctcttgagttgttaactacgtagtcggaagatgtccccctcacgtcgtactcggtttacttaggccttggatgcgtctccgccacctccacgacggcagaatctggtgacacttggcgagaagtaagtggacaaaatttgaggtccttcccttggttgaattctggcgacttgtcttgagggccagacatgttaatcttctgtaggtcggcgcgggcgaaggcggtgcaagacgggtccggagggaactccagcacgtctcctgcgatggcctcgaccgatgtcgtggtcgtgcccaggagccgtgaggtgacgcccaacggcccagccagtgatctcgtgcctgctcgaggcctgcctgctgacgtcctcacctggggggagctccaagtcgagatggggcacatccttgaggttggtgctcatggcataagtcgcgagattgcggaggcgaggacggcagcagcgtcgtcggcaaatgagcgtgccgataagctggcgcgtgacctggcggaggttcgtgaggacctccagaaaatgagggaactagtggccggcaacgagtgacaacggtggggactcgagaacccgatgtcggaactcgagaatgtcacgtccggaaataacccaacgggcgttccttacgtgtgtgtattattccttgtcccaggaggcaaggtacacccaaaagttgatacaattcagagtttaacaagcggaagcgtatatagataatttattacatgggcggcgaaggcccagcacacaagaagacaaacgaaaaacagcagaagactagggcgacgaccacaggcgcttgacggcaggcaccagctagacaccaaagccttcatcttccgggaactcctcttctgggtttgggaaaaattgagcaagactgagtacaaccaccgtactcaacaagacacacccacaagtgcagaataaatgcaagggagtacaagggagttataacataggggttaagttttgcagtaaacagcatttaaaagtcacttagttgccaaaacctattttatgaagacgatcctagagctatacaagattattaatcaaggccgtgaacccacacaaacctgccttaacccaaggcctacgatgattcaaaccgaactggcaacccgaccctgggtcccagctcgtcccaagccaacccaggccaaccattccacattttagttgttaagcaggttttaagaattaaaacactaacttgggtacattgctaggcttgcccataaccgagggcgcggctatttgaataggttttactctgatcagaggtgtacatctttacccacaagacatgtcttcctcacgtgtaaccacatgccacataccaccacggcatacagacggaagacatgacatagtttccaacccatcctagccatagacaagagtaccgacccaaccccacctacggcaggaacctccgggacaggtaggcaggactgagcccctagcagcaggacaccagccccgtgccatgacatctcgactaccgggccgcagctcgtgtagccttcatttgccctagagatgtccatcgacccccgacttcgtccatctgcatccgtgtacttttgtttataaccagactgagccacaaactaagccttacccactagacatgtggaagtacggtagtgctttgcaacagaggcccgaagaccggtccttatgtggccgaggtgctactatcaaaaccatgcaccccgagcccagcctaaaaccattttgagggttttgaatagagggggaggtgtgaatccaattccacaataatccaaccattccaatgtccatgtgatatgaatattcccaatccttggcgcgaagcgtcacagtacaacatgaagtccttgcgagtatccggtaagattaaaaccggcgaggaaaccagcctttccttgagagtttggaatgccttctcgcattgcgggctccacacaaatttctcttctttcttcaacaactgtgtcatgggtcgagcgattttggagaagttctcgatgaacctccggtagtatcctgccaaacccaaaaaactgcgaatttgagtgactgtcttaggttgcttccaatcagtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtacaccagaatgtcgtcaatgaaaaccacaacaaacatatccaagtattccatgaacactttgttcattaagttcatgaagaaggcaggagcattggttaaaccgaacgacatcaccgtgaattcatatagtccgtatcgcgaggtgaatgcggtcttcgggatatcttcttcacggatgcgcaactggtgatatccggaacgaagatcaatcttggagaataccgtggcacctttaagctgatcgaacagatcatcgatccggggaagagggtacttgtttttgatagtaacttcattgagagctctgtaatcaacgcacatcctcttcgtcttgtctttcttctccacaaaaatcacaggagcaccccagggggaagtactcggccgtatataccccttttctttcaactcttccaactgtttcttgacttcggccagttcatttgctgccatacggtagggtcgcttgtacagaggagtggttcctagagcaagatctatccggaactcaatctctcgcttgggcggcataccgggtagttcttccggaaacacgtctccgaactctctgatgatggggatttccgacagtcttatctgatgaagttctgaactaccgacagaggttgggggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgaggaaaaaggaattccctgaatttctataggaacggcagggctataatactttgctgtcataacccctccaggggtggtgatgagcagagggttcctaagcctttctacccccaactgatttctccccacgaatggcacaaatataaacaagtgggaagctccagagtcgaacaaaatggtagcagggatggaatgaatgaggaacgtaccaacgatgacgtctggagttgtcagcacgtcctcggccatcacgtggttcacacgaccccgtatgacatccttaccaccgtggttggagcggggaggcgcttggccttgctggcacctcggctttgggcatttatccgcaaagtgcccaggctcgaagcagttgaagcacagacactgctgaccttgaacgtccctgcggccttgaccaggctgcacggctggcgtaggaggacggggcgcacgagtcccttgctgactctgctgttgctgcggctgtgggacgcgcaccacgaattgaggtcggggcgcggagcgaggttgctgctgctgttgctgctgcgaggaggatctccctggatagggattggtgtagcggtgtagcggaccttttggttagccccctgttggttgcggaaattcgccaagcgacgcttgtgcgactccagttccttgtgcttggcttccaagcggatgctcttgtccaccagacgttggaaatccagatagtccccggagaccagacgcacggacagctcagggtccattcctgccaagaacttctcttgcttctcctcatcttcacgaacatcctccagggcgtaccgggccaggttgttaaactcatgcaaatactccatcacggagcggttgccttgcttcaactctcggaattcccttttcttaagggccatgactccggcgggcacatgggttctccggaaagcggcggtgaagcgggcccaagtaataggctgcccctctggctgcatagcctggaaatggtcccaccatagagatgcgggcccctgcagttggtgggcggcgaagatgacttactcctcatcgctacactgcacggtgtctaactttttccccacggcatgcaaccaatccaacgcgtccacggggttattggagctagagaaggtaggtggacggatgcggaggaactcggcgagtttagagtgttgtgggggtggtggtggagcattatgttgtggcggattttggatgtggtggaggaaagcagccatcatgttggcctgctaggcgaggatttgggtgaggatggagttggtgtctggtggtggtggtggaggcgggggaggaggtggaggtgggctgccatggttgttgtggttgctgccttcggggtgactgccttcaccggtagcagcacttctcctggttgtcaccatctgaaaaccccacacagaaccagcaaacagagagagctgacaattaaaactaaccacccacgactaccataattcttgaatttattactgctattaaattggttcattaaagttcaagttgcttaagcaaataaaataaagacaagctccgacacagttataccacacaccggcataaccatgccccatacgactctagcagaaaaacaaacgagaagaacacacacgcaagcctactaactgctcgtctactactgcgacgggccagggcggaaggtgagcagcagcacatcctccgtgctgccaacgccggaggctccatcctcctgaggaaccacgggcgcgggctcagcacgaggggtctcgacgaagcaggtccacgccagggactgacgaacaagctcgggcctggaggtactcttgcgggcggtgatcttcaggctgcggcagacgcggcgacgcttggggcgacagacctctccctgggcgatcttgagctgacgcagctgcgcgtccactgcgtctaggtccttcttcagctgcagattctcctgacgcagctccaggatcttcatgttgttctcgaccaacccacgacgcaccatctgatggaagtcgatatgggccgcgtcgtacgcctccaccatgcgcgccaggtgcatgatggtagcgtcatcctccgagctagcatcccggaaggtggcgtagtcgcgggctcctccgcggcaagggtggtagcggtagggcgagtgctgcaactcgttcgggtagcactggtggagagtgccgatggcgaggagtgcggcgttctggcaagcggcagagaaggaatctccacccacggtgactaccaacgaagtcctctcgggtgagccagtgaggatcactgcagtaatctcccaagcagcgtggggctctgcatcgtcaccctcctgctccgggagccgcttgccctggtagtccactccatgcggataccccaggacaacgcacatgccccgcagctccaaaacgaagccagtcaggtccagaccacgacggttgatgctgccggccatctacaaacaaaagagaaaagcaacattttaaagatcagattttgacgataaatgaagcagcaggacagagagagactaaaggattttcacaaataagaaaggatttttattttgaaaatattgctaaggcttgggatctacggctcgtcctagggtcaagggggctctgataccaacttgtcacgaccggaaataacccaacgggcgttccttacgtgcgtgcattattccttgtcccaggaggcaaggtacaccaaaagttgatacagttcagagtttaacaagcggaagcgtaaatagttaatttattacatggccggcgaaggcccagcacacacaaagacaaacgggaaacagcggaagactagggcgacgaccacaggcgcttgacggcaggcgcgagctagacaccaaagccttcatcatccaggggctcctcttctgggtttggcaaaaattgagcaagactgagtacaaccaccgtactcaacaagacacacccacaagtgcaggataaatgcaagggagtacaagggggttataatatagagggttagggtttgcagcaaacagcattaaaagacacttagttgctcaaagctattttgtaaatacgatcctagagctatacaagattattaaacaaggccgtgaacccacacgaacctgccttaacccaaggcctacgataattcagaccgaactagcaacccgaccctgggtcccagctcgtcccaagccaacccaggccaaccattccacattttagttgttaagcaggttttaagaattacaacactaacttgggtacattgctcggcttgcccataaccgagggcgcggctattcgaatagattatactctgatcagaggtgtacatctttacccacaagacacctcttcctcacgtgtaaccacgtgccatataccaccatggtatacggacggaagacatgacatagtttccaacccatcctagccatagacaagagtactgacccaaccccacctacggccgaaacctccgggacaggtaggcaggactaagcccctagcagcaggacaccggccctgtgccatgacatctcgactaccaggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgcatccgattccacaataatccaacaattccatagtgtccaggtgataagagtattcccaaagtctagagttgtaaaccacctaatgttacctaattaaccagcgaagcatctaactaaaatcatactagtggtaccttgagtagagtgtccactagttggggttttgtttattctagggtgaacaaggaaataataacaataacaataataaggtcataacaaaggtacataggcatggctagataaaacagtgataacgcgggaatttaaataaagcgataatgcaaaaatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagctggaacaaagcacaaaaatgggttcttgacttcttaaggaaaaattagagacttgaacggtccaattccgagttcaaatggccaagttatggtcatttgaagtttatatgctctttaaatgaatatttgcgaatttcttcatttaaattttaatttta

SEQ ID NO: 13767 - DNA, 2592 bp, Oryza sativa
cggacggaggaggtgcggggagggtttaaatagagcccggtcgagagagggtggccggggaagggaggaaaacggcgcgggaggtccggccgccatcaatggcgccggcgagatttgcgggggcaaatccgcaggtcttgaacgcgagagagagagggaaaaatggggggaaagggagaggggatcacggggagtgatttccccctctttattgcacgcggagacggcgggaggcggcgggattcacggcggcgacggcgctagggcgcgggcgaggcagcgggagcggcgggaggaaggggatgacgggtgggccccacccgtcagcgatggtggcgggcgggcccgcccgtaagcggcgcgcgcgcggggagaggccggatgggccgcagggagaggagagggagggggagggagatgagccgagccggcccaagagggagagggagggaaaggggactttttagagtttttctctttataaaatcattttaactttgtttatttcttaataattattatttgtgctctgaaaattccactaaaatttatttacgcattttaggcttttaggaaatatacaaaaatcccccaagccttatttgacttttaactttgcaccttttaattgttggaggctttcacacggattttaattattctaagcataatttagaggatgtattttagagtcgttttgggacgtgacaatctcgaccccgagattcggaagaactggcgaagagatcgggatgggctgtcttcaactcgtcctcacgttcccaagtagcttcttcctcggcgtggttgctccattgaaccttgcaaaaacggattacccagttcctggtcctgcgctccatgctgtccagaatcttcaccggcttctctacataggtcaagtcttcgcgaacttcaatttgctctgaatcggcctgctcggacggcactcgaagacatttcttgagttgcgacacatggaacacatcatgcacattgcccatggatgcgggcagcttcaactggtaagctacttctccacgtcgagcaatgatgcggaaaggacccacgaaccaaggtgcgagcttcccttttgtctgaaacctgtgtactcctcgcaatggcgtgacccgaaggtacacaaaatcgtccactacgaattccaggttacggcgtcagttatctgcataactcttctgccgggactgtgccacctttagattatcccgaatggttctgactttagcttcagcttctctcaggatatcggtccagaacacttggctttccccgacttggtcccacaacagtggtgtccggcatttgcggccatacaacgcttcatagggtgccatttgtatgctggcttggtagctgttattgtaggagaactcggcataggggagactcttatcccaggtcttcccaaaatctaggacacatgcgcgaagcatatcttcgaggatctggttcagacgctcggtctgtccaccggtttgcgggtgatacgcggtgctgaaatttaatcgggtatccaactcttcttggagtttcttccagaaatgagaggtgaattgacttcccctatcagatacaattttcttgggaacgccatgaagacttacgatcctagcgaagtagagttcagctagtttgttccctccataggtggtcttcacaggaataaaccgagctaccttggttagtcgatccacgactacccatatagaatcatatcctccctgggtttttggaagtccggtgataaaatccatcccaatttcatcccatttccattctggtacttgtagaggttggagaagtccggccggtcgttggtgctctgccttgacacgctggcacacatcacaaagggccacgaactctgcaatttcccgcttcatactaacccaccagtatttctctttcaagtccaagtacatcttcgtgctgccaggatggatggaatagggactttcgtgagcttcctgaagtatcagctgtttaagttccttgtcgtccggaacacatacacgatttccattccatagggtttcatgttcatcttctgtgaaaccagcggctttaccctgtttcatattcttgaggatcccatgcatatctggatcattcttcttagcctcgcggatttgatcgagcaaggtaggcttggcttcaagtgtagccaagaatccatggctaacgatgctttggttcagggcttccaactgttgattaagctccggtggaatgccacggacgccaagagtgttgcaacggctttttcgactcagcgcgtctgcgaccacattggccttaccagggtgatagtggattcccacatcataatccttgatgagctctaaccatcttctccgccgaagattcatcgagaacttctccaaaatcgcctaaaacgacccaaaacgaccctaaaatatatcctttaaattatgcctagaataattaaaatccgtgtgaaagcctccaaaaatgtgcaaataaattttagtggaattttcagagcacaaataataattgttaagaaataaacaaagttaaaaaggttttataaaaagaaaaaaccctaaa

SEQ ID NO: 13768 - DNA, 34851 bp, Oryza sativa
ccgcaccggttaccttcctccccggccgccctctcccccttccaaccctatataaaccctccccgcgcctccctcgcccttttccgccccttgccgcaccgtctccccgccggaatcgagctcgcgccgtcgccctctctctcctccgtcaccgacgaccttcggccggctctctccgctcgccgggaccgtctcccgccccggcgtcgccgcctccggctttgccgcaccaccgtcgaccccgtccaccccctcgccgagctcgccgaccgccagaacgccgccgaccccgtcgacccgagccacgtcgccgccttcctctgctccggtcgccttttacgtcgtcgctgtcgacctagggtgagccgtgaaccgctgcctcttttcccccttcccttcccctctctcggccgccgctccgccgtgcctatggccgccgccggcgaccataggggcgcgggcgcgccgcctcccaccggccgcgccgacgtggctgccttcgggcgcgccgagtggctgccgcgtggggcccggccgtcagctgcccgcgccctcgggtgcggctgacgcgtggggcccacggtgccggccggagtgagcccgggtgcaccctgtccaccgtggaccgtgaggctgctgggtgggccccactcccgtggacccggtccgcgcgccctcccccgtcggctgacgcaataaatcctttttttaaaattaaaatttaaataaagaaattcgcaaatattcacttaaagagcatataaacttcaaatggccataacttggccatttgaactcggaattggaccgttcaagtctctaatttttcctcaagaagtcaagaacccatttttgtgctttgttcctgcttgttatatggagtttattagagtaaaagcctttttcctttccgttagtcgtgtagacgctgcagcttcggaagatccgctcttcgtggaggttgaagccgacgtttgggaaagcgagcaaggcaagtcacatcatccttgaacatattgaatcccagtttataaaattattttgatttaaattaatgcattatcgctttatttaaattcccgcgttatcactgttttatttagccatacctatttatcattgttatgaccttattattattgctattgttattattaccttgttcaccctagaataaacaaaaccccaactagtgggtaccctatgcatggtaccactagtatgaatttaggtagatgcttcgctggttaattaggcaacattaggtggttttacaactctagactttgggaatattcatatcacatggacattggaatggttggattattgtggaattggattcacacctccccctctattcaaaaccctcaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctagttataaacaaaagtacacggatgcagatggacgaagttaggggtcgatggacatctctagggcaaatgaaggctacacgagctgcggcccggtagtcgagatatcatggcacggggctggtgtcctgctgctaggggctcagtcctgcctacctgtcccggaggttccggccgtaggtggggttgggtcggtactcttgtctatggctaggatgggttggaaactatgtcatgtcttccgtctgtatgccgtggtggtatgtggcatgtggttacacgtgaggaagacatgtcttgtgggtaaagatgtacacctctgatcagagtaaaacctattcaaatagccgcgccctcggttatgggcaagcctagcaatgtacccaagttagtgttttaattcttaaaacctgcttaacaactaaaatgtggaatggttggcctgggttggcttgggacgagctaggacccagggtcgggttgccagttcggtctgaatcatcgtaggccttgggttaaggcaggttcgtgtgggttcacggccttgattaataatcttgtatagctctaggatcatcttcataaaatagcttttggcaactaagtgacttttaaatgctgtttactgcaaaacttaacccctatgttataactcccttgtactcccttgcatttattctacacttgtgggtgtgtcttgttgagtacggtggttgtactcagtcttgctcaatttttcgcaaacccagaagaggagttcctagaagatgaaggctttggtgtctaactcgtgcctgccgtcaagcgcctgtggtcgtcgccctagtcttccgctgtttttcgtttgtcttcttgtgtgctgggccttcgctgcccatgtaataaattatctatatacgcttccgcttgttaaactctgaattgtatcaacttttggtgtaccttgcctcctgggacaaggaataatacacgcacgtaaggaacgcccgttgggttatttccagtcgtgacagagaacaacctgtcggagatccgtggctcgttacgggtcacctacaccagcctacaccagctcgctgggaaatgtggtgttacgaccaccatcccggtgaaccccgacaagttctcgctgatgacttcactcgcagaactggccacggcgatggaggcgataccctccaagcatgcggccatgatcggggaggagacgtccaacgggatttacaccggggcatgtcacgtcctcgcgtgtgtgaggttagcgcaccctgaacttgatcttcagtggatcttggatcagggagcgactaacgacgcacgtaagggcgtgatggaggaagtcggtgatctgggagagtctgttctcccactttttgaagagtaagactttagttcccttgtactctttaatcagtcatgctttgtaaaacttttgttggcttcaactgcctttgcgtgcgcaatcatcaccttcattttctttagcattttaatcccaagtactttgttgtcgtttgtagagatgtcgatgtcgaggatgtccagcagcgcgggcagcttgagttgccggtgatcgttccgacgcttgcgtttgaaccacgtgtgtcgcaggacgatgtagatcaaaatttgcccgcggacacgggtatggtgacgacttccttaggttggtcatctctgtttccatctcctttacccttccgtttggattgacttgatttgctgtgttctcggaagagaagagcggcttgatttagtcgttttcacgctgagcagatctcgagagtgcacctgctgaccaagatcatcgcatccaatattggaagacgaaatttgaggtagcggaactcgagaggactgtgctggaagtaaagaaggagctggctgtggaaacactccgaggtcgtgaggtgaggttcaactcgtatctgaagagttgctgcacgtccatgacaagagtctgtagggagctccgagtaccccgtggggatcccgaggagtcggcggccggatacatctcgtggttgaatggggcctgcacccagctcgaaggcatcgacaagcgtattgacgaggctctgaagcaggagtgccgtcgatcgagccgatatgccggagggcatgtattggcttgcatacgagatcatcgcccgcaactgcacctcgagttcctccacgaagggttttctcgttctcagagaactccggtggagatagatcacctggcgaagtcgatggcgccgctggcagagaaggtcttctagtctatggactggcgttggccttcctggtagtctctgtaccctgtgacaaatatcttagggaaaagtgtaatatagttttggatgtttacgggattgtaagcagtacttgtgaaatagaaaagggatctatctaactaagcttccttactctagatgtagtgtgtaagagtgtcttctcacttcacgacgtcgatcagtcttttaagtcatacactctccctagcccccagccttgtcatcggagaatacttctcggaagataaggctcttggacctttgacctgccttggttttacaagcactgatcctagcccccagccgtgaagttggaaagttaatttccgattacacggcttggttaatacgcacggcaagaactcttacacgaccagatcttacatggtctttcgtctctacaggatccgacaaggccttatcggctctaggcgtccccagccgaagatcccttaggtttttcggaggccttgtcaagacggcgtaaagggacaagaggataggtttcaatgctaaatgtcatctgggtaagggatcatcgggaaggaacactttggttgtaatccgtacctgaaaataggctttattgaagctatgagatgtcttacaagtatggatacgattgacttatacatagaatttacgtaattgatcaatgttccaggaatttgccaactcgcgaccatcgctgtctgcaattttgaatgcgcctggccgcaagacttgtgtgatcgtgtatggtccttcctatttgggtgagagcttgtttcgccctgcttggctttgaacccgtcagaggacgtaatcaccgatcgaaagcgtgcgtgctcggatgcgcttctcatggtaacggcgaagggcctgttggtagctggctactcggacggcaactcattcgcgatgttcctcgagtagattcacatcgtcgttccgctgctcctcctgaccctcatcggaatactaattctgtactcgtgtactttgatgtcgtagctcggtggggagcatggcctctgagccgtacacgaggaagaagggtatttccttgttagacgttgtcggtgtggtacgcactgcccatagtactaatggaagttcttcgacccacttcttgtcatgtgacaagagcctatcatagacgcgggtcttgattccttgtagtactatgccgtttgccctctcgacctgtccgttgctctgagagtgagaaaccgaggcgaagcagatcttgactcccagcccgatacagtaatcctggaagtcggtgctaatgaactgggagccgttgtcggttatgatgcgatgcggcagtccatatctgcagaatatccctttgatgaatttgatggcgttgtcggccttgatttcccccgtgggtgtcgcttcgatccacttagtgaatttatcgatcgccacgaataggaacctgtagccgccctgtcctcatgggaatggtccgagtatgtcgagcccccaacacgagaacggccaagtaagagggatagtctggagcacttgcgctggtagctttgtgtgtttactgtgaaattgacaggcttcacatcgctgaaccatgtcgcaagcgcctttgagggtggttgaccataaaaacccttgtcgaaaggcttttccgaccaatgtgcgaccggctgcgtgtgacccacagatcccttcatgtatgtcgaggaggagatgtctaccgtcattggatgagatgcatttgagaagtaccccatttggcactttcttgtatagatcgttgccgatcatacagtagaattttgctttacgggttattttctcggcttctgcgtcgtcctcgggcaactcttcgctacctatgaatttaatcagtggggtgcgccagtcgtctatggtctcgatatcaacaatggcgcgctctgcctctgtagcccccgagctgatgtcgggggcgactgggctatcttcgctgcttgcctctttgactgatggcattgtctggacgtccagaaaagttccgggttcaagtagttctcgtctggacgcacgccgtgctatatcatctggctcgatgttgtccttgtggtatacgtgtcggacctcgatcccatcgaaccttttttccaccttcctgacctctgcaagatacttggataactcgggattagagcaattgtaatctttgtgcacctggttcgcgactagttcggaatcccctttcacgaccagtcgcttaactccgagtgcagctgcggctcttatctcggcgagtagtccttcgtactcggctgtgttattggttgccctgaagttgaggtgaattgcatgcttgaattgatctcccgaaggagatgtcaagacgaatcctgcccttgctccttggctgttgagtgcgctgtcgaacgccattgtccacgtttcgttgtcgatttggttgtctaacctgttatcaggtatagtccaatcggctacgaagtcggcgagtacctgggacttgatgattgttcgtggcacaaagtggacatcaaactggcttagctcgactacccattttgcaatgcggccgaccacgtctttgtttctcacgacttcaccgagagggaaggaggagacaactgtgaccctgtgggcttggatgtagtggcgtaactttcgtgatgtcatgattaccacgtagagcagtttttggatctgtggatatattgtctttgcgtcgtggagagcttcgttgacgtagtagactggctgttgcaccttctctctctcgacaacgatgacagtgctaacggaatatggtgtggcggcgatataaagaaataattcttcattaggttggggagcgacaagtacagggggattcgataggtagcgcttgagtgcaatgaatgcctcttcggcttcctatgtccatacaaatttgtcttgcttcttcagcagagcgaagaaaggttgtcctcgctctcccatcctagcaacgaacctgcttagtgccgccatgcatccagttagcttctgtacttgcatgagtcttgtgggcgacttcatgttctcgattgccttgatcttctcgggatttgcttttattcctcttccagatacgaggaaaccgagcagcttgcccgatggtactccgaacgtgcacttctctgggttgagcattaggcgatatcgtcggaggttgtcgaacgtttcctgcagatcgtcaatcaatgagtcgcttgtcttggtcttgacaacaatgtcatcgacgtaggcctcgacattgtttccaagttggtcgctaagtgcaccttggactgtgcactggaaagtgtttcctgcggttatctgtccaaacggcatcttaacgtagcagaataccccgaacggcgtgatgaatgttgtcttctcctcgtcctctttcgccttgctgatttggtggtagccggagtaagcgtcgagaaagctcaacaactcacacccggctgttgagtccaccaattggtctattcgaggaagagggaagtgatccttgggacacgccttgttgaggtcggtgaaatcgacgcacgttctccatttcccgttggccttccgcaccatgactggattggctagccactctggatggagtacctctctgatgaaaccagctttgagaagtttgtcgagctcttctcgtatggcttgttttcgatctggtgcaaatctccacagtttttgctttactggcttggcgtcgggtcgcaccatgagtttgtgctcaatcacctccctggggacccccggtatgtcggacagctgccaagcgaacacatccgcattgtcgcggaggaaggtgatgagcgcgagttcttatttctcgcctagtgatgccccgatcttgacggtcttgtcggggttggcactgaagagtggaacgatcttgattgcgccgtccggttttggtgtcttgtttgttttgctcactttcttgggtggctcagctgtggcgggtaggctgggcgtgtgctcgaccatgtcgaggctccgcttgtcgcattgtactgccagctttgtgtttccttgaatagtgattgttcccttcggtcctggcatcttgagcactataggtgaaaacggtatggaaacggatggaaatcatctttatcgttttcattttcatatttttttcggaatcggaatcagaaaccccggaaggtgatttgctccgttcggaagttatttgcttggccgaaagtcacaggcaacgtaattttgcccaatggtttggacgatgactggggagtgattccatggaagggttgatcggtgggtgtcaactcgcttcgtgggatccccatcgcatccaaagtgctggcgaagagaaggttgattgagctgccaccgtcgatcagaactcgcgcaactttgatattccgaatactgggttcgaccaagatcggatatcgtcctgggataacggcagtcttggggtggtcttcttccgagaattctatcttctgttcggaccacttcatcttgggtgcagccccctgccacgtcgaacagacttcacgttccactttcttgtattctcgctttgaggagtatgccgtggaacctccgaagatgtgcgagacatggagatcggagtctaggtatgttgagtccgattcctgagtagccgcctcagcgtccttctcaaccacacgtactcgcttgcctttttccgatgccatgtgctttgcgagcgactttttgaagacgaggcaatcttccaaagaatgtctgtccgacttgtgtataaggcaccatgcattcttcgcgtcgctaccttgtgggtctgggcgtttggcagggtcggcgtattctgctgcgagaacttacgcttgagctttccttttcccactcttacaatttttctttttgcttgactcaggtgcgtccttcgctggtttcttctctcctccggtcttcggcttgtcgttcttgcgtctcagtacgtcgtccgcgtgggcgcatcgatcgacaatctcgaataatctccgagtagtcgtgatgcgcctcgttgccaactcttgggtagtatagcgatctctgacactggacttgaaagcgcggattacagaagcgtcggtgatttcagggattgtatttctgcactcattaaagcgccgaacataatccctcaaggattcacccgggttctgtgtcaacacatgtaggtcgtcttcgatcgcgtggcgcttgtaagttccttggaagttggcgacgaactgctgccacaggtctgcccacgaagaaaacaagtagggcgggagatgcatcagccatgaatgcgcagagcctttcaatgcagttggcaaataattcgccaacacgttgtcatctactccggcagcgtagagtaccgtggagtagacctgtaggaattcttccgggtcggtactcccatcgtacttctctattgctcctggtcggaatctttcaggccatcggacatcacgtagcgaacgactgaaagctctacaccaagcgttgggggcggtgggttgtcggcgatcatacgtccttcgcggatgtctatctgatgatgaggatgaggaagatgatgacgatgatgatgggtcacttagttccggtgtacgattctgaggacatcggccgggttctcgagaatcccgtcgtcgccccccgttgttgtcccggcgccgatctccatcgtcgtcgtcattatggcggcgtccttgacaagtatcgtccggcacccgccgttcgtgatcgtcgtgatcgtggtggttgcggcggttatcgcggtctcggtcttcgctcgtgtggcttccttgttcttcgttatcttgacgtcacgaagagacgcgatgttgggaacggttcccattgtgtcgtgcgcgtcgcgcctctcggcagccattcaggtgatcgcggagatcaccggtgccgtgaggtggaggggtggctcgatgaggcgattcctgctgttcagggttttcgccattagcaccgccaaattgtggctgttccaggtgcgctgcagcggcggcctcttcgaacgcgttgctgaggttggtcactgattcccgtagccgttctgtccagcgtgcgagattgtcattcagaacggggtcatagggggtttccctcagtatcactgacggtccagcattagcgccatcagggctgatgtgctgatgtgcagtactgtcagggcggtgggttgtccagtgatagcgccatcagctctacaaccagaacggccctgatgtgctgatgtgttgtgcgggacagaacgactgaaagctctacacccagcgttgcctttcacttgaatttctgcttctgcattagcgcgcgctgacgtgccgatcccgtcgatagccaacacctcgcgtggcgtacttgttgacgatgagccatagtcttcgagcaaatgtagaactgatggctcgtgagggtcgatgtagattaccccaacgaatcgatccgagatcagtgtcgctccttgttccttgtccgcatccctaagagagatacgtgactgatggaccttaggaagcggcatcttcatggcgttgagaaagaccttgtagctttagagttcgtgattctttgtcttgtgaataggacaatagatatcacgagttggagaaatacgttgaattccacgctctttgcaggcacgaatttcggtgtgtacgttgagaaaaacccagcaagcttgcaaggtgtgttttctggttttgtggataggacaccaggaccttgtcgcctcggaagttatcctcgtcggctcatgattcttgtcgaaaagacaaggtttggccgcactaagatccttctcaggctcggatgtcgtcgacgttccgttctccgcttcggcgggaggatccttcgacatggagtcgtcttgggttgtagccaccgtgttctcgcttccggtcattgatggaccagctgagatcggcaccgtggtgtaaaccgggaagacgatttcgctgacttgagtccacaccagcattgtcgaagtaggaactccttggttgaggttggtgttagcgctgttgtcgacgaaactggatgacatattagtagatccttgagcaccaagtccccctacctggcgcgccactgttgacgggggatacccgtagaccggatatagagggtattggggtacgctggtacgaggatctacgtaatacgacatcaagcacacaaagagcacagattatactggttcaggccccttgataggtattagccctaatccagttgatatgggattatataatggaaatcacaagttacaaagggaacaatggaactcgatgataccggcgagatcgtaatcgagctggttcaactaaatctcctggcgacttggctcctgtagactccgacttcataggctgtggtggatgtgttggctatgagattcgatgccttaggtccttcctagggggtcccttttatatcgcaggtcaggcggtttccaagtagaactcgaagatatcggaccctgcatgatacagtgacgacccagtcctgtccgagtaggactccttccatctgtgaactccgtgatgaatttccttaatgtatgcagaaaatgtccgtatacacgcaggtataccatatcgatatgtgacgtataccgaaaggtaaagggtataccttacccgtaaccctaacagtttatatttataccccgagtacaaaataagttcattatggacacgactcaaaccatacgaacaagacctttcacggccgtctcttgacaaaactaacaaaactgtcgtaactaacctaattaatggatacaattggcttcaatgagccttatctctatttggcaatatcaattattccaaactgggcttatgctaaacccaaactgtgctgtatcggctgaatcggccgttgactgtcctggtcaatccgactcttggcttttgctttcagccgatacagtttccatccgacgcgcaatttgatctcaaatccttcatgcttggtcataaaatactgtaccgatttattcccttctatctgaaccccactgccagattttaccgttaacacattgatattgaactttgatttaattgaataatgaactaatgtgtattttacactaaaaatggtgtatgagactaatacgcttaaatctgtcgctgttctttttacgctgtagtccaacaatactctcaaatgcacggaggcacgcagtcaatcggttcaggacatgaatgtatgtggaagctggctcgacctgcatagtgcaagcattggcatggctcatgaccataggcccaagttgctagctgaggggctactcccgttggacccgtatacatgtacgcgagatatctaaatacaggaacagcagacgctcgcgataggagaagagtcacgttaggagcgccctaccccgaatgctgcatggacatgtgtcagtaaaacgaagggacagcaaatgaaccaatcagctgctagcacacccgctagctttaactcccttaaccagtgaacaaatataaacaaatataattcgtatccctaaaccataacaccggatatctcgacccctatttattaaaacctgtacaattaactccctcaatggttttggagagcggtttcgctgacgcggcatctatgtgttagtgttgacctagtctgtagagttaacatgacacttaggtggcattagaattaacaacatatatgtgagacccatttgtcatctaaaaaattatgaggcccacatatcatcctctctctttattcttcctccctctctctctccttccttctctatctcatgcactgttagccggtgaacggaatcccggcgtcctcgatctctctgcaactctcaaactaaaacactcaacaatgcctctgaacttgaacacacatgaattggcgctgcaacaccttcagcagcttttctgggttatattcatctccttttatttggaaacaacgctagtaaatcggcagtagtggaccatcatgcgcacgacacgatccgcaccgacgtgcgccatcccacacgtcagatcgtgccgcgcgagactcagactccacgacttcgacgtgaactcgcacgcctcaagtcttacacacgacgtagctgctatagctagccggcccacaagcaacacaaagaaatgaacgacacactacctgacgaggaacagtgaaaacagaaaaacaaaaacacctaaaaaaacaatgccatagacggcaagattgacaacatgcaccccctctctctcccccatgttttctcccaatttcaacggagaggaagtgcaacagcgatgacgaggagtggtggctccccagcgccatctggaacctgtacgagcacaacagcggagatgaggagtggtgactgaggcggttcctcatgcattagcgctatccagcgatggcgggagctcagcagcgacgcgactggtgtgcctccccctcatcagctccgtccccctgcgtcagcgccatccgacggcggctgaagcatagcagcggtgacgagaagtggtggctgttggaaatttggtcataattcggcatattttaatccaaaatattaagacaataaacatgacatacacaatgagaagcgatctagtgataaggctaaacataaacataagcatgcttaaggtaaaataagcatagacatcgttgacattcacataggattgaaatcctatggataacattgtgaacatgtaaataacaagaagaaaatcaaataaagtacatggtgcagaagatgttgaggcattcgtattgcctccattgatattgtctcctccgttctctccagtagaagccatggtgaagcagaagtagaggaagatgcaacgttgtcgtcgaagaacgaagaacaggagcagtcacgcttgaagcgctacccaaaaacttgatcgctcgcctacccgtgcaagttctcaagcggacggagttccggaggcacctgctcgtcccgtacacctgtgcgcgcaggtgaacagaaccggggaaggattctgcagctcaagaatagaggaggaggaactcaaagtgcaagagtcagcaagaacttcataagtccttctggtcgctgcggagtatatatatgcaagcgcgagagtaacgttcggagtcatcagccgcggtgtttaatttcgtaaccgacgcgctcgttaatacggaatcaattcacggcatttaattccgtaaccgacggaatcaattcacgacgtttaattccgtaaccgacgcgttcattgatacgaaatcaattctccgtgtttattaccgtctgttacaaaacgagagagcgcagcagcagctgtttgccttgcctcgcctcgccccgcctggttgtccatgcaccatctcaaccggtcaacagagactctccactagttccatatttaagttgagacctcttcacttagatttccaaggtggtattattacccatagcacttaatgtgggccaatggaatttattaggatttaattagacctagcccattaatctaacaatccccaccaaatttcgtggctcataggaaatgctctcgattctgatcctgtttgttataccagtgtttcggtggagactgttaagttgaacttccacctaggaaaagagctacaccagatcacaactgaacaatggactatgccttgaattgtcagtcttgtgcgattcaggtttcactcatacccttaactggtactaggctgttgtttgcatcccctctgtttggagcatataagtcatactcctggccttttcatgagtatctagagatcacccagatctcatagactgtgactagcagtcggactcatataggtgtgttccttctaagatgttctgtaggataacatctctgctttatgaaaagccactcggatcacattaaggtgtataccatcctaccatacagaatagaagagaagtgcatcatgaagataagctcattttagggtctcttctctcagttacccaatagtttgtttcgccatccaaattcacgggatctccgatcacaatggacaggtttccaccattgtgcaactctaagtgggtctcaagcccatctccctcgatgcaccgtctatcacattacgtggtagccccttggtaaactgatctgccagatttttagccgtctggacatagtccaatgctatcactccaaagtttttctgctttctaacagacttcagtcttcttttaacatgcctagatgacttcatgttctccttcgaactattcactttaataatcactgtttgattatcatagttcatcaggattgttggtactggtttttcaaccaccggcaagtccatcaggagctcacgaagccattcggcctcaactgtagcagtatctaaagctgtgagttctgcttccattgttgacctcgttaagatggtctgcttgcaagacttccaggaaacagcgccccctccaagtgtgaacacatacccacttgtggcctttatctcatcaatatcaaatatccagtttgaatcactatagccctccagcacttttgggtacctggcgtagtgaattccatagctcattgtcccttttagatagcgcattactctttcaagagcatgccaatgatcatctcccggatttgaaacaaaccggctcaacttgctcagagcaaatgagatgtcaggcctcgttgcactagctaagtacatcaatgaaccaatgatctaggagtatctcaattgatcccttgctattcttcggtttttccttaatagcacactgggatcataagaactaggagctgccttacagtcactataaccaaagcgactcaggaccttgtccacatagtgagattgcacaagtgtaatcccaccctcatctcctctcagcagtttaatgttaagaataacatcagctactcccaaatcattcatttcaaagcgtttggacagaaagtccttgatctcctcaatcacattgagactggtcccaaagatcaatatgtcatcgacatataagcacaagatcactccctctcccccaccatagtgatagtacacacatttgtcagcttcgttcacaacaaagccagcagatgtaagtgtattgtcaaacttctcatgccattgcttaggtgcttgtttgacaccatataaggacttcaatagcttgcacaccattccctcttgaccttctaatacatacccatctggttgatccatatagatctcctcctccaactctccattgaggaaagctgtcttaacatccatctgatggacgagtagaccatgagaggctgccagagcgagtagtactcgaatcgtggtcaagcgagcaaccggtgaataagtgtcgaaaaagtcctcgccttctttttgggtataacccttggccacaagccttgccttttacttttcaattgtaccatcaggcctaagctttttcttgaaaacacatttacatcctataggcttgcacccatttggacgctcgatgacttcccaagtaccattagacataattgagtccatctcactgcgtaccgcttccttccaataatcagcgtccggagatgaatatgcctcttcaaatggttcttggagtatcatccacaagatatacaatgtagtcatctccaaaagactttgcagtcctttgtctcttactctttcgagttgctacaatgttatcctcctcaggattttcctcaggcgtttgatcaatgtgttctatcggcgcaaagtgcttaggggataaaataggttcttgactagaagtgctaggtgtatttttcataggaaattcattctcaaaaaatgtggcatctctggactcagtaattgtaccaacacgcatgtcgggtactccagaatttactattaagaacctatattccacactgtggatagcataaccaaggaacacacaatctacggtctttggtcgaagtttacgctttttggctatagttacatttaccttggccaaacagccccatgtgcgcaggtgagagagacttaatttcttcctttcccatttctcgaatggtgttacatccttatgcttagtaggaattctattcaggacatgacacgcagtaaatattgcctcaccccaccattccttggaaagtcctgcggtgtctaacatggcattcaccatctcagttagagtgcggttctttctttcggctaccccgtttgactggggtgaatagggaggcgtcctctcatgaataattacatactcttcgtagaaagaaataaactcattagaaaaatactctccacccctatcagacctcaatcatttgattttcctttccagttggttttctacctcagccttatagatctcaaagtaatgtaatacttcatcctttgttttcaataggtacacatagcagaatctagtgcaatcatctatcagtgtcatgaaatatttctttccccctttagtcaacacgccgttcatttcgcacagatcagaatgaacaagttctagtggtgccaaattcctcgcctcagatgccttgtgaggcttgcgaggttgtttcgattgaacacaagtatggcacttagagcctttgactaaagtgaattttggaattaaactcatgttggctaagtgtgtcatacaaccaaaattcacatgacaaagtcgcgaatgccacacattggactcatcatcatcatcgcttacatggttcacaactttattacacatatcatccaaggaaaagcggaataagcctccgctgtcataaccttttccaataaacgtttcatatttagatacgacatatttattggattcaaacacaagtctaaaaccatctctacatagtagagagccgctaactagattcttctttattgaagggccatgctgcacgttcttcagttgcacgatctttcccgaagtaaacttcagatcgaccgtaccaacaccatgaacagccgcaagcgatccgtttcccatcaacaaggaggaacctctcccaacttgataagaagaaaacagggaaatgtccgcacacacatgaatattagcaccagtatcaacccaccaatcaggtgagtgacagacagagagaactgtaggtaaaaatttaccataccccaatgttcctccgccctcactaataaccatgtttgcagacttcttgtccttgcgctcaggacaatccttggcccaatgcccaggcttgccacacacaaagcaatctccttttgcctttcctttgcctttcttcttaaaattggtagtagcctttggtttgacatcaggcttgactttcttgttgttgttgtgagatgcatgagggttcttcttctgcaccaaattggcgctagaacctccctcgatctttttgccctggttgtcctttgccctcgccttctcctcaacacccaaagagacaataagatcagtaacactgaactcttgcctcttgtgttttagagaagtagcaaagtctgtccaagaaggtggcaatttggcaataatgccacccaccacaaacttgtccggcaactcgcagttgttgttctcaagttcctttgccagcatctgaacttcatgagcctgttccactacagaacggtcatcgaccatgttgtagtcatagaactgctccatgacatacagcttgctaccggcgtcggaaaccccgaacttggcctcaagatcatcccacatgtccttccctgaaggcatgtgcaaatacacgtccacaatactgtcggcgagcacactgatcaatgctccacggaacaagctatccgcagcctcgaacttagcctcctcctcaggggagagaggcggttcactcggtttgccccgtgaaacaaagaaacaatgcatcgccgtcaaccacaaaaagtgtgtgtgctttccatcttttctaatttgaaccatcgaaagcatgtggttttagtgatgcagcaaagccaactaccgaaaaagacctatcaagtttttggattgttggaaatttggtcataattcggcatattttaatccaaaatattaagacaataaacatgacatacacaatgagaaacgatctagtgataaggctaaacataaacataagcatgcttaaggtaaaataagcatagacatcgttgacattcacataggattgaaatcctatggataacattgtgaacatgtaaataacaagaagaaaatcaaataaagtttgaatcttatacccagataatggtgcagaagatgttgaggcattcgtattgcctccgttgatgttgtctcctccgttctctaaagtagaagccatggtgaagcagaagtagaggaagatgcaacgttgtcgtcgaagaacgaagaacaggagcagtcgcgcttgaagcgctacccaaaaacttgattgcgcgcctacccgtgcaagttctcaagtggacggagttctggaggcacctgctcgtcccgtacacctgtgtgcgcaggtgaacagaaccgggtaaggattctgcagctacagaggaggaggaactcgaagtgcaagagttgggaagaacttcgtaagtccttctggtcgctgcggagtatatatatgcgagcgcgagagtaacattcggagtcatcaaccgcggtgtttaatttcgtaaccgacgcgctcgttaatacggaatcaattcacgtcgtttaattccgtaaccgatggaatcaattcacgacgtttaattccgtaaccgacgcgttcattgatatgaaatcaattctccgtgtttattaccgtccgttacaaaacgagagagcgcagcagcagctgtctgcctcgcctcgccccgcctagttgtccacgcaccatctcaaccggtcaacagagactctccactagctctgtatttaagttgaacctcttcacttagatttccaaggtggtattattacccatagcatttaatgtgggccaatggaatttattaggatttaattggacctagcccattaatctaacagtggctagagcggctacccttgcatcagcaccgtccagcggtggcgggagctcagcagacgcaactggtgcgcccccccccccccccttctccctcatcagcggcggtcggccagggagatggccgaaggcacgctcgccgtcgcaaaaggcggggtctcatcgtcagggatgcggtgcaggttgggggagctattgggcatgatgattgagcgcgcgggaggagactgagatcctagtggaggagcgcgttgtgagcgacgggtcctccgtctcttcgcaccgcctcgaaggataccgctccacgccgccgctcctcatccccgctccccgctccccgctccccgctacccctcctcatccccgctccccctttcttctttgctgctagacctgcggaacgacggtgaggatgatggcgatgtgcggaggagccattgataacagtggcagaggggctccagcgtcaaggtccccgcactcttcgccaagctttcctctggcttggcatcatgcgcttaacgagaaagcccctgcacagccgtctcctctgccgccgcctcctccgcacatcggtcagaccggtggcgagcaggcgatcagaccaacgggagtaatgcggtcaaaccagcggatatccaatggtgtgaccggtgtaaattcgccaaatccaagggtaacttttattttcactaaatttttttggtttttagtatttctaccgttcaccctcctctgatagatttggttcgtgtactcgatcctagagttgcatcataaactatgggtacatattgcagaagatctgagtggtcaagatttttaaaaggaaggtaaccatcatttaatttgctgcggctgggacggcacaatatttttcttaatcggtgttgattcggttgaatgatatgttattctaatttaaagacaagacacctatataaggtcagtgccgattgaataaacccctcaacccaatcgataaattgattctacgattattgttctgttctttttttctggagtagattaatctatctctctttgccgatttgattgaaaatcggtcgctcgttgtcgaaaaacgcaatggttatcttgttatcaatttgttcctgacaaactgcgtgttgcctatttttaacgcctaacacatatccggcaaagtggagctatatctgaatatgtggaagatttgatggtattatacatcagctgctggcttacaataatgcaccaactctattgtaatttttttaacgaaatttgtggaaaattttagggatgatattagggcagtcgtcgtgattcagaagccacgtgatttagatattgtgcctgtttaggcgagattaagattctgagaaatagctggttggtagctagcttctaagaatctaaaaatgttgggtttcgcagattctgacttctagttcattttcagattctgactttcaaaagctggactgtttggggagcttctaattttgaaagaaactgcagccgccaaaaggtcccccaaataggccaattatttgcccattaaccaaaataaccttatagatatacaaggttctacaatatattattgggtatggcttttctttttttctttcaaaaatacccaaataccatgtatacttatttactctttgtggatacaaatgtcgggtttctgtccattataaaacaaacaattccatgttgtttagataacatattaacattgcggtgagccactgatgttcgatgatctgttacgtagctccattctggatgcagcagttttaattgtatggatggtttacagggagagatcaactgctagaaacatgctgctgctgttgatctgttgttgtaagctgacattagtagatgatccatttattcatgatcaatgccagtctaccaaacacagacatggacatgcttcagaaatatatgtattcttgtgtgtgcgcagctggtatggcacacgtattatcatgctagctgatagaaataagacactaaaagacagagcagggcagttgagcagagttatattcctgttgacagcaacagttaatttatggacggtttggatggaatggaattaggcaaactaagttctttagttaatcaagctagagctagaatgcctaaacaaacacttgcccgaggggaatcagaataagcagcattacaatcttagtttttttttttcttttcaatcacagtatgtgttctctagctctgagctaatattcagacacctgaatattttgttctgtctcccttcatcaattcttctctaatttgtcctaaatatttagctgtcagtctggtagtatctcttcttaaagatgctcgtgcgtatcttgcaattatcatatcgggtcgacgacgagtcggcgactgctgcgcgcctgcgcctacgtataagaagagaatcgaagtgaaaaataggtcattttgcgaaacacaatcagtagttggtagctcagttgatagtgctattaggcagcttctcttgccaactcaattgagactacgacatgagaattagaattgcagagcaggtgaagatgcagaagcagagtacataacgatggcgttaggactcgacgttcagagagtgagctagtcagcacgccattgatttttgtgcagagatcgatggatagacggcggattcggccagatgtggagatcgaatctgtcgccgacgactctgccaattatgtccaggttaaatctctcgactcagctgaagtgcatgcaatttactgttgattagtatgtttaattaatggtgattagttcattaattaagctaattatgtgtgtatatcaattgcatcgtgtagaacatcaggttggtgattgacatcggcgacaggacgatccaggtccctctcaatggccacaccgtcgtgcagaacatcggccgtcaggctgccgcctccgtcgccggtgattcgtcgtcagccggcggcgttagtgagaaagccggtggcggcggcgaggagtggctgcaagaacaggacggcttgctgtgcatgcgcgggtggctgatggcggcggccacgctgttcgccgccatggcgttccaggcggcgctgcagccgccggcgtggatgccgaggccgcgtgactggttcgcggcgctgctcgccgccgacccggcggcggccgccgtcacgagggaccaggccgggaaggcgatgctgtatctgatcgtcagcacctgcaccttcgccacgtcgctcgccgtgctcctgatgctgctcgccgtgggcggcggcggcggctgcgcgtcgaggagggtcaccgcgaggctgatctccaacatgatgacggccgtcgcgctcttcgccgcggcgacgttcgcgctctgcgtcgctgacgactaccggctcatggcgttcgtcggcaccgtcgtcgccgtgtacgccgccgtcacggtcgtcttcgtcaggtgcaaccttgctctaccgtttgggagaggcggcggcggccatggttgttgtagctgggtgccaagaatgtaaaaagaccgataatactgggccggccatgcgtttgattcagccatatattattactatatacacgcgcggcgcaatgcacaataatggagttttgtaccacatgaaaaatttatagtggtagagacccgcattaaacaggacgtggtagtgttgctcccgcggagcttggtgatgtgagcttgtcaccccagctgtggcgggcgggagttggcaggatttggccgatgttgggtggatcgagggtatagataagatatccctggtctcgttgggttgcttagagccctgcgttgtttaacgtcagtgaacttcccagctactttaacgagagaagcccacggccatatcatctggtccaactctcctcttttctttttatgatgctatttttcttttacttttcccttcaaatatcaagtggggtgaagatgatgagaattagaattgcagagcaggtgaggtgaagatgcaggagcagagtacaaaacaatgacgttaatcatgttaggattccacattcagagagtgagctggagcacataattgatttttgtgcagagatcgatggatcgattgattctgtcgccgacgactctgccaattctccaggctaatcaactcagctcaagggctttcaatttactgttgatgaacatgttcaatggtgattaattagttcatcaggctggtgatcgacatcggcgacaggacgatccaggtccctctcaatggccacaccgtcgttcagaacatcggacgtcaggctgccgctgccgtcgccggcggtgtcagtgagaaagccggtagtgctggtggtagcggcgaggagtggctgcaacagcagggcggcttcggcttgttgtgcatgcgcggatggctggatggtggtggtggccacgctgttcgccgccatggcgttccaggcggcgctacagccgccgggtggatgccgaggcccagggactggttagcggtgctgctcgccgtgggcgatggcggcagcggatgcgcgtcgaggagggtcaccgcgaggctgatcaccaacatgatgacggccgtcgcgcagttcgccgcggatacgttcgcgctctgcgccgccgacgactaccgcctaccggctcatggcgttcgtcggcaccgtcgtggccgtgtacgccgccatcaccgtcgtgttcgttcaggtgcaatcttgctatgccgtctcggagaggcgacgccggccatggttgtagctgggattccaagattgtaaacgcgtctatgcaaaaattggctcattggctttgtatccaaaccacacaaggacacattgattctgcaacgaaaattacgatgaggacgaaacataataagaccagatatgataattactgggacgccacagcccatattagtgcacgtgtaacccataagaacaaagtttcgtaccacatggaaaatctacatcggcttaaaccggtataaaaaagaacacgatcgagatgctaccaccgagctcggtggcgtgagcttgtaaccctagctgtagggggcgggagttggcagggtttggccgttgttggggtggccgttgttgggggatcgaggtatatagggagatatttctccccccgggtctcgtgccggatgctagcattctatatctccttgccattgtgttcgggtcggcccttgagccgccgcctaacgaaaatgttctaggtgactccctttctactcacgagagaagccacgaccctatcctgtccaacttctcttttctttttccattgtgttcgggtcggcccttgagccgcctaacgaaaaatgtctaggtgactccctttctactcttgagagaagccacggccctatcatgtccaacttctcttttttttttgaattcatggtacattcttattttcgcacctcttttctttttaaattcatggtgcattcttatttttgcatcctttccaccgacgagatcatccacggattcatggtgcagttcggtgccgagcggattcgagcgatctcgtcctttaggcggagggagcgattgcatcgatgcatgcagccgtcaggcctaagggaagtcaaggtggaatatttttttattgtttcatgttgcgatggattagaattcaaacgtggatccctcttctaattttatttgggtggattagagtctgattccttttagttttgtttttgtgtttgagttgggaaatttggaatcttgagaaggcgctaaccgcgcgaggcagagaaggtgctcaacgacggatgaaaacacattgtgatgatgggaaaaatccaaagttttaagtagggatagatttgattcagactctagaattctggatgatatttgccgcgactggcttttcaatctatctttgatttgtgatttccccaccatacactatcaagagtttgattcgatctctgatctgtcttttttttcctttttgctttagccggcttgcgtgtcgctcgtgtgtggatggagggcgccgctcggtcggatttacgggcaaaatttttgtgtgacaaaaggaaaattgtgaatattttaattagtaaagatatgctgttgttatttattgttgattggtacgataatttctttgtgtgtctatatagacttgatgtgatgccacatcatcaaaaccgatatttgtttgtttgagtcaaaggatgaaattaatgacaatggttttgagagttttgagagttaacagaccaacagtaatcggtttgaatgctaagcatgaaaatgggtaaataaaaaaaatcatatcaacgataaaaagtaacatttttcttataaaggcacccgtaatgttatataaaactaggtagtatacttggtattaagtactgtggaactggtacataacataccgtatagtagcactattaccagaaacaaggagataaattatgtatgtacagtctctcacacaaaaagtaaataaagcaagtggtagttctctgacagaaaaagtaaataaggcaagtgattgttgcttctatgggcctcaacttattggcatcttgcagaagtaagcaatgtggagtgtgtctattcctactacccatgtcgacaatgtacgtaatgtacgttgttgatgccctaagttataaagggtccttttggagagcttcaagttctaaatttaatttcaagagctaagtccaaagttgatttgtaattaatttgtaaaatagcctgaaccctgctctacctttctagtttattttgtaagatctatcatcctagcttgttacgctattcttttttatgctaaaaccgtttagttacacttcagcttcaagagagatggagctaaagctgaaatttcatcaaataggcccaaaggaaagagactcattttacgactcctatcttttagagaagtttggaaaataatgctatatttcaaaattgccctatattcaaaccttaaactaataaaactatttatatctcatttatagagttggcgttcacatagaagttttgcagattttttctgttaaccccaatgaccatgggtaactaccagtattcacgatgctttgtcactatgtatatactgtatcacgcatggtcacacacacatggcacaaacatgtgtgtgacgaataacgactgaccttgtgaagcatgacaagccgcaggtcactcccaaccatccatctcatctggtttttcatagcattttaagcatattatcacataattaagcaaaagattgaggtggatagagagttaatgaagtgagagaaaagatgaggtaactatttctcatgtaagaagctagttctacacataaaccaagaataaaaacaagaggatagcttccttgcaaaaaaaataaaaaagaggatagctgaacaaaatgagacagaagagaggttattggatgggaatttactatgaagaaaccattcattgagtatatagtttcttcatatagtgtttatataacatggcaagaatataaactacttttgatagtttttgacttgggatttgccctcatcaggtccatttggaattccagtacatagtgagcagtgttgggtagtaattaactagttaaggaagagcacaccgcacaccggtactactatttcaagaaaaaaatggagatcccaaaatctttgttcatccgtatcaaaaattagtttttctatatgttttgaaagaccataaaaaagctaagtgaaattaagaagattgctagacggatattcaattttcctttttgtttctttctttgtgtgtgggggtaggggagagagaagagaggataatagatatttttaaatgtcacaccgtgcattggcaaaatatacttacaattactataacttctagggtaggccgccagttcctcccaaaggctaggtacatagcacccctaccgtatggcaccactaccaaatcaattttttggacgagacttcctataggttgcacatggaccataactgctcccacatataaaaatcgctcttcacgggatcgattcaaggcatcgcgggtagccgcttaagagacccgcctgtgaaaatagatttattttcgcaggagcgcctcttaagcgactgcatgtgataatgcattttcgcatgtgggcctcttaaaggcctgcctacaagtatgtctaaccgtccacctcttttccctctcaacatcttcaaacttttccaaggcaccttctccctcacctcctcacttccttatccttaccttctcacgtccgctcctccttttatttctcacctatgggactttttacctttgttatcatatgatcctaatggttcatgctattgtatgattcatgaatcgaaaactaatggatctatttcattttcgttaatgaagttgcttctgcgtcccactgcattttcttccttctactcaggggtggatttaatgtagaaatgatgggggccttggaccccagtcaaaattacactccttaggtgtatccctagtagtatgacctatgggcccccactttaattgggaggaaggaccccagtccccaagttttcgttcctttcatcgcaatcgcgcgtgcgtggagaggtcgaacggtcgctccctttctcttattctctcagattccatcaactagcaaatccgcaaattagggattagggaagggaacaggaagcgatcccaccatcgtctcaccccatccgtcgcacttccccgcatgccacagttcatcttcacccgaatcactgcttcctgccttcctcgaccgcttgtcatcgtcagcgccttagcctcagcggcactgctcgttctctcctctctgcctccctggtacgcactcatctccttgaccctctcctccctttcgtgctgtcaatggttatagtggatggatccataggtctccctcctcatgtgctctatctaattagccttcccaagatttggtaggtgagataatgaacaattttttttattaaaaatccagcagctatgaacaccaccggagaaagttctagtgcaaatgcatctggaccaatactgagaaaaatctggagtgcctcaaccaattgatatggacaagtttcctcaggatacagtaaaaggaagagagtggcagttatcatcccaacatgaagacataagaaaatattagacacgatcactaatgatgtgattgtccatcgtttccataaaatgaaacaccgtcgtgaaaagggtaaaaaggatgccatgtactatatttataaacattatttcttatctatatatactactttcagtaatatttatatggcttgtgttaacttatgttatttctatagacaatgacattatttgaaaggtctatctatatattactattaaagataatgtaatatctcaaagtttttagaagctgcaataaggtaagtttcacttggctttctaactattctataagttatatagatgcatgtccccagtcatttttttatcctgtgtccgcccctgcttctacttgcattcttattcctccatcctatcacgatctggctccaactagcattcaggtgattgcttacgacatatttagtcatttccatccttccaaattgcagtgaaaacagagaataaggaatcaccaatgcttgaaccattcatatgcttaacacataattcaagtccgtcaaaaccgtacgaagttttctaataacacctcacaaataccgctgatactttatcccatctttacctgtttagtatcaactttctaaatacaaacttcgcatgttcatcataaaccatgaaacctatcacagtggtcatgaaattaataaaaaaattcctaacacataaaaatttcttatcatatgatatttcttcacaaatatgaaatagttgagctagttgcactgcatgccacaccaaaaagccaggcgtggcaaacaccagctaccacgctaaggagccggccggaacaggtagttgtgccacgtcagggactaattaaccttgtcaatggcaacgactgccacggggcaccctttaatttgcgacaccatgaccaatggcgcggtagctcagattggccacgccggttaccatggtgtggcgaaagggttcattttagaaataagttcctgggaggtctattattaaaactaggaaggtagcccgcgcgaatgcgtgggcatgcgttttatacactatgtttgagacagttataagagcgaaatatcaaccgtaaaacatctaccatgatttcttcgtaaattgttttcgtcgacattaattgcttttttaattttctaacctattagctttatattataggagtatcatatttacctgatatttataagcaattatttataatcttcttcatcatttgaaaagaagaaggtagacttattttctttagaaaacatgtcaacaaaaagtaagtgtaaggtaaaactaaggtatttttctttttttcaattgcatatgtattatcatggtttattcgatgatgaattgggtgagacatgaagctccactaaatatatgggtttatatagcctaatatgattgatgtagtttgagagttagtcaatctatgaacatttcatgtagagtgggtaagaggttccacgcaagctaacttgcatacgataacgatgaaatataattgtacaataatatttttgaaatgtgacatactatgaatacacacttgtgtttccttttataagatagttctaacggttagaaataatggttctactggtttaaaagatataggagtactccaagaatgtagcttaaaaattatggttgttttaatatccaatattattacgaagtgaacgtagctcaaccggttaggttccttgtgatggaacttgcccgagttcagacttcacaaattcttttagtggtaggcaacgtacccgtcgatagcgagacgtacgtggtgacttcgtcaatctcaaaatatatcaggctagtctcttgaaagtactcaaaggggtatttgcatgtgtgcgttcacagaagtaattgtgcgcgttgtgagcgcccgcgtttgtactttgtttcaaaaaaaatatcaaacattacttattatttctcttttatttaatagataaaataatagggaggggatgacagtgttgtgtacatgtgagggtgaggcggtggagattatatttttttaacttttttaaataatttaagtgaaagccaatgacgaggtgtttcatttttttctaagaatttctaaggtttttccgtttttataggacgtgacacacggtgacttaagattttttctaaaaaatagatttaatggttaaaaataatggatacatcaaattaaattgatttttcttataatttaattacaagatctaatctattggtttattatagatctagatttacatgcatatatatacttccgtatattatgtagtattgtattttatcttttttatattatacaaaatcctatttttagaccgtagtttttttcacggatactaagtacgcttttttttttgctttattttatcgtagatagatgtctatttttttcttccagctaacagtaggtagctttatatgtttttttaaaaggtagtagctatatttatagcgccatatttttcaccaaaaaaatagtaaaataaaatagtcggtatgtatttacattgtaattccctaaattatatatgtaattttagtgtatttataatgtaagtctcaaaattagatatgtaaatcttaaatttatatactaattatatatataaatggggtgtaactacggtgtaaattcgtataaatatataaataattattaattttacgacggaggtgaagtgctaatgagtttagagcttgattaggtgcatttggttctttcgcataagctgtaagatgggatgcagcctgcaagtgcttgaaacgaatcttaccggacgatctcacggttaaaacatccgactgtacacaaatttagcaataccgtttaacgtagggacatttatttttctttccttttcccagccaccggttgcatatgtttttttaaggaaaaactatcaccttttttaataatagatctaatctaatggtctaaataaacgggtccaccaatttaagtgaaaatcgacgatgagattagatagtgccacgtggcggcctaggagcgtttgtaggagtcccacgtggcggcttgagagcgtttgtaggaagtttcatggacttttagtatataatagaaatagatagatagatagatagatagatagattatttattaaaaaggtctaaaatataaaagttttccccaaggggtggttgtcttgtatcgttatgtgtagtgtcccacatgggattttctggtactgctactgattaggaggatgctattgtacgagattccattaaaacggtatgatacttggtaggtaggaggtctgatacctacgtactacggcctccgggcatgataccacataggtatcagctggtactatttggtattagttggtcctgtgtgttacaatgcatgacaccttcaataccacatattcccagttgatacttggttggtatcaggctagatccctgcataaagcacgtcggcacaagcaaggaggctttcgaacaaggacaaagctctggcaacactggctatatgacgccttgtgcttcagtgccgctagcttgtttgcaggaactcgctgccgcgctcctctgtatcaaccagttgttggcgaaaatcgagcgctagacctgctacgagctccttcggaaaacagaggccgacaacctcctagagctgctcctccaccgccgagtcaatgacctgctggacaagcccctccaccacatggcgcatgaatagtgaatgcatgcggtaatcaacagtttgcagcggttcagcacgcgtcgagtcgcgcgagcgcataccgtgcgcaacaccgatagtgaagatgggatcccgtccaatagaccaatagcttttttcctattaaattatagatttttaattaaaaaaattaacctgccttctgtcagcgcttagaacgggcaatcggctccagtaggtcactaaggacaacttaaaactaataagaaatatccccacttgagaatcggataaggaatctgtagcacttcagaaatgagcatgctgattttgcattagagtactagaacttaatatatgagactattgatagaacttgtgaggagcgacatattcactgcccggccagcgcgggcagctgctcgggctctgcgtgtgccaccaatggtgatcgagtgattgctttgcattaaaatccaacgatttttttacttcgtagacataattagaagcatcggtactggcagctagccatgcaagcagtactgttgcacgatgcaattaggcctagccagacttgactgcttcacaatggatgacaatgatccattcaagtataatatggcatacgtccgttttaatttatattaaaatcaacgtagtttttcaactagtgaaaaattatatgcatattaaactaaactatgcttttattagaaaattgttctgccttcgattggtagtaaaatgagcacataaacattatataagcgggtagcagttttatcttttcatttacaatttgcccaccccttcaaaaaattctagctctgccactgcttgtgagaaatgtacttggaatgtgatattgcgcatcaactttgacagagttcctacaaaccaggagtttctaccggtttcgtggtcaaccctctggctctgtatgactcgtatagtagcaaaatactactccgttgtatggacttatcgattccagcaaaaacagaataccgtaggagttcacttccctaagcctcccagacctaaaggcctttttctgactggttggtgtttgtttttaaactccagtgtccttagcggtttaatgccaagtgaccatcgactagaggacattactgatgagtcccgattgtagtgtaatgcctggcaatagaacatgtttgccaattctctgcaaattaatgttgttgaattagtaaaaaaaaaaaaaggtgtacagtgttatttacaggatgaagctcttgggctgatgagcttgtaggatcaagatcagatgagcattgcagatcaaacccttcaaatggactaccccccatggcctagggaccaaatgaactgtaatcacaaattaaggtataagtagggttttggtttggagtttgtttgtctttctccatgtcagcttgggctttatattcctagtcaataaataaatatgtactaaaaacatcctagtaaatcctactataagtatactccattggtcgtatcttgctgataccaatcctccaaaatatcccatgtatccatgggacaaccaaccataaacccctctaggtttgggaggcttggggaagtgaatggctgaccacaatagtttagcattttcttggttttaataccaagatttatgcaattcttacgaactactccctccattcacaaatgatcaacatatatggcttgtgcagtgataccaatacattctcacatgccacttaaactcttaaactgatatagatcaacttgcagcaccgttttgtgtgtcctgcacatgcatcaagggtaatttggaccaatggtattgcttgcatgcatgcatgcaccacaattacaattagttgaatggtacatggaacaatgcatgcaaatgaccatttaataatgcatagaaaaatgacaagtcacatgcaaggaataccaaatatgttgatcatttttcaataacattgaaaaacttatatgatgatcatttacgaatggaggaagtattgatttgcccacaacttggcatcgcttctgcaaacgagaagagtagtgcaaaacgaccagcagtagtacattaaaagccaacatagtgaccaaatctaacactataggtgatgaatttactgtagatgatatcctagcgtgtaggaacactcctatgtttgagctgaaatacttgttat

SEQ ID NO: 13769 - DNA, 9001 bp, Oryza sativa
ctgagtgaatgctctactattgccgcacttcatttccccaagcctctcaaacctaaaaggcaatccaccaaaaacctaaaaagggttctttgaatggttgctacattttcagttggacacgtgggttttgaaggattagaagctacaagagacatgaaatcaatggactatatttataatgggttttaataggatattttcttactacaaatttatttattgactatagagataaaaccaaatctgacacagataacggcattcaaatattgaccaatccactaattatacctttacgattatagttcatatggtcatatgccatggatttactactacaggaaacggcttcagtgccggttggggactctcatatgtgttgggtccccaaccagtaccacaattcctgcactgattacctccccatcatcaatgccggtttaacaaaagtatgagccggttagtccaaatcaatagcatgcctagattagtaccaaatatccaaatctttcatatctaaataaatatcaacatctcatagatcaatacatatcaatgaacacactcacatatccacattcatagatcaacaactgacaaatctaaataaacatcacaaattaaaaattaattgatgcatacaccaccccaactgtagaactcaaccccaccgaggctgtcgatctccctcttcttggctctgggtcatcattgtcgtcatcaagcctcctgattgtttgacacttttgaccaaaatatttgttctcgtttacttgttaatccacacttctcaatgtaaatttttccaatcttatcttttctttcacacatctagtagtatataactatagcctaactcagtttgcaatttactaacaggtgaatacaaacctcctgaccatatatatattaggcacagcttcttgcccaccttctttcttcactttgttgccttcctttctgacagccattgactgttttacccagtgaaagtgtgatgcactgcttgtggcacaaggcacacttgtacaatagatattttggtcataaattttggaacaaatcattgcctagtttatgtgctagaatttatgtgtcaatttgttgacgaaaaaatcgaacacaccggcctaggagatctgcttagctcctgtgcaggtccaaatataatgagatgcgggcgtgccagtcagtttgatcctgcaactgacaagatatgcaaatagtagatcaaaacagccgatcggctgacaagccgatggagtagttccagccgatagccgataatagccaatgccgatgccagccgatagcgatagggtttaagcaatcggctatatgtccaatgtggatgatgatataaaggcaatcagctgttgataatgtaataaaataacaatataaccgagtagaaaccaatcggctagagacaatatataataagcacttatccaaaggtcaaagcatacatcggctagaggttcgatgtcattaaatccataggattagataaacagtaaaatctatgttgcgatcggttaattccaatatgtatacaatccttgtaagccgatgcaacgcctagataactcatcggttgaaaccccgatgaaacccttattggcagtcaaaagcaggctagagattatggttctaagcacgacttagtagatcaaacttaactgatgcagcactgagtatgaaaagaaacataatatctagacaatcaagccgttgactgatttttcagggtggtagatgtccaagctaatctaatctagcaatgtgatttagctgataccggcagaaaccctaaaacgagaagcagccgatagagctaaattgatatgctaggactagattaacagaaacatatgataaataggtaggcaaatatatcatctaaaccagagcaatccaagacgtcgaatgtactgatgcagccttgaacgacgccgacgtagacgatacaattgcctggaccggcagaacattggacttatcccttcgccggagatcgaagacgatgcagccccgcgtcgggtgccaagtcccgccggatgataaaataaagtagaaaaggtaaaaggtggcgatgcgccgaattgtattgatcgtagcgatagattacatagaccccaggtgtacatatttatacccatgggttgatacaagtccttgtcggacaagaaagaaactaacctaaagataaaaggaaaatataaagtccttatcggacactaaacacactttcctaaagataaaaggaaactaacaaactattcctaattaatagataaactgccatgtcgcatcctctttaaactcggtcacttagggataagcttcctttagtagattgatttccttagccgaatatagcaggaatccgactattggcgacttgataactcccatcggctgattccgagatgctgcagccgataatgattctaagccgatgacgtctttgccgattaccaaatttcactgtcaacacaattaaataaaaacagagagtaacgttgagttctaaactgcttcttagatttgtttctccctcattttttgtgatcatgtttccctaattgttaaactatgtgttaaaaaattcaaacaatattattttttgattcgtattacttaattaattaagtggtaatggcttatctcgttttacgtgccactcaaaatctaaggtaagaagccttttcaaacgaagtctaagttacaagggccataacatatgaactgaggcctccaaaggtgccgttgacttgggaagcaaatcctctaacttatatccctataactttgagtctctgatataccagcccacttggtggagggttcacatgtcaatgactgacatcagagggaaataagttataggatctcaattcagttgacttgtattagttgtcccacatgtgattttctattactattattaattgctaatgaaaaataatctaccttaatctgatgtataatgttttgactctggtgatcactaaggactattaagaaacgaccttccttggggatgggttaaggaaactgtagcacttcagaaatgagcatgcgtatgctgagtttgcactacaataatagaacttaatacatcagactatcgatgaacttatgagaaatgtacttttgatctcagcaataactggtattgcgcgtcaacttcgactctttgagaatttttggtgtagaaatcatcctctagagtgctctggtggttctaccagccttgtcagcttgtctcttgttttgtatggcttctatcgcagcaaaacaccagtccactgtatgaacagatcaattcccaaaacaatgaaacaacgtaggagttcacttccatacctaattaaaggttatcgatctgactggtttttataagggtatttgggctacaatagtttggaggatatgaagttgcgagcaatcatgtgtgtgttgttactacaaaattgtaaactattggcagcttagctaatataatgctttcaaatctaggtggcttgcttcatgatacaaggaaattctccaatgtgaactgatattttagacgaacaattgcacgagcatgaatatcttctgtaatgttaaccgaagtctttggggccatccacatatcatgctatcagccattatacactacagttgatatgttcacttggtgagttggtgatatgttaagtcgttaaggattctatagttcagaaacaagcacatgcaatgattttgcagattacagagtaaattaatggatcgattagattactaacaaactattaggcaaatggatcaatttgactattgacgaactattagagaaggttaaagcaacaagtatttcagctcaaatccggcagtgctcctacaagccaggagatcatctactacaaattcatcatcaatattgttagatctggttactatgttggctttgttgcactgttgcagctggttttgcactcgatctcggtgccagagactgagcaagaagtgcagtaatcatgaatacaactaagcaaatgctgaaccattgtagcagttcacttcaccaagcctctcaaacctagaggggttcataaattaatggtttgttttcagttggatacatattggtttttttggagcataggaacccacaagaggcatgaaccagtggagcatatttatggtgggatttgctagtatttgttgttactgaagatttatttattgtctacagcaatataatgccgaagctaacacagagatgggcgtacatcaaattccagaccaaaaccctaattatgagttttttttactgtcctgcaggtccggtaccaaatcgtgaccgtttagggtgcataatccgatgatccagaaaagctggtacttggtggtaccactgctccgtccattaggtaccaggcatccgagtccgagtaccctaaaaagggcataatggtcttatcgtgtcaaaaagcttaacgcgtgagcaggtcttgcaccgacctcttcagcctttcttcttccttcccagtgcggccgcactcactagaagagctgtcgccgacagcaaggacaattggacaaggtaaagcaatgtgggagcaagaagaccagatctactcccctcaaaactagaggcactagatcaggtcgctccaacctcggggggaccagctttgccccccagtgatggaaggagctcgacctgccaatgaaatccttgccgaccactgccttccctgcactaggccaagctctttcttctcatcgtggttgtatggtcaccgcatcaccaagccactcttcctatggccagaggctggtggtgttgctcgtctggagacttgagtttgagggccttggcctcttctaccctgacggcgatagcctcagcctcagccacagcgagtaacgagcatagctagaggggcggtccagcaacggcaaatccccttcttcaccggtgacaagaagaccctcggcggctgtgcatatccatggcttcaccagcagcagctccaaagtccagcgttgtccctgtcctcaagatcagaggtcactaaacttcttgcaaagttctccagtttataaaacttcactgaatttctatgcatatgcagttatcttgtttatgtttagcgaagtttagagaatttaatggcatctcttatgcaaaagtcagagagctttcacaaaatttgaatcttatgtgtgttttgataccccacatagtgttccttgtttccctcaccctcaccacatcacaaggaatcctctcttccatgacaaccggtgatggacattctcgtacacgaagcgagtcagtgcagctggaggattcgctaggaaatcagggtttccgctctaggtggcggcggtttctgaacaagcagaaggatgaatgtggcagcaccgaggaacgatattggggcgtgtgcgaccaatttagtattggacgcaattttttactcattcccaatcctacccccaaaacatatggtaccaactgctggacggtaaaaaaatcttcctaattatacctttatgattacagttcagatggtgataagccatgaggtttttacttctgaaatctgcatctttcttaaggctgtgtgaactgtgtaaatccttggactttttaaacacacataaaaaaaactttttgctgtagatttagcccagtgttaacttgcatggtgatttgatttctgttctctggaattgtatcagctgagtgtagtctcccacttgtgatttttcctatattcattaactgctaataaaaagataacctaccttctgctagccattacacaccagcgatcacttgcgacaaccattaagaaatgaccctacttgcactacagcatttcagaaaatgagtatcactagtacagatcctctcatctgtgacggcccctcacatgcctgggcaacgtgggccgtcagaacaaagtcatcccaatcgggcctaaattaacaccgttgtagatgtactcgtccagacataatcgaggtgcatatacctatagcccgtcaccgatggcactcatcggtgacgggctcatagttaggcccgattgagattacacctatatctcaatcgggcccaactactaggcatgtcagcgatgagtgtcatcggtgatgggcagcaataaaggccgattgagataagttgaatgcccgtcacagacatcggtgacggtcttttatttatgcccgttagagatgaatgtgcgcttgttagagatctcgtttatttggcccgattgagatatattttgcacactataaatactccaccagtttgttgtctgtagttatcccactattcaatattcactattttggtgggaggttgaagggggcgaatttttgccattttttccaagaagaacatgaaaatcataaaagtaagtaaaatggtactgatcatttcttattaatttagtagtacttatcttataagatgttaactaatattttgtgtatttttcaacgatggatcgaagttggatgtatacgacttctttgaagcgtcagtataaagagtatagagatggcgtattaagttttatgaataacgcggaggaggataggagaagaagaaacaacaagttttatatatgctgatcttgggtttttggttgggtacattgaggtttttcttttctgatagaccataaagaaatgtcattacgaactgcagcatttccgaaaatgagcacgttgatcttgccactacagcactagaacctaatcaggaacagatcaaatttaagctgatgtggatgtctaaatttgctttgagagaggtgtacatatgttgaaaataaacgaactacagctaaaaaatatttttgatcaggttcctagcacccctctctcaacaagtagatccgcccttgaacctaatatataaaagactactgataaacatgttggatgaggtaaaagctagaaatgttctttgatcccatcaacaactggtattgcatctgaacttccacctgcctcgccatgcatgattgcaaaaagaccattgccaaattgtggcggaacaagtccccaaaaagtataagaatgtagcggttcacctctccgagcctcccagggctaaaattcctctggatcattttgttttggtgtactacatatggccattggggtacaatggctttgaggatataaagttgcaagggtcaggaaagagacaaagacatatatttatagtggaatttactagacctgctgttactacaaatttatttataggggagtgtatatagcgaaagctagtgtcgcaaaagaaaacggaggaaaagacttgtagaaaggacccttccaatgaaaaatatattattttagcaagtttgagaagtgtgctcaataaaaccaagggagtatctctaggacagcagcagtaatgaatgctgcctgtcctcctaagggcttccttcaagttgcagttggtttcttatgtgatttttatattattatggcattcatctattacaactttacatcaaaagtagccgacagattgtgaacggtgatggtagatcgtagagtttaagggaaagacaatagtatattatggatatcgacaaagtcagtggcatattgttgaactgtgacgaacttagtagtactaagtagattttctgagtggtctttcgttgttattccgtagggttatttttgttaaaaagaaaaagaaagtagttcatgtagatagaaattttttttaccatcgtcgggtttgtatgaatgtgttaacctaactagcaagattcaaaatgtgtaacgccttccacgcacatctgctatggtacaacttagattattttgaccagtaattgatcacttgtaaccaaagtatgcagatttttaatgatgattagaattgaccaggaatcgtgccaccatgatgcgagtcatcgtctctcatctaggtacaaacaagatccagcagtggcaccaacaccagcacgcatgaacgagtcccaattagaccggattaactcacccacaaaatactaggaagccctttccagtttttttataaaaatccacaaactttaactttaagtatcatatagaaaactttaaccttaggctgtgtcctttggacaactttcccaacttcactccctcattttccgggcgcacgcttttcaaactattaaacggtgtattttttgcaaaaaaaaaagtttctatagaaaagttgttgtaaaaaattatattaatttattttttttaagttttttaagctaatacttaactaatcatacactaataaggtatcttgatttccgtgtggaggaaattagttcccaacacaagcaaacaaacacatccaagacttggccctgtttggttccatgggctaattattagtctccaccttttagctatgaattagccccaaggatctaaacaggtgggctaatttggggctaaagtaaattcactactagaaaaacgatttttcatgacatttggaaaatatttttcatggcggctacaagaaaaaaccgctagcgtagaaaatcgggggggatcacgggcacattaagagatccaccatataaaatactatatttttcgatgtctaccagcgaaaatcagtatttttgctggcggctactaaacagatccgctagcaaaatgaaaaagattcaccagcgaaaagcaaacttcgctaaaaaattttcgcagtatttaaaacgcgcgctagccttcacccacccacccactgcatttatctctcatcttcccctcacctctcccagatctagccgagcctctccccttccctcccacctcacctctctcccctcccctcccacctcaccgcagcgacggcaggcagacctggcgggcggcgacgctcgggctcgggcgaggaggccggatccgcggggaggcggcgtcgccgggctgcgggaggccggatccgcgaggaggcgtcaccgcc

SEQ ID NO: 13770 - DNA, 8047 bp, Oryza sativa
gacgatgaccacgacgaccacgacgacaggcaaccggagggcctcctcctcctcccctcccctccctctccctctcccagatctagccggagggtggaggcggcagcgaccgccgcgacggcgatggtaggcgggcgacgacatgtattgctccattttgtttgtactgatgtttcatatatgcatgtattgatgtttgtttgttgagaatgaagtgagaaattgatgtagtgttctcttgatgttggatctgatgtggatttgaattgttatggatttgagatttggggatgtggatttgggaatgcaggtagcagcatggagtttttgctggcggctggaggccagctgcatatggtttttttttctcaaaccgattatcgctggcggccagtataacacagctaccagtgaaaatcgattatcgctggcggccgataaccgctagcgaagattgatattttctctggcctttgctttgtggcggctgcaatttccgccaggaaaaaccaaaaatggccgtcacgaaagatgattttcgtagtagtgattagctcccctcgaaacattagcccctctaagggatgataatggggctaattttttatggggaccatcgaaaagcagccctatctccccccatctctctcctctctcttcaccttttagccctcaattaactcatggatccaaatatatcattctaggctaatgtttagcctaccaattcaagactaaacattagctctcaaaattagcccggtgctaatcttctaaacagggccttaatatcgaaggtaccaaattttggtgtctcacaaattataatgtttggtgactcttagtacattttgaagaatggtaaaaagctgaaagaaagagagagaagattgctaaagtgttattctaaatctggaaaaaaaagtatgctatcatttttaagagaaacacatctaactctaacaacaagtaactcagccctaatctggcagcgctcctacaagccaggatatctgttattcaagagttggatgttgtctatgtcggctttactatgctagctgaatctggttttgcagcattcttgtcgttgacaaaagcgatgttagcactaatccaaacttgcatattgtttttagtcttgcatgagttgcatgtagataggcacgtgatatgtttatgttgatccactagatagatgcatatgtgtgtcatgtaaacaatggttagtccaagctttgcatgtagagttagttagtgctagtgattggaagatgcatgtgttgcagcataactagcaactgaacaagtctagggaataagaggattagtggcgaattagttagctgcatgcaagattagtggagcatgtttgtggcgtggtttagtcagctcggaggagcgattcttgcgcgtgagacgcatagatcgtgtgagtgagtggctcatggtcgtgcgggcgacccggtcgggctgttagctactccctccgtttcataatgtaagtcattctagcatttctcatattcatattgatattaatgaatctaaatataaatgtggaaaatgctagaatgacttatattgtgaaacggaggaagtagctatatgtgcatgtacgcgaggctacataagccgtgtaatcatcagtttgtaagtgagtgaagaaaagaaaaggcatttgttgccaagaaaaaacttgtgtgtgtgcttgtgcacttctgtgtgttcatccccagagagctattgtgtgtgtttgttgctccgtgagtgtgctgctcacgtgaatttgatccttggccaaagctaaaaagcgacaccctattgtggatgagccagtcagccaaaaatgcaccaaacttagcagccgctaagccaaaagatgcaatacagtagcagttcaattcctcaagcctcccaaacctaaaggggttaatgaatgattggtttttggttgcatacatggaattcttttaggataggaacctgcaagagacatgaaccagtggagcgtatttataatggggtttgctataccccgcaaaaaagaaaaaaagaggggggtgggggtttgctatagttttccttttgcaaagatgtgctaggatttatttattgcctagtaatatgaagcacaagctgacaccgagaagcacattcaaattcaaactccaaaaccctacttatacctttgctattaccctcaaggtccatgctgcagattcagccatttgttcacttgcatggtgatttgattttttttattattatttctctggcatagtggcattaacatcaataaaacaacaaatcctgctcaaagattggttcagctagcagtaggaggacatattaagatacagattttacctaggtttttgttagcacacttttcaaagtgttaaatagtatatttcgtgtgaaaactttctatataaaagttccttgaaaatatcaaataaattcacttttcatgtttgaaataattaaatctcaaataatcatacgttaataactttctcgttttgtgtggcatcccataatcttcatcttcattagacgggacggggtgaacaaaactagccacacaatgttgtcctcgaggtccattcagagtatatatagcataggcgtgtgatcaagcattttctaatcactctcttgagtactgactgacgaaccatgcatagagtacccaagaactgcacatccacggatgtactgaccacaaaacttgcatcatggcattaaataatttcacccgagacatggatatgctatagaaattatattcaattagatttcggatggtatcttaccataaattttgaaaagtgtgttccccgcaaaaaaaaattgaaaagtgtggtgcgttcccctagtactgaataacaaagcaccggtagtcactcccataatgcaactatacttacatatggaaacaacatattagtatctaccacataaccgaaaggtaattccagttgttggtaattcataattgtcgatagcaaaaatcacttcatgatctgtatgtttatatgatccagattattgatgaaatactcgatttcagattattgacaaactagttaggcgcacgctcaaaactcgatcagcaacacaaacaagtaattcacctcaaatccagcgttcatacaactaaaagccaggagatagatcatctgatatcatctactgctgattcatgatcatctatggcgttcgatacggtcactgtagaagctttcatgtactgcttctattttttccactactcttgtcattgccgatagtgatgccctattgtggacaaagcgagtgagcaggaatcttcacaccagctgagcaaatgatgcagctgaaatcttcgcagcagctaagcaagaaatgcaagatagtagcacctcacttccccaagcctcccaaacccaaaaagggttttatgaatggttgctccgttttcagttcgatatataggttttcgaggacaaacccatggattttaatttactgcagaaatcagcatcccttgcctaaggctgtgaactctctataaaaccaaagacatttgtaacacataaaagatccatgcagatgagccttggtcgctggcatggtgatttgatctctgttctgtggcaatggcatcaacatcaaaagaatgctgcccaaagattgaacatcgaactcaacagtactagtagccacaattcttgtccttgtggttcattcagattaaatgtatatgtgatgaagcatgttttaatcattcttcggtcttttgacttattaatgatacaatgaatacccttgaactgtacattcaaatgtgccccagggagaagtactgaaccactagacttgtatcatatgtagcagtaggacactggcattgtctcttggaaatttcaaggagatcataacattcaaagatttggggctgatggaagtgaaggagctagttgagaaggcctcaatcattttgaaacagtcactcacggaggagattgaggcaattattgagaagataaaggtagcattaatttggaagtcatttctttgcaagtgacaataaagcctcttaccaaagtatttagtatcaaatttggtggttagtgggctagaggctgcaacctaccaataagttcaacaatagtgtgattttctaagaaattattattatgtgattttggatgtggtatttgcataaatattgtgattacatgtagcattcttgttttttagtagatgataccccgcgcattggcgtgggatatttgaatcattgtggtagaacaaaggaatcacaatataagtttacaggactgtacaatcagaacaaaagggcaacttaataaaaacgtacatatgaatccaattcatgtaaagccatttctttataaaggaataaaatttagcttctacaattgatgtaaactataaacaatcaccatgaatcaaaaagaaatcttggtttatgttgttggtgattactccttgatgaacatattttatatgccaaatacattgaaatctcgaccgatactcgttatgcattacaatcaatcaccacataaaagaactcaaatcatatacttcaaatggaaaaaaaaaagctatactttgcaaggtagtccagtgaataattaaattgtagaaagaccaccaaattaattaaaatagctacggtgtaaaattaaaataccttttaacttacatggattgttggatggtgtgacgaaaaatccacactcggccgataataccggaactgtgttaacacgaactaagtcgacgaacacaacggcctaggagatctggttagttccaatgcaagcccaaaggttgatgagatgcgggcgtgctagtcagtttgatcctgcaactgacaagatatacaaataacaaatcaatgagccgatcggctgacaaaccgatggagtaattccaactgatgccgataccaaccaatagcgataggattttgagccatcggttatatgtccaatgtagataacgatataaatacaatcggctgatgataatgcaatacaacaataatataatccagtagaaatcaattggctaacaatatgatagaataagcactaatccgaaggttaaaacatacatcggctggaagtccgatgtcattaaatccaaacgattaaataaacagtgaaacctttgttgtgatcggctaaatccaacttgtatgtaatccttataagccgatgcaacgtccagataactcatcggctgaaacctcaatgaaacccttgttggcaatcaaaaagtaggctagcggttatggttctaagcacgactaggggtgatgcaacgcaaagtataaaaagaaacataatatctagacaatcaagcccttgattgattttcagggtggtagataccttagctaatctaatctggtaaagcaattcagccgataccggcagaaaccctaaaacgaatattagccgatacaagtaaattgaactaccaaactagattaactaagatatatgatagataggtgcttatattgacaagatcagagagtcgaagccctagccccgccgatgaaaatagccatgcatgacaaatataaactcgtcaaaaaagtagaaaagtaaaaaagggtggcaatgcgtcgaatttgtattgatcgttgagataaattagaatgatctcctggtgtacatatttatacccatgggtagatactagtcctttttagataagaaagaaactttcctaaagataaaagaaaaacataaagtccttatcggacactagaaactaacaaactctttctaattaatagataaattgtcatgttgcatcctccttgaacttggtctcttctggataatcttcctttaattgattaatttccttaactgaatatagcagaaatccgactatcggcaacttgataattcccatcggccgattccaggactctaaagccgatactgactctagaccgataatgacttcgaggcttaccaaatttcattgttaacagatggtcaaatatttcataaggtctcacaatgacagtgatcagtatcgaggtgattgaacaaacttagctgcatagtagcgatggaaacaaaacaacaatctaatatctgcatggcaacctgaaatagaaaaaaagaacagggagaactaacacaatgttgtgcatattagagagactcggataatattggaagataccttttgcatgccttgcactggacataggggaagctctaactggtagaaacaaattggcggatggaaaaaatgattccttcaaatcaatcgtatattggcatatctcctagaacaaaagagactgcaactgaacatgtggtgtgatcaatttgtttttatgggctggacggtgacttctgagctccttttgaggaaaattgtagtgcggtattatgtgcatacctattagtgtgcagcattagtggagtagtgttttacttcttgactccttgattattttgccattactaaacacatcaagcagcggcacctgtagaggaactgataaagacaggtaacaatttgttaggttgaagaaatcggtggcagcagtccgtctaatgaccgatagtgaatagagagtctaatctaacggttaaaacaattcgaatgatacggctgcacctcaaagcaagaaattgctattagctacactaagtgaggatgaactatataggattatatgattcgtgtgagatgtatgtgttacatatgatgatttgaccttcggagtactttgttgtaatcttgaatctatagcttccatgaacaacaagatactaattgcttgtgaatattttggattttttttcagattttgggccatattttgggagtgtttgttgaatttctatcgtcattttcatggtttctgattttaaaaacaatatttcattcgttttgtgattttttattctttacattaaattttttaatggtattactttgataaattgtaagtacaaatctaagccagtgatttgcttagccaaaaataacttgcttaattagcagggagacttgtggggggattgggtgagagtatagggatcaaccccatccccctggatggatctccctatgtgaatccatccatagtagcccaactaagccttgggttaacgccagaatatgcaatggaataccaaatagcaggtagagttgcttgtcattgttgcaatggtcttgtgagttgtggattgttatctgcgtaatgcacgtatacccaccgcgagttaaacttggatcaagctgacaagttgctccagcatcggtgataaatattctcgttctctctatgcatgtatacgccaataaaaagaaaatgcttaactcgatgagttggagcgtcccattcctgatacctcacatgcatatagcgtaacaacactgcaacagtaatccgctgatcttaatattggttattgcatgtggaggttatgaaaacgattcattgagaggtagagaattcgtaatttcagtagtagtatttacatttcaacattgccctggatttatatatagtggttttggaggcgatgtagcttacagtttctgtacgtacgtttttctgtttacttcacagaccatgggtgagtgccagaattcactattcttgtccctatctatatcatgcacatctgaataatcacatggcaatatataccgcaaaggtctgaacttggaggatgaatggtgaccggccttattaatgacgatataactaccacgaaaaaaatcgtagcatcaatgctaaaattgtggcaatagatacatgttgttacaatcttaaaatcgttgctagccgtggtaataggttattgcaataatttttatttagttgtaacaaattttgatattgccataaaatggatgtggcaaaagaatatattgcaacacttcacatcgttgcaatagataactattaccaccactccatgtatggcattagttctacataccaaactaaatatttcaatattaatttatcattctaaat

SEQ ID NO: 13771 - DNA, 5809 bp, Oryza sativa
atgaatttgagtatttaaaatatttcaaatgaaaaagtcaagttgtagagctctaaatttcatacaaaatttattataatccgtgtccatatgaaaagaataagtcaaattatgagatgataatttttttatttcaacgaatttgttgatcgtggcaacagaaaatagtgaaaagtaccatgtactatgtaaattgccacataaattaaaattgtggcgatagagtatgttttttgcaataataatgtttttgtggcgatagctcatttcctgttgcaacaaaaatattgaataaaacaatgattgtaaatcgttgcaccaaaatatagttatttgccataggaaaaatatcattgcgatagtataatatattgtcactaattattttttataataaattggtggcgatagctcaattatcttgtaaaaggtgactagtattgtccattagccagatcagcaaaagttcaccatagagccaagaaattaagcatccttgggtaaagatttgattggtgtgtgtcaatctatctatataactatataattagtgtaaagttaatggatacgatgtttaatatttgatgcggaaattaaacatcctatcatttaactttacactaattataaattttctataggatactcaaaatttgtagtatgtctttgttgttggatacctcaaaaatatgacacggtgggtaggacacccaaaaatatatagtaatttgttgagggggaacacggcaacaattatttttttttattttcgagtcaaatgaagagagacggcacgcgtaaaagatgattttgcccctcggactagcaggttgtaacacagctaggcccctactttccctccccaatcgatcccctctccaacacctagaaattgtaggctgcagcaacaatgtccatagcgatggccattacaagatgttggcctaagggaaaagttgtcttccaaatgtttgtcctctcgatttggctcgaaaatgataaaataattgttatgagtaaattgcacccacggtacaataacttgtcaggtaggtgcaatttggtgtaataatttaaaaaatgagcgttaagtgcaacaacttggcaagaaggcgcaatttagtataagaactttataagtaatcgtataaatgcaacaatttgtaaggtagatacgattttaatacaataaattaagaagttgtgtgacaacttaattatttggagcattttttatataaattcaaatttttaagtacttatttcgacaatatactagtgtggatttgtataaacatatttatatttttatcctaataactaataactgaaagtcaatcaaactggatgtagaaattattatatttcggttgatatttgaggagttgaagaaaacaaaaaattcttaaacgttactgaatgtaaattgtatgtgcaatataattctcaaagattaaattcaatattataaggctatgtattggcatattgacatcgggaaaacctcacctagcatatgtttagccaaattgatccaccaaaatactaaattgtcaagttcttgtattagaacgcacccacttgtcaagttgttgcactcagacgttcaattctcaagttcttgcactacatcgcacccacttgccaagttggtgtaccgtgggtgcaatttactctaattgttatggtatcccccagtagattactaggaacatgtcctatagccatgtcatattttttttaaggtgttcagcaataaagatcataaattgtaagtgttctatagcaaattttgtcctaattataatatgagagatactaagacttggtaggtaccaaatttagctctcacaaattataatttttggactcttactgtacgttttgtagtgccattaaaagctgaaagaaagggaaagaagattgctaaagtgatgttctagatttggaaaaagagatgctatcatttttaagagacatcatatgaagaacaaacatatctaacccctttacaacaagtaccttagccacaatatggcagcgctcctacaaaccatgagacttgtatgcattgtatctgcctatctggtattacggtgctcttctcatcgacacaagtgacaccctattatggacaaagcaaatcagcaaaaagaaatagcaccaaacttagcagccaacgagcaaaaaatgtaagttcaattccccaagcctcccaaacctaaagggtttacgaatggttggtttttagctggatacatgggttccttttagaaaggaacatgaaagagacatcaaccagtggagtgtatttatagcaagatttgctacaatttttcttttacaaaaatgtgcccggatttatttattggctagaaatataaagctgaagctgacacagagaatggcattcaaactccagaccaaaaccctagttatacctgtgctattgcagttaacatggttcctaggccatagggttttttactgcagaaatctgcatcgcttgagaattctataaaaccagagatattttgtaacacacaaaagggtccatgctgccagtttagccctttattcacttgcgcggtgatttgatctctgttctctggcatggtggcatcggcatccataaaaccacaactcctgctcaaagattggttcagctagcactagctaggacatcggctaatcattcttgagtctcgactaatgaaccatagagtacccaggatcggttgattgatgaaccatgcatagagcacccaagatcggcacatcaaatgtgctccatggatgtactaccacaatacttgcatcagatgtactagtagaacactggcataaataatttcaacagacatgaatacactatagaaattagattttatcagatttcggatggtatcttaccataaagtttgaaatataaaagtgtgatgcattcttccccagtacctgtataacagactgccggtaggcactcccatagtgcaactttacatacatacgaaactatgaaagcataggcattagtgtgtccagccacataactgaaaggtaattccagtcgctaaatacagaaattgtcgatagcaaaatcacttcatgaatgtattttacatggctgtcgtgcaacactgcattgacaaacctgcccatgcatatcaatgtccacagcaaaagacatcaacctcctctgcatcaggtaacaatgatcttggccttgtcagacaccctcggcagagccaatagcttcttaagaactttactgcccaatgaaaaagccctagtgcaatccacatttatcttcacttcctctaaaaccggtgcccagctcagtagctttcctacaaaatcaacttcgtagtccaaacccaggaagtcattcacgcttacagttacgaggtggtccatttgaagggttagatctgcaatgctcgtctgatcttgatcccacaagctcattggcccaaaatcattatcccatgggaaactctgcacaatcaatttttaatcaacgtatcaaatgtaaatagtaccaaaatttcagtcattcaaggagataaggatagagattgacgaatatataaaaggcatacccatagctcaagctttttgaggataggagcattctgaaacaatgacacggccggtcaggatttccctttggtcccagaagcatatctctaataacatcatctcgaggtgatcaaacacagcagggatcttcgtcattatgcacccttttgatagatactgcaaccagaaaaatgaatgatgagaaataccaacacagcataatcaggacaacatcatcataatgctgaaaataacaatgaatcaccgtcaagaaatagccgttgatgacaagtttttcgatgtcacttaggcttcccaatgcctgcttgaggtaacttttcccaccatgcacaactggaacagattggtattcttgagctttgtgcagagtgacatttgcagtctccagattaggggcatccaaatggaagtcttcatacttcccatcaacctctagaatttcaagttcaggagctcgaatgttcagacagctgatgccttcaaaggatttcaaaaccagcacagacaactcagggcagcaggaaatcagattatcaatgtcactgtctgtggaggagaaattttccaggtccaaagtagttaaccactcaaaacctttgaacatttggggcaaactgatgatgcagttctttatgtccagatgctccaaatcactgatggagaagaagcatgatggtatcctataccttgacgcagaggtcaatttgattgtaactgaatttggtgacttcattgacagcttgtgcatccacctaccaaatacgtcgtggtaatttttgctccctaaaattgtaatcccatgcagaggtcccctgtggagtgataacgccatatcgaccaatgtaataaacttgggtggtgcacttgttactgaaccttgacaggaagtgtaggtgcaatcacacagcaacatctctggaatagtagtccatgtgctcctccaaacgcttgacaggatgttagttctgacagcatcttgaacattcagacgagagaggatatcggcttttatctctagaggtagactgctcaatctgtctgacttcgcggcacgtctagacttcaccttggccttctttgagctacccattactttgaaaatgccctgtcgttaccagaaagcagcaaacttagatgggtatgcattccatcgccagcctcggaggaaaaataaataatagaaatcacaaaatatagtacagtgaagttgattgaggacagagtaaagtactgatgactagccagcattcagagaaacaagactggaaaatttttttaaccgaacttaacacgccgactcgtgggtccttctctgaaagcaactctaattgtcagttaaagtgtgtataaaccatctggtaaggaatcattatcaactatcagctgcagagatcaaacttgtgcacagctgcaagtatggaaccactggatcggtaagcatagcacagtttctgctgttgagatgaacccatcagaccaaggatcaagtggcacagcacatgtttggggtatcacatcaaatacatatgagaaaatcccttatgtacccatgaattttcgcccaatttcttctgtgcccctaaattttgtcttatcccctacgcacccttgagttttcatttttatccctgatatacccattccgtgagttgactgtcaattgactgttagatttttccaaaaatgtctacattacccttgtgtcttacttattgcttagtacagagtagttgattaaaaaaacatggctctcaaggtaaaagttgattcatttataaaaccaaacatgccataattacttaatctaaaacatagatttttaaataggtttcaaatcagatttgatgaaatttattgaaaattttcgctgaaatttaaataaaaaacagttttggtttttcgaattccgaataaaacattttttggatttcattatctttaaaaaaatgtttgaaaaattaattttgttttcgaaatccaatgttaataatcatgtccctttttttatttttaggttaagctttttttattaacaagacttatgtttttaaattagaaagcatgaagtacaagcgaagggcaatatagtcattttgggacaattctaacggtcaattcacagtcaactcacaacatgggtatagaagggatcaaaataaaaactcagggacatacagaggatgaggcaaaattcaagggcacgtga

SEQ ID NO: 13772 - DNA, 1609 bp, Oryza sativa
caaatgcatgagaatcaggaacggagttaaacaaaaaggggaagtctaaccctacatgaacaactctgcatcacaaatttcacccggtagcatttctttcttgcaagatccatcgaagaacggacaggttcttgattatggccacaacgacaagaaaactaaaacaaacccttcacagcccagcccccatggcgtctgaatcatcatcagcagatcgcatacgaaaattctctaaccaatcccagccaagaatcacacatctagaatgaactagcgtagaaaaggtgcaccatcatcatcatcatcagttcatcatcaccacacgaagtcacgaagaggagaaaggggtggttacctagaaggaataatcaatggaggatcggtgggtgaggcccttaccaggagagacgacgaagaggcaatgcgaggggcgcggccaagcgcagacggggagagggagggagggaggcggccggtcgtacggcgcgaggcggcgatcggtggcggcgacggcgaggttttcgcttccccctctccgccgagagaggatgagaggagagtgaagagaggctgggccggataggcgcattttgggcctcaattggatgggcccatatgtcggctttgattttttttttcaaacttatttttttggtttggttaagtttatagaaaatttgacaaaatctatatttcttttatttttcataatatttttgttttgtgctgaaaatattattatatttttctataaagtcggtcaaacttttaggaaaaagtgaaaatagtccctaatatgaaatggagggagtacaattataggccaaatttgggcccataaagtggtgggctgagatttcggtccatctaaaggaaggacacggatggacctccatcccagttaaaaggggccgactggacattgaccgtacgtccgtattgcagtcatgtgttagaatttgtttctcttttttttaagcaaaaacgaacaaggtttattatttttgtttcagaaaaagcaaaaaaaaagagaaaatttcataaaactacatgtattttgaataaattatcaaacaaactatatatttaacatgatgtatcacaaaactatagatttaacactaaaattattatagaactatagaatggaatatcacaaaactacgcatttagtaacacagttatcaccatattatagaatttaaatatcataaaactataaatttagttacaaagttaccataaaacttggacacctttaactctaacataacattattgattattgttaatgatttgaactcaaaaatatatagttttgtgataattttattattaaacatgtagttttgtgataaatttagtgttcaatctgtagttttgtgatatatcacattaaatctataattttgtaataatttgaccaaagcatatgtaattttgtggaaattataattaaaaaaagttcacaatcgctgccggctgccgctgtcatttttgcttgggatcacagctgcttcagatacacccacatctcaaatgcaaagcttcatcatcaaattaaagaaagaaaaaccttcgaagcatttcattctacaaacgttgggct

SEQ ID NO: 13773 - DNA, 8590 bp, Oryza sativa
ttttttaataactgtacctggaaagcgttgccgtctaaaagaaacaaacacagaaagcatgtcacccatgtcatgtcatgtggtggttcattatccgcaatcgcctcttgtacatatgtcacgtgcataccaccaatcaatgacaccaacgcatcaaagaccacagacaataatcacactgctgttttttttatgtgcatatcctggttgaccgggaaaattttgttccatcttgacacataagtaaattctcttcttaaggatatagaagggtaaactcactgttatcaaagaaaatagtgcttgagaatctatgcaacataatagcccaccaccaatcacttttgcacgttctacagattaatccctgatattttttatatcatgcgatagtcatgtgtttgtttgaatcaagtaaataacatatatttaaataaacataggcattttaccgatagcaaagcatgggtatttcgctagcattcaagaagaagagaaacttggaaagttaagccatcatgaactaggaaggataatgtgctagagccaacagttcaacacttgattgaactaactgagccaagggaaagaaatagtttgtcactctaatcacaccaataatttttatacatgagaaaatggccgagttaaattatttaatacaccaccaaattacctcactatatgctcctttagctacaacactgtcctccaactttgatcttctcccgtttaccatatactcacaaatcactgaaagctagtataaaaatacacttgcagagaagaaacctgggatggaaacaatatgcatattattgggactaaaattgcatcttggagttgaatttacccgctgggtgccgcaattactatttcttccatactcttctggaacattatttctgtaggttttaagcacccacgaatgtactcctgcccaagttgtgcgcgctcgttgtccccaaacccaaatacaatgcctctgtttgtcactgcaacagtgtggtacaggccagtgctaatttgtgaaacatagtgatcacgcagactatcgaggactcgaggcctcattactttgtcggatgatcctcggtcaggaaaccctaaactcccaaagcccatccatccgaatgcaaaaactgagccctcatcagtaagaacaaatgtctttcttttccttgcacagacctgtcaaaattaaaggaacatacttaagcctttatacatgaaactactactagttctgtttcaagatatgattgttattagaacaagaaactcctatatcatattagcatgtagcaatgcataacttttgttttaaatacgaaaaccatagcaatgccctatttcttgctacataaagtatattacctcagcctaatctacatgattgatgatagtttaaaccaggtttattcttcgatgcttaatgaagtaagaaggaaaatggtgcaaacatatggaacacacctgcacagcaacttgactcttcaaactgctgatcaattctgggctagttttgtcattctcatcaccatggcctaatgctccacagtaacctctgccccatgtataaacctaaaattttcaaaccttaacttctgtctgaagatacataacaatcaaaacatacaacagatagttccttgaacagtgtatacttacataacccagtgcatcaagagctacagcatgctcatcaccagcagacacgcgaaccacatgaatattcctcctcttgaatgactggattgcacgtggacgaagttcatcatgctgatctccatgtccaaggcagaagttggtacaagagccaaaggaataaactgttccatcatccgttacagcaaatgtatagctggcaccagcagcaacctgcactaccggagcaaggccttcaaataattcaacgatctttggagtagccctgtctattgtgtcaccatgaccaagctggccatgtgtgttacttccacatgtatatacttgcccatccgttgtaagaatgacagtaaaacttaaaccagtggcaacctgcaaaaaggggaatagatagaattaagaaaaagaggaagagttttgcagacttgactagaccagacatatgaaacaactacctataaggctataacagccttattgtctattaacaaatttagttacaaaaagtagggtcttccctccattttatatcaacaaataaataaatttgaccacaaaactaaaacatcgttcctgttgcatcaaataactagagcattgttctgtttttacaaaatgaaatataataattgaaagaggcatttattccattgtaggagatatggaacataaaaggataataaagatgattgggtccacctgtttgcaagaaattccttttagggcctttatttcggttggtcgaaatatagttcgccccacctcaccgtgaccacagcataatgatgaattatctccacaagtgaagacctatttgaacaaaattcacagcgttcaaagtattagaaatattacaattgacaatatacagtgtttaagatgagcatcaattacctcccctaactctgtgacaaaagctgcatggttgtgagaggcagagatgttgacaacacgagaaagtgatgggaagggaaccctgctgaatgccgcacactgggttgtatctgggccatgacctagcaccccacacaaactggatccacaagaatagacagaagagtcatggaccaaaagtgtgtgatatcttcctgtcgctacttgcatctggaaacatacagcatgttcacatatataagaaaccaggttggaaatgtcttctaacattaaaaagaaaatctaactttccagtttcatactaaagatagaattgttcatgagggaaactattcccaagtgcaacaatgcaacttttgttgatcatttggtcttcatattggcaagcatagcagaatggcaataagtaacatgtccaacatagagcatactctcaaactggtagagcagatgagctaggatgttaataaaagaaaaaaaatctagaataaaagtaaattaggcaccctccagaacaatctgatgcagtaggcacgccaaataattatgcgccatatatttttaaaatgtctgacttgaaattcaatcagtgtaagaaaaacaactaagatatgatggattcaaagcaactgaggcatcagcaacatattcccattcagccaagtgtgtcgtatctaaaagaaaatgaaaaaacacaaggtaccatatgtttattataaatcatttccaatgtccacatatcctcctcattcagaagcatgccaacttacaaatcaataaatcatagaattgttagtaattttgttcatcaggaatgagctggtcaacctctcttaattctataacaagcaaaaaaaaaaagaaaaagctcacaatagactacaaacgcatgccttaacttggtgttaagatgtttcattgtccctagtgtaatccaaatgtggatatccgattcctatcacgaagtttccgaattcacaaagtcatgcatgcatgatcaaacatggatccctaaaacgggcaaaggtgtgaggcaagcacaatcatctctaccaggctatcctacaccacacaaagtcaaactaaggttgcatttactagtatctcagaattcagatgcgaagcaaagaaatcctcacgttgccggaggaggtgtggacggtgccggaggactgctcgacggactgcaggaacctgagcaccttcttccagctgccgccgcaccgctccaggagctccccgcgcgcggcggggcccatggccgcgaacgccgcccgcgcggcgcagagcctggaggcggcgtgctcggcgagcgggcggagcgcgcggcacgtggcctcgagccgcgcgaggtccccggcggcgaggcggccggaggtcaggacctccccgatgaggtggccggggagctcctccatcgagaaagcccgcggcgccttctcccccgtcgccatggatccacccctcccgccgcgatccccgcctccgcccgacgaaatcttggcggccttgcccctggatcgatcggaatcatccaaggacgacgccgaccccgacgccgccgtacggatcgaaatggcgacgaactccgcggcgagctccccccctcccctccggcggatcaaatcgaatcgaatccaatcgaatcgaatcaatcgctcaccaaatcccgccaagaaacactaatccagcagcagagcagagcgaggaattgggggagtaaatccggggtgcgatttgagggcgggggaagcggagaagaatccctccaaatccgaaaatccgcgaggatttatacgctctcgcgcaagcgcatcaacgcacgaacacgagcacgaaccgaaaggaggacgaaaaataaaaataaaaaataaaaaagaagaggaggagcaggagaaattttcttcacgcaagtaaagactaaagaggggctccggaaataaaaaaaaatgcttggatccagaggctcctccactagtagctggcgccgtcacccactgaccagtgggcccagcggcaggtggcctcacctgtcagaagtcacactcacccggtggtggcacgtggcctcgcggtgactgacgaggtggggacagtggagggtggggccggggggtcagtggggttggagggtgcgcgcgggggaaagaaggttcgagatcccggggggaggaggagaggaagaggacgtggcgggcactatcgcctacaggggtgacgtgtcaagccgggattgggcgcgagttggcgatggggacccggcacggtggcacggccaggcgatcggtttcctcggcaactcggcgccacggctggacaaggcgcaggcagcgacaggcgaggggcaatgcaaatggcatggtggggttgcaaattgcaattttgcattattagcggagcaaaagcaccaacggctcgttgattttgttcgctcccatctaatcacattattttttcgtccccagcccgggtggtgttcggtcacaggagtttttgtccaatcccttgtcaacatagtgtggttacagctcgagacttttattgtgctgtgattctttcttttcttattacattatttccgttacacggcggacacaccattatacgtgaaacatgatacacaccactgcgcatgcaacaccacgctcacacttccacgagtgcgtctcttcacacacgctcagagagataaaaactggctgtatatttatgatcacactaaatcctattgatatttacttacgtacgcgtaatatttatgggtagcaagatttgaaccctaatgggtaaagtcatgcactcactaatgactctatcaccaccccgtgctttccttactgtgtagtgattctcgtggcatcatgtctcgatgtttttatgtttatacttggagcacatcctttagtgacataaccttttattgcacactccaccgaaaaccaactatcacatgttcattcttttcaaacactagcgaagtgacaattctttcgtgataggtgatacccctcgagaatcataccatggtccattcttgatgctaccaccaataaattatgagagaatttcttttatgtccaagtcttcgctgctcataatatttctatcaccattatacttacaagagtgaggaagagatgcgggcgacggcggcacgagaggaagacaaaggcggaggcgaaggcggcgatgcgaggcagaggtgacggcgtgagaagaaagcggatacgacagcggcggcgagagaggtaaagggcgagatgacatggaagaggggatgcgggcggcggtggcgcgaggggaagacgaaggcggacgcggaggcggagacggcggcgcgaaacgatactgacggcaccagacagaggtggcggcacgagaggaaagcaaaggcggcggcggcaagagagggagagagcaagagacaacggctagggttttggatctgtgagagccactttgcgaaaaaaaaaccttcagttttgacaattttaagcacagcccttattcacttttttctcttcttcgtgacgaatatctggtttatgtaagggcttaaacgtaaaatatcagttcaaagactgtttgggagggacttagatcgaattaaactcaaactaaagggttttttcgtaaaacttcaagcgcgtactgttcctatcctacgtggatactggatagcgcgtctgcgcgcctaaccggacagccttgaagagtaaattttcatatatttttttttacccacgagtctcaaaatgccctctcgcttgtgaataagtgttgccataaaaatcatgatcctcaaagtgaaaacgagttcaacttaaaattatttgacccttaatttaaggaaaaaccagttcgaaaagcattaaaagttccctttttgattttatagtaccagaagttctcaactcaggggcaacccacattgaaggtatatacaatggtacaacctagtataggctcctaattaaaacacattagttatagattggcttttgagacaacatagcctgcacaaaaaaaaattacttttctttcctcttctctacctccatggaacaaaatttccttcattcaatgttaagagtcgatcttgagttgagttggtgtcatgcgtatgaaagggtcaattaggcctagaggggggtaaataggctaatttacaacttaagaaatgcggaagcagtaattttcagaactaggctgggaattttcggaacttccgaaaggattttcggaacttccgaaaatgcacagagcaatgcacacaaaagaaaaatctagatctagaagtctattacagggaatacaaggcacaatcagcaactagaccaatagtggcacaagcaagcaaagctagaggagagggataaagaaatatcaccaagatgtagctcccaaagttgttcccggagttcaaatccttgaggggattctactctccgttgaggagctcactaagagccgggtctttgctaaccctttcctcaagaggttgtactaagtactcctccttccactaagaggtatatcttcccttgcggaggcgagatccggccttcacaaacttctcccggccaaccacaggtagatcggtggctcgggagtgacacctagccgtctaggagtcctcaacctccaagagtaaaagatgatgtaaagaactcccggagatgatgcaagtgctcacaaatcttcacaaagaccacaagtagcatccacacaaactcgaatccacactctcacacacacacaccaaatctgaatcaaacacgagtggagagatgaatcgaggaagcaaggctcaaatgaactagagaaagagagcaagcaaagggcacaaataattggaatagaaccagcagccctcacaagtgaggggaggtgggtatttatacccacagcacaaatctgcccattggagtgcaataaaagtaattttcggaacttccgaaacaattttcggaacttccgaaaattccagatctgagaaaaaaatcgaagtcaacgcaatttttggaacttccgaaaaacattttcggaacttccgaaaatttccagaacgcttctgtgtattttcggaacttccaaaaatttccagagagctctcaaacggttctgtgtattttcggaacttccgaaaatttccagaacgctcaaaaacggttatgtgtattttcggaacttccgaaaattcttttcggaacttccaaaaattttcagaacgctccaaaagagaaatgcttcgaagaaaaattgattttgagcacacgcgtcactccttatatgtctatgcatcatcctccttaatagtacagctttcctacgacacaatgcgaggaaaaagatacaatatactatttgatcattgccgcattgcatcgcgatgtcgcattcacgggatatgcattgtattacaacacgttgaggacttaacaaacttcacatttgcttgaataaaaatgttagtcctctctaattgtattgtaatcaatcatcaaaatcattaggggcctagatgcactttcagcgtagcaacaatgtttctctttctcctatctctctctttcatgttaccaaatttacttagatggcaacaaagagagcccgctaataaagatcgttgtatatgatgaaagtgaatgacttacaacaataggatgctcctgtcatcaagttcatcaagcgccgcccttgagcctatctggcggttgcctatgcaccgtcacaataccataacttcgcctatgaaacttgacgaaaaatgttgttccaatacatatcttgctggctagctaaccaatcttgattttatgtataaaaatgtgcacatgcaaattcaaaatgacaattaagtgttttaagaaaaacgaggtgattttaacgtatgattaattgaattttaattattacaaacttgaaaaatagattaatatgatattttagagtaacttttatattaaaagttttcgcacgaaacacaccgtttagcagtttaaaaagcgtgccacgagtatccaaa

SEQ ID NO: 13774 - DNA, 7216 bp, Oryza sativa
  unsure (1)..(7216): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgctcggcaaaacttgaaggaactcatgggcttgcaatacccatggtgcagagaaatcatcgcacaattctatgccacagtttactttgagcccaacaaagaaaagactattcattggatgacagatggcatcatatactcagtgacatatgccaagtttgctgccattttggggtttccggctcgctctcgcaccaatcgtgtcaagattcatgatgagaagcccatggacacaaattctcttcacttcttgtaccaagatgtggactatgagttaggcaccatcaaaggtcttcttcccttctatgcctatctcaacaagctcttgcgcaaaactctcaatcccaaggaaggtgatgctagcaacgtccttgcctatacaagtaatttgctttacaagataaaggctcacccacagctctttgactcctttgacttcatctttgaagaaatccggcttatctccatgatgcctaagcgaggacttggctatgggccttacattatgaagatgattgagattgtgtccaagaagaagtttcacaaggaggtggcacataccggttaccaactccgtcccatcaaggctgctgctgtgccggctggatgaaccactcgtgcttcttctcgtgccggtccctccgctaccgtcaccaagccggactccaactcgtccttgcggttcttcaagtccatcttcaacttatgcaagaccatctcagttcggcaagccaaggaacgtagagcaaggaagaaggacactcgacggatcaagaacctccttcgcaacgcccatttgccgtgttctcccgatggttctgaggttgaggacagtggggaggatgtgattgaggacccttttgcagctgaggcaagctcctctcgtgcggatcatggcaaggctcctatggaggaagaagaagaggaggaggaaggtgactatgctgaggagtcaagtgaggagggcgaggattctgatgaggatgagtgatcctcttttttcccttttggtgccttgatgccaaagggggagaaccacctatgaacaaaaatctctaatctatctcctttcgtgatgactagtcgaaccttgggcttttgtgtcttgttaagtgcaattatctattatccatgctcaaatgtgtgaaatatcttgtcattggcatatgcatgaggttatattgtcatttctaatctaatgcatagattgagggggagctctcctatttcatttctagcatatctttagggggagctccactaaaatcctaatcttttattacttctaagtgtgttgtcatcaatcaccaaaaagggggagattgaaagtgcatctaggacccctcatttattttggtgttaatgacaacacaattagagggtaactaatgctttttgttgagatgtatgcaaggatgaaaaaggagtggatgtcaacacaataagtattgcggcatcttttgtggtaattgtcttctaatccatgtatatcttgtgttcttgagtattaggatgccgtactattaagagggatgccacatgcatataattgatagaacactagtgctcaaaatcatttatttgaagtgttcatgttttatgtctgtcggactatccgatgttgatcagactatccgatgctcagactatccgaaatttcacagaactttgctcactgtcttgggtctgagtgttggctaaaaaatatcggactatccgatataaggtcggactatccgatacgtcggactatctgaaatttctcagaacttcactctttgttttgaattgctttttattccttttgagtgagttttaaatcagactatccgatgtgatcggagtatccgatgatccagagactccgaaattcaatggaacttgagtctctgtgagaggatgaaattcttggttcaaaaataacggaatatccgatatgacatcggactatccgatcgatcggattgtccgaaattctccagaatttcgttctctgtctctggcctgcttgggggtcaaaaacatcggactatccgatgtcacctcggactttccgaggtgggatgaaaagattctctcccaacggccacattttgggggcttctataaataccccccacctaacccttttctagggttacccaactcattcattcacattcactttgggttgagcttggtgctaaggtggtttagatctttgagctctctctccctctctcaaatcccctcttgttctttgtgtggtggatcttggtggttgtggatttggggtttgagggcctagtgtgtgtttcactcgatcttgagcactagggttgaccaagagttgtgtggtgtttgttactcttggaggttgaggactcctagacggctaggtgtcactcccgagccaccgatctacgtgtggttggccgggagaagtttgtgaaggccggatctcgcctccacaaggaaagagataccccttagtggaaggaggagtgcttagtgcaacctcttgaggaaagggttagcaaagacccggctcttagtgagctcctcaacggagagtagaatcctctcaaggatttgaactccgggaacaactcggtgaacttcattgttggtgatatctcttctctcattatttagatttgttttttgtgccgctatagatctagtcgctgtttgcgccatactcttgtttgtgcactagatctacttgtagtgttcttttagtggatcagacagtctgatccaacatcagactatctgatattttcggatagtccgactgtggatcagactttccgaccctaactcagttttagcttccacataaagttttaaattagcctattcacccccctctaggcctaattgaccctttcaaagaggatataaagatgacttgaaaaaaaaattgaagtgctcagagggatttgaagaggtaacttagacttctagatgaatattctacgaaaatatattttttcgtgcagccacttaagagacccgtgtagaaaaatagctctattttttagtatggcttcttaagagggccgtccgccacgagtgaaggtcccactcaccagcatgcgctgaggagataatgggccgctagtggccctgtcctcaagtagctacacacccacaaaacgagggcgtgagggtgttgaggcagtcgacgggtggctctcgaggctgaccaagacatccgcgggtgcagttagccatgaccaaatgatgggttgagcccaccagctccacaatctaggtgagccaccaaccctctagagtctcaccggtagctgactgaggtgggtgccagaggagctcttatgttgcaagcaacgtgctccccgggtcgtttgcatcgattggaagggcaccatgtttgcatcgctcgcgatcctgccccgacattcgttagctatagacacagctaactcacaccggggtattatgtattagctgtgatatagtaccagttctaggatatactagctggtacacacagaataaatatggaatcaaagtaaactgctttattacatcactaggtagtagtccttacataagttgccatcatggacaggcccatagatgaacaacacaacattatagaaagccataaaagcgacagcgcagaagcgaacagcgtggagaactaagcgactaagcaactatgcactaggcaaagaacctaggcactaacttattccacagtcgaggcttagggctaggcacgaaacatctagaagtcttcatactcggcttgctcctggagatattcctcggcggtcgggtcgacgtcttcatcttcatactctatagattattataaggagcaagggtgagtacttaacgtactcaacaataagccaggggaaagaatgacatgtttggtgatgtgcactagggttccaaatcttccgaaaggttctgataaacaacgatttgggcggagtcacgacacaaatcgatccggcttcttgaacacacacgctcttgagccccgcaatcgcagcaccacgtctcctctggttatcacccgtgtcaaaatgcggatgacctcgccgagaaggctaatccctgtttgccaatcgaagaacacaagcaagaacgagatagaaaacaaccaaaattgtagatgaatgattaagctcacgaattggggtctaacaaaccgatctagcggcgaaactgttctcgatagattaatctaagcaaacccgaccctaaacaatggcggctactgaataaatgtgattagaaacgtcctagggttgccctagggcgcacactcccttgggctaagcccacgacacaattacaaggcccaaaactcaaatcagattcggattggatgagttacgtggcttgttttgcagattcccggcagctcggtaggaattttgatgtgggaccaaaaccatctgaaagtagacttcataagctttccaacaagtacttatgggccctgaaattacttctagatcagcggctaggtctgtttgaagttgatgctgtcaggaggcccgaatccgaatccaaaacatgtagaatttcatctcttgtcttatatggaccaaaagtgacgtggtgagatcaaagaagacttggagaaggtcttgatttggtccccaatcaacttcttcaatcatccatccaattccttacgctcggtctcttttctttcgcccaagcaagtaactctgcaaacgaaaacacacaaaactcattgtgtagcaacgtatgttcaaatatataacaagtaaatctaatatagaacatatgcacctttggttgattaatacataaggtagttatggttatatccgagctagttgtgtcctcatcatttggtttaaacaaggaggcaaaggttttatttgcgaaagctgcctctttggcaaagtgatttatttcacaaaaactcctagtgagtgagtcaagttttagttgtcgggaggaggctcatgcctcgacccattccacaagttgctttgcaacaacttgtcacgattatcgaacaacaattaatttgtttcctctattagttccttttcacaacaacacagttcacacatatatctcagcacaacaacgccatcatggccctaacaacacctcggcgtcggatgacaccccaggtcacacagacccgttcctaaccataaaggttagccatctgccacacaggcggactttagaaacgttacccttcccaataaccacttcttcacaaacatttgtcaaacaaatctacgctatgagaaacaccttacacccgcccttgaccgtgggcacggctcttcgaacagttcaataatctctgcagaggttgcacgctttatccacacgacatgaaacttacaccgtttacccgtcggtaacggaagttcgtgataaggcctttccaaggctaacccatgaaaatcgcatgagtatcaggcaaggacagccgtcatccactcaggaaataccgaggatgtctcctacagatatcgcacgccacaatagaggcaaaaagacacccatgatgggccaaaatgtgtaaaacttcgtctcctcatcctcggcattccacaaccattggcacaccaactcccatgtgataacaatttacatagccagagacatcccataaatacccgtgcgatcacactgtaatgtgtttggatggatttcccaaaggaatcggtccttaacaacaatacgtggccaaaccacaaaggcatgactccgcatcaccaccactttcacaacacattttatttcacaacacctcagttgtaccggatttttaagcaagtaatttggaataacccaagtttcccacacggcaaacaacgtaagcatggctaagcgaaactatctcggtaatcatataatgttaccgctgcaaacatttgtggagctatcaaaggtatggaaacatcaacctatgtaatataagtgcgactactaggtcggtccgtcggatgtataaacaatccgagggctaaacatattattcgtgtatactaaataatgcacttttcaaacaacatatctttgcaaatataggggcaatgtgatcaaagaggcttgccttgcacagggttggggtcttctccctcgaaagcgatgtccagagcttcctcgtactcgggctctaaacgcgaaaacaaaactaattaacaaaaggcaattaaaacaggctcaaatcagagaaacaatagagccactgtgtagatatcaatctactactaattaaaaaaaaaataagagatgcttccttcgtccatcacaaataaaaaaatagcgaagaaaagaagaagtccgattccccttaaaaggaaaaacaaaaaaatcggagaaaaaatagccaaaaaaacaaaaaaaaatccgattcgaaaaaaaaaaagaaaaagtagccaaaaaaatgatccgatcccttaaaacgggaaaaaaaatcctattccggcccacgcacggtttttctgtttttttttaatttttcgtttctttcagttttttctttccttttattttgtttttgttggtttttttatttcttaatatataaactttgtaaacatctctttctctactcccgtccctacttaaaaaattcacatctaaaaaggtccgttcgattccctaagaaagtggcaaaaaaagggttagtctactacttttaaaaaaataagaggcgcttccatcgtccgtaaaaaaaccgacggaaaaaacctagtgaaaaaagtccgatcaaaaaaactgggcaaaaaaaaccgtaagaggtgcttccatcgtccgtaaaaaactcagcggaaaaaaccgggcaaaaaaagtccgatcaaaacaaactaggcgaaaaaaacaaatctgtccgataaaaaaaaggggccaaaaaagggaaaagtaaatcgaaactaatccgnnnnnnnnnnnnnnnnnnnnaaagggcgattttttttaaaaaaaattgtccgattccatagaaaaaggaattatatgtgacgcagtaaaaaaaatagaccagacgaaaaaaaccgagcaaaaaaaccgggcgaaaaaactgggcgaaaa

SEQ ID NO: 13775 - DNA, 2055 bp, Oryza sativa
aaaaattaaatccatccatgctttatatttaggaaattttatttcccacatttaacttcacttgtaaattaatgaacatttaatataaattctattaatgaattattaaataatttataaatcctgaaacgaaaatcaggatgtgacaaactaccccccttacaaagaatctcgtcccgagattcggaacggctagaaagaaaagggcataggtaaactgcagtctatcttattccataactccgataattattctaaggctttaaagaaaactactgctgctttgaaactggtggctgagctgtaacacttgaaaacgcaactcttgaagacgcaactggcactgcatttgatctcaccaccgatgtttaactgttaagactgtccttgaccagcggaagaagattcaccaatttggagtggcttgatacgctgcctctggctactaccttgtgcctcctggaatacagtcattttccttttacggttatccatcctgttcttcttgtcttcaagtcgagttgctttgtcaaccaactgctgaaaatcagcatagtcatgagagatcaacgtaactgacagttcatcctttaagccttccaagaacttctcctgcctttcctcgtcagtacgcacatcttctggagcataacgtgccagacgattgaactcatgaagatactctgccacggtttgatccttttgcttcaatgccctgaactcacgcttcttcaaagaaacaactcctgtaggtatgtgtgtcttcttgaatgcttccgtgaagtccgcccaagtgattggttgtccttctgctctgttcatccggaattgatcccaccattctgaagcagatcattgcaactgatgtgaagcgaaaacaactttctcctgatccgtgcactggagcagttccaacttcttctcaacagcgtgcaaccaatcacctgcttccactgggttggtagtgctagaaaaggtaggtggcttcacacgaagaaaatcagttaacttgttctgcggcggtggagcattgttgttcccttggttgagctggttctgcatttgctgtatcatcatattcattaactgagtctgttgagccagaacttgagcaagagttgggttcccttcattgttattgtttccacttccactggcgcgagtgttcaccatctgttgcagattagagaagataggaggagagaggttacactaaagataagaccttaaccaggttaacactgatctgatgtgtgtagaccaatatattgttcaagttgattaagcaagcaacctaatatagttacacactcatcattgaatcacaccaatgacgggaatgcaaccatacctacacacaagcaagcaacaaacgttctatcctactaactattcttcaaagacactttggcggcataggttctaaggtaggatccaaacttcattccatcttgaccacttggcacttcggttcttcctcgatccacttgactgacctccataagtagacctcattaacatcttctagtttcaacaactagttttagaactactcaagttgaaagcaggaggggagaggatgataaaatgatttatagagaattctagagaaggaagaaaggaaaattttcacaaatcatgttttcgaaaaatttgtccttaaggtttgaccatttggcttatcctacagtcgagatggctctgataccaacttgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcactaagtcctcaccaagaagaaaactgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtg

SEQ ID NO: 13776 - DNA, 33964 bp, Oryza sativa
tccgactcagataacgcagttaaaaaaactgtgtgattctaaagaaaaaggaattatatgtgaggtagtaaaaaaaatcaaatcctattatatctagaaaggtccgtcactataagaaagtggcgaaaaaaaccattcgtaaaaaaaatgcacgagaaacaaataaaaagggcagaaagaagcatggcagaaaaaaaaaatctaatttctattcgtctttttagtagtccgtttatatctcttctatatctctaatctaaataatctaactattttaaaacataactttctaccttatattaaaaaagaaaaaaatacgtgagaaaatagaacggtttaaaaacgcgtgaggaaaaaatatcagaaaaaagcgcaaaagaaaacgcgctagaaaaaaagttccgtagtccataaaaaaaacacgcgagaaaaaatatttacatcgtatgtaaaaaaaagcataaaaaaaggcatacgaggaaaaaactgttagaaaaaacactaaattgatggacacttggtcggataggatccatcaatttttttccatctcctacacgacttgtgtttcgtcatcttttctcatgtattggacacgctgcacatctttgtaggcaattatcagactatttttgtgaagtgtagctattattcttgataacatattatatgaaaataatattagtaaataaacatattttaattgttatttagagaagagtgtacaatgactctattttgtgtagacttgaccatacgaggtagggtcggatttgattggttgcaagaatgggattaaaagaatattttagattatatgcatgttgccttatgaataattcaattattttaggtaaagcaaacatcgtaaggttgccaccatcgaggttgggccattacatttaagatgttctaattttctgattggcatcgacatggttatgcataaaaaacgtatattatcattatgtttttttcacccgttgcaaacacacgagcgtgtttgctagttttagaaaaatttagggacttgaacagggtcaatcggagttacggttgaatttctaggaattttcaaaggataaattgattttctggaatattggaaattgattaataacggaaaggaatattccattggaatattccgctaacttggatggcaatggggggcccacctgtcagcgacttgatggagggagagaggcacgggccctgcttgtcagcggcttgagggaggaaagggaggtggggccggcttggcagtggctcggcacggtttcttcttcctcctctcgctcctgctcgatcccaggcagcgtcgcagcgatgtgccgcggcggcgaggttcggctcggtgaccggcggccggggaggcggcggcaacctccggcggagctccggcgaggcaccgccgacgacggcggccctagaaggcgcggcacagcggctataggtggcggtacagagagcaaaatgaaagagagaaagaggagagagagagatggcaacggtgatggcaaggaaggggctcgggttcccctttaggccttgttcggttgggttgttcccggccgggatcggggcccaatccccatggatcaccccggcgaggaaaaaatcccggcccatgcgaaattgtgcgttcggttaagccctaccgtgaattttagcccagcccaccacggggtttccctcttctctaggcccgggaaaaaatcatctactcctggagcgtggaaaatttcctcgagtggaggcggcggcgcaacgaagacgtgacggagggggcagcgcgcggcgcgacccggaggcgacggcgacggcgacggcgacgacacggctctctcctccggccgccaccttgtctccagtgagcacgctgcctttccccttcttccctcctcttgcaaagctagggttagggttttcttctcttctccctttcctgtcgtcgccgccatctctcttctcgccgtgtagctttctggtgagtgagcgcttagcgattcgtcgtcctcctcctcgtatcctgctcgatctggtgagttcttgatttgggcgtggagctttttttcttggttgggtggggatgagttcttgatttgccgccgccaccgcaccgcccaactctggttcttgatttgagttcttgattcacggtggctttgaggcagcagatggtgagagcgagagctgtacggtggctatggaaacatgcttgccttgattagttttgcttagtgtgactgatgctgtgatgcttgcctgagcatgtcttgtaaaattgactatacaagtttttacagtgaagtactcagttcttggtgcttccggagtcccaacttgtggttgttggttatatttctgtttggaaattacaagggttgggtgtcctgattttgaggattgtagagctatggaggtactctgtaattagtttaacatttctgaattgtaaactaattctatcgtcattgtttcacaaacaaactagcaacaaattgctgcagtatatacagtaatgtatacttaaactgatttattttaaactaacaacagtagcttttagtctcattagactaacagatttgttttcctcaacatgatacttgtataaaacatgtttatcatagctattcaagcactaatatgtctagtgttaaatgagctgattgggtgattaattctgtacccatgttataatgtatttgatgatgagatccttctatttgattgaaaaacagcagctcctactttgatgctagctagcactagttctgggttttatgtaactctagttctagttctgaatttgagttgtcagtgatgtgtataagttgtgcttgttttgtagattgcacgtgcacccattagagttggagaagaccaacctcctccttcaattattgttgcactgtgcactctttaagaaaaaaagatccttattgttcttttcatttttcccatcaatttttaaatatgcttcataacttggacttcttaagattaattcccatagtttagcgattcttttgtgattatctttctagatcttttgttgctgtgctaagtgcaaaattgtaaataatttgtgctctatctatagtactactatggatatgagagcaagagaccacgctagaaagaggagggaagaggaggacgatgatatgatgttgtttattttccctgcactacatttgttgagttctagtggagcaagggaaaagaagcgacgccatacatcaaagataacaggcgaggagcgtgttcgggagttgcttgaagggcatgtaaaaaattgccgggtagcattcaggatggagccggaaatatttatatctttggccaattaccttagaactgaaaagttggtcgatgatactaggattaaagttgaagagaagttggcattcttcttatacatgcttagtcacaatgcttcatttgaggatttgcaagagaaatttgggcacagtggggatagctttcatcgtcacgtaaagcatttcttcaactcagttgtcccttcgctctcgaagcggtttctgaagcctccaaatcctaatgaagttcattggaaaatagaaaaagatcctagattttatccctatttcaaggttcttacctaaacacttatatccttattaatatgctgttttacatttttagaaaatcatatgtggtttttttttttgctgcagaattgccttggtgcaattgacggcacccatatacccatatctatatcatctgacaaagcagctccatttagaaataggaaaaatactcttagccaaaatgtgatgatagcttgtgattttgatctgaagattactttcatgtctactgggtgggaggggtcggctacagatgccagggttcttacctctgcagtaaacaaaggcttccaagtaccccctggaaagttctatttggttgatggtggatatgccaacaccaattctttccttgcaccatatcgtaaagtcaggtatcatctaaaggagtatggggcaggtcggcgtagacctcaaaactacaaagagttatttaaccatcgccatgcggtattgaggaatcatgttgaaaggactttgggggttgtaaaaaagcgcttccctattctcaaagttgcaactttccacaaaatcaagaaccaagtgaagataccagtggctgctgcagtgttccataatattattctatcactgaatggggatgagcaatggttaaataaccaaccacataatatccatccaagcaattatgttgacctgccagatggtgatgaaggcaatgatcaaagcactaatcaagggaaaggaaaattttcacaaatcatgttttcgaaaaatttgtccttaaggtttgaccatttggcttatcctacagtcgagatggctctgataccaacttgtcacgcccggaaattcactagtaatttccgaacttatttgtgcataaaatcctcgtccaggaatcagccgaggtacacaaactgacaatttaatatacagattcatcaaattaactaaaacgataaatacttacttaagaggcactaagtcctcactaagaagaaaactgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaagaataccaaaggatggcgtaatattggctcatttgcaaaagcagcatttagcaaaacatttaagagaagtaaaaatagtggagtaattaatcagaaattttaatcaacactgaacagcacacccatgctgcacaggcccaaccatcctgaacaaccatacccggctgtacagatctaatctccaaaccaggagctaagcaaattattatcaggtataacatccataattattgtgagaggtgtgagactaatcacgaaaaacattgctcaacccgcccataaccgcgggcacggctattcgaatagttttactctggccagaggtgtaccactgtacccacaagacacagcctcaacatcatgtctaccatgcgtcgcgatactggaaagtacccgaatagaggctgtgacaataccctctgcataacacaactcaccacagtgcaccattcctggatcataatcacccccttataaaacaaggcatggactccccagcgacccccgtgggcttatctccgccacttctcagtctggtgccccgcaatgaaccatgctatacaaaaggtaaagccgttgcccacgctggcttgtggttggcacggttaatgttccacaatagtagctcgcgaaccggtccttaattgccatgagcacgactctcaaaaccatgtgctcacaacccaccattatcaagttttagttggcaagtaattaattaatcaatcacgattgaccatcgtgaactatcattaagccatcattaaataatagtgagtcataagttatcccaatagtgtgctaatgtttctaagcatggctaagcaattatatctaacatctagttgaaccaatatatataaagctcaactagtccaattataatcacccaaggtataaaggaataaagtaatcaagaacaaaagggccataacaaagaataagttaattccacccaatgacatttgaaaataaatgcacagttgaaataaatagagaatttaaatataggatcaacatgctcaaagggttgtttgggatctgtgtgacttgccttgcaataatcggtctttaattaatcttcttgaatacttccggcgcactcgcgaaccttcgcaacgacggaaacgacaagctaacacgcaaaacgaggaaaaagactaataaaaaccaaataaacaatacataaaaagtaaacaaacatgtagattataattttagatgaattatgaggcttgaacggcctcattctgatttcatatgaatttattatgaattttacaagatttaattccaattaagcctattaaagaaaagactattccaaattaattaaacaatttacaaatgatttatagctgagacagaagattaaaacaacctccggaaaagattagatcatatttggtagatgacatatattaaaaaggaataatatgtcattgaaaagaacggatttatattgattttggacggctgagattaatcttgaccgagagttgaccaagatcggatggcttagattgatctggcaagcgggcctcacgagataccgactcaacgagtcaattctacgtgacacgggatcacctaaatgatcaaccgaaaccggcgaacggaaccggcggctctgaactaaaggacgactcaacacggacgaacgaacgaagcacggggaacacctcgttcgaacgaacgagcgaacgactcaacaacggctgtggctaaaccggtcggctagacacgattcacggtaaagccctggtacgacaaacgataggccggtaggaacctagggttgcacctacggctacacaactcgactaaaagcagcggctaggtttaagcggcacacagctgcgacacggcggcactaagacaacttgactcggctaggcggcggctaggcggaaacacgcagctagggttagggtgacggcacagccggtagcgaccatgcacggctagagcagcagggctgcgagcaaaaacgcaaccggcacggctgcggctgtggcaaagcggcaaacagcggcagcggtagcgactaagcagcggtggctaagaggctcggtagagcgacggcaaaccgcagccgcacggcgtgcagcagctacgacacagcgacgacgacacacacggagacgatgatgacgctagggccaaacaagattagattagatcggattaaggccctagggaaaacctcacaggtgaacggcaaaggagcggcggttgccggcgaaccacggcacaaacgcaaacggagggcaccgggagcgagaggggatcaaagtgacccttaccaccacttatgcgacgacgaacggcaacggaagatagccggcgacgagcttcaaagggcggcgaggtactgtccacggaggcgatgactttccggcgatgtgcggcgacaacggaggggtggccgggcttcacttcgcagctgcgaatccaatggagtcgatggcgacagagggcgatgacgggaggagcagcagggcttcgccgaagatcaaaacgcgacggcgaacttcgggtttacggcgacgatggagctccggtggattttggcttcggggagatggctgccgggcttcctctccttcttgcgaacccaacggcggcagcggcgaccaaaagcggcggctaaggcggctgctagctgcggctggagacacagcgaccacggcggcgctctggttcacgacgacgggcaacctccggtgggatttggcgcaaaacaaccggtggccgaggtagctctcacccttgcgaagccgagggaggcgacggcactgaccggcgatggccggggcgacggcgcacggcggctggagcggcgccggcgacgacggcggggtggagcacgtggcggcggcgctacgaggcacgggagaccacgggagagggggcaaacgaaagaggaggactagggggtcctttatatagccatgggagctcgggtccgggcccaaaacgacgggaaaaactcgggaaagtttagatcttcgccggaaaaaggaaaggttgaaccgcgaaattggaaaggatttccatagaaacttttggggatttcttagggaaaaggaagaggagattgagaggattccattcccgcaaccaatttggaaataggagcaacggggaggtcggattttggaaggtaatcggcggcactgtgcacggcacgggagacagtcggctggaggaggaagatggagtactgtagcgccagggacgaaaaacagacttctatgcggctgagaggaagggagagaataggagggaatgggctgaattcggcccaagctgaggaggaggatttttattacttttccaaataaattaaccaatgagatgatctttcaattgttaaaaatattccaatgctcaaataattccaagaaaaatcttgaacatacttggacactcaaagtatttaatataataatatccagatcatttaatgattaatttattttttaaataattgctaaactgttctttgtattattaacattaggaattgagctccgaaaattccgagaaaatttcagagagtataattaaccatggagaatttaataaaaattaaatccatccatgctttatatttaggaaattttatttcccacatttaacttcacttgtaaattaatgaacatttaatataaattctattaatgatttattaaataatttataaatcctgaaacgaaaaacaggatgtgacaactttccaccaggattttagggcagcaagccgaatagagtatggctgtggaaggtctacaaaaaccttgtagggctcgcttatgttatcgttagcatgagggaatatatcaccactgtctgatgtgaaaaaatctatggcctcttccatgagggactcaacagtgttaccctctttttcaattcgcaagactaaattccttgctcgttctacgtaggactgaagggaaatactatccccttttttatctccctttcctgtccttggaacgtgcatatcagagctgactaggttgttagggcctgtttggtataactccaactcctaaatataactccaggagttgagtttagagtggagttgtggagctcctaaacccagctccacaactctagtacattttgtgagagagctccacccaactccactcccagttttagtggagctgaaactgtttggctgagctccagctccaggaggggtggagctggagctggagctgtgccaaacagggccttaatgctggcgctcctgagagcccatggtttctcaatgcatttcataactccggggacgaacagcacaatagctgcctgcaacaacttcttgtcgccgcctggccatgacttgcagaagacgtagatggacacggtgatctggcatcagaaaagtattgttttcagcacctaggctcttgcatgtttctatatggacttctagcataagtgcataacaatatatttaaccattttttaaaaaagaaatctataactatttaagctacatttactactagctagaaaatcaatcatcagtaacgggtcaaaaaagttatgtgtaatgggtgagtgaaccgataaaaataattggtcagtgctgagacaagtcaaacatataacggttaattaaattctatttgccactcttacaagtgacacaactaaggatttgggcccacgtgtcatagactgcgagtggcaaatctttaattaccacatcttaaaagttgcaaaaagttaaatgctgatgtgatacaggttatctataacggttcattacatatacataaaataaggaaaaaaatcctagctgctcatcgatgccaccgtggtgtacaaacaaactagaacaaagtgtcctgtccataacgcttcggcacttagaggggttttcggtgcaaacgagcctatttaattgataggataaaactaagaaccggtatataaccactcattggtgtcggttcatgaaaaaagttgacaccaataatcccaccaagtgataggtgcagggataaaccggcacatatcgatgtcaaatgtgtcgatcggtttgcaacaaaagttagcacttatgagtccataggtattggtttataattaaaaccggcacatatgatgacttcactattttctatcatataaagtcagatgaagaaaattttatatcaaatttgtagagcttgaaggtatctataacgtagttataaccttttcatttaaggttgcctggatgtctaaaaatgtgttataaattttcatatttaaccaagaaaattttgaaaatttttaaatgatctcagatgactcaaaatctatgaaagttgcagatcttgatgagttctacaactttatagttgaccacattttcatttaaattaatctatgttcttaaatatataattcattaaaagggagtagtggtagtggtgagtgatgaatctgtcaccacccccaccaccaactccctagtccctaccgttgtttagagtgaagaaatgacacatgttgtcaaatgacccatatgtcaatcacccctactttttgtgagaaggacaaatgatattgtgaggacataggatcaatatattaggtacaaatatatgtagaatttaataaatgatgtataccgaaaataataagaataactggttaatgatcattttcatcaattaaaatcctgttacaacacacgggcaatatgctagtgtattataagttttgtatgagagttgtctcaaatactagctaggtgagatggtaaaaaggctttggatgaagagagaggtcttgggttcaaatcatgctaacaacatgctcacaatactgccaccattaagagtgtcatggtcgccggttttataactaacaccaatgactaccctcaatacttccactatatttatgcccgttctaaaattgacacatattaatcgggagttcagaaccggcaccaatgagggtgtctctactagattactactccctccgtcctaaaatataagggctttcggatggatgggacacatcctaaatcaccgtcgctgcatccactcccggccacctcttcgtctgcggtgccgccccccgctgcatgctcccggccagaggagaggaagagagagagagagtctgcggtgccgcccgccgctgcccgcttccggccaaaaggagagagagagagagagagagaggggaggagaggaggaggtgaaaataatatatggagaagagaggaagatagagaggagagaggaggtgaaaaagtttgaagttgtgagagggaaaagagagaggaggggagaaaaatatgtgaagaagagggagtattttcgcatgtggcccatttaagagacctgcatgtgaaaataggctcattttgcatgcggcgccttaggcacgcctgcgaaaatagttttacatgtgggcctcttaaggagccatatgggaaaatggaggttgtttttttgcaggcgcaaccagttacggtccgcatgtaacctatagggctcctcatacaaaaaaattatttctgtagtagtgatggtagtatatatagagtcctttaagaaacaagtgcaaatgcacttagagcaagtacaatagcaggctataaatacatgtggaggagataaaagagaatagagaaaaaaaagtggcaacaaatttatagccagctgcaacacgaactctaatacgttctatgtgtatgggaggttggaccagataataatggtttaatatatgtttatatgcaaatatagtataaatagactattagattgactatagatgatgtgtcattttttggagttacagtagttgactatattattaaactttcttaaaaatccatgtctgacctggcacgtcatggtgacgacgttcctcctccagagctcgttgtcttcgatgttgtatgcagtgatggagtcttgtccaccaagatggattaggagaacgggagcccacaccacttccaggatgctgctattgccctgttctgtagaatcttcgttcttgtggcggttgaagagggtggccagggcataaatcgccatggcgtcgctgccaaggtaagcaagccatactataaatctgaaccggggataagtaatatgcttacgcctgttagcagtaaggaaaaggagcagttgaatgattgtgctggcaatgacgaggatgcgcagctgcgactcctgccaccattcaatggcacttgagagacccattgatctctctccctccctacctacttagctatactatctaatatctatcaataatatcgcgctctgtagctctctagctatagctacctattaatacagggccaagaagtgtgtacaggccgtcagaggtcgactgattgtgttgaccttgattcccggctaatccaatatagggtgtgtttagttcacgctaaaattagaagtttggttaaaattagaacgatgtgatggaaaagttggaagtttatgtgtgtaggaaaattttgatgtgatggaaaagttggaagtttgttgaaaaagtttggaactaatcaaggctacctattaatacagggccaagaagtgtgtacaggccgtcagaggtcgactgattgtgttgaccttgattcccggctaatccaatatagggtgtgtttagttcacgctaaaattagaagtttggttgaaattagaacgatgtgatgaaaaagttggaagtttatgtgtataggaaagttttgatgtgatgaaaaagttaaaagtttgttgaaaaagtttggaactaaacaaggccataagtaagccatagtccggagtccgagcgatagctgcagctacgttatcacatgcatcaatacttaagttgcactaatgtcaattatattgctcgattccgctcgactggggcgccctagctagctaacagaatcgttcgtatattttgcttgactgtgctcttgtggacttgtttaagtcttaacatattactatttgtttatactactagaatgggttcgcgtgctacgcgcgcggcaaaaaaaaatattagagagaacaataaatattacgtgaaatattagagaaatatagcgcatacataggtgcactttgatatgtcaatgatgatttatcggttacatggtacattatttcatagagcaccaatatacataaggcacaaagagggggaaaaataattgtaataagaacccattcagacagtacagacccactataagtccatgtgcaagcttcttatcctattccaatccacaaaagaagcacaatagcatgaatggctgcctggtcatgcaaacatgaaagggttatacctatgttggaaaatataactcacataataatttctttacaaagcagtcttgattgaacagtcataacatcaaaccaaatagaatgaacataaaagaagaatatatggaacaggaatgattattggtacgcatcaccatggttttgccatgctcctgtgacatactaaacctaaaaaaagtgtttgtgctctagaataacataagaccaaggacgttgtgatttattaatgttttataaagaaataatattagttatttagtaggcaaccaagatttatatcaaacctttgaaattacaccatggtatgggtattgtttagcaatgatacacatatatcactataagtatactatgcgagcacacatcaaaccctatagcagggtaaggatgagaagttcaatgtaactcctaggagtagtataaaagaattagaacttagaagagaatggtgcaaacaagaataagaatctcatgatgctaagtttcttcttagtatctcactttttccttttcaaagaagtaagagcaactcaggtgtattgaacaaggtaacaaatcaagtataatcaccctttgtagcgcactcatgatcaacttttggtttgggcacagaatcagcacgaaaaattgctaaatatttttgatgtggcagtctagcatcctttagaatttcaacttcaaattcaatgtttcagaagaggcaaacataaatagtgaaacgcctgcccaaggataaaatttgataggaggtaataatcacggacaaaaatttgcatcagcctttagtcaaaagcaagctggggtagctaaagatcaaacccaaggcaaaacgcatgaaccaaaagggaacaaataatgtactaataaagtaggataacacaacatatgagctgagaatggctaacatcaacaaataggattcttcagtcatttatcggtttggactcaaaaaagcagcattacctgggaataatagttaaatttatcaacccatctaatcgaacgtgcatgtggttacttcattgcgtgctatgaatgctgttcctggtatatattgcgttgacacttgttggagttctaattacaggatcttaggctttagtttacaaacaatcacctcttatttatgcggaaaaataattgatctaatgacctgtgtttgaagccattgctgttcttctttcttcttcttctagagatgcctcacaaaccccttccagtgcctagatcgatcgggcgattaatttagggtttgagattagagagagagagttcggtcaacagcctccttccttctctttctttatataggcgacactagtggggctcgggggttatctcaattagtttagaattcgttttctgtaccgatcacacaaaaaacgaatttatctcttagtttgtttcttgttaggataaggaaaccggtggtttagatcctctcctaacccttatcgacacaagtcgacaaaatcaaccaacaacacttagatacacaggtacacaggtcttaaaaaaagagcacataggaaccaactgacctggtgcgtctaggccgcctcaactaaatgtgttccatactcctgaagcatctcatagagtaacaggaaaactttcgaccggtctttacgacttgagcagttttcatctgattggctcgtttctccgatgccaagggatctggcctctttctgagcccacctctctctttttgtcattgcagtatttggtttgtcttgaacaggcagagcggcggacctcttcctggagcattgctgagcggcatcattcttagatgagggaaagatgtctagtgatattctcaagatgtacaaagcctgcttcctcactaaagaatccttgtcaacctggtgtgaagaggctaagcatgtcagcacaatcaacaggatgagtataaagagtaaaaggctaacataaactgagtcggggcagaaaggcccaccagtcccctgcgaatttcatcccaaaattcattggaattcctaagatcatagtcttggggctcgtgaggtcctgagaaaacatatttcagtgttgacaagtagagagagagagagagtatgttataagcatccaggcactcagcaggcctcagtgcaaagagagaatggcacgaggcccatatagactccaagaagccagacctgcacgagacaaaccatcgaaattaacatgcacagcatctatagaagatagaaagctgatgaggagcaggccaaccttgagagcttaagctgatgaggtgcacctgtgactccaggtccataaagaggattgatgatacatgacatgaggtgagtaccctgtatgtgatccaatgtacttaaggctgagaattcaagagctctggctgtccaagacacgaccagcggcaggaatgtcctgcactacagaacttctgcacagtacagtgcgtgtttagcatgctttcttgcaacaattcatccaccatgcattacttttcagttaacggattacacaaaaacaaaactgggagcaaggtcatcagacctgttaattatcacataagatctcttccaatcctgactgaatctgaagtaaaatatgaaagaaacaactctaattaagtaccaacaggaagcctaaacaaaaaccatagatccataaagtcatagagaggatttgatgctacatgacatgaaaatatgagatgagtactttctatgcgattcagtgtactcaaggctgggaacgccagtccaagaattttttttttaaaaaaaatgtgttggctagaaggagctagccaaccgatggaattaagataggaaaagtcacatattttcaatccttcatttgatccagacgaaaggtgaagggtttaggagtgttgacaactgaacgcatgtgtcaactgcaccgtaaacacatctcctagtccaagaatttccaaggcaagagagagctgtgcatgtttaacatgctgccttgcaagttgcaatcatttatccgccatgcattattttgctcttcactaattctatgtcatgacaggaaaacaaaagtgggagaaagattatcatacctgcgaatcaccaaataagatatgtaatctctttcagtcctgacgagcacggaacacctggaactatacctggaacaagttgagtttctgaaaccagcgaagagctaatgcggcacagctgcttctctccgccctcccgccgccaccgcatcgtgcagaggataaggtaaagggtgcacggagaagtcgagggagcacgagcaccatccccggcgccagagcccggagcgagggcaaccaaatccaccggtggggaggcctagaccattagctccgcccgtcctcgaaccagatcgggcaccgagcggagtggagagcgtgaaggagcgggaagcggtgggcgcgtggagatgaaaggggagaagggggaagcgacggccagcaccactcttgtccgggtggctggatcttccggcgcggcgaagatggctagaagagcgtggagctgcggcggcggcggcggcgcatgcgaggagaggagaagggtgaggcggtgcgtgggagggaggaggtgaggcggcacgtgcgagcgagcgcgattgcgcgagacggcgagagaggagaaacgggcgacgtgggaggctcagctatagctggccaaatgagcggcccggcccagcacggcacgggcccaccaaaggcacggcccaatagggcacggcccgttaggcacggcttcatagcgggccgtgccgtgccagcccacgtgccctcccccggcccaggcacggcccaaggggatgccgtgccgtgccgtgccgtgccggcacgagtccattagtggcacgtgggccggcgccggcccgaaggcacgcgagagcccgagagaggaagcacctggtgcgaaaagtcgcgtcgtcgcctaccacccacctggcgcaggacgcgtggaggcgaaagattggagccgtggctcgcctgacgcggcgcggcgacaacgcatgcatgcgtaggagcaggagatttaatggtttttgacgtccccgaggtcattttgggggaagtatcgtgtgccacttcccagtgggagaatgcaatcagcaaggtggatcaccagatgcgaaatgtgcggcttggattgaagcgggtcatgagctaggatcactttaaaatatatgcagatgccccccaaagtgtcagtgcgcattttgcacgcaacaccccataattcactctcttctactccatagtccccacgaaattcccctttcatctcatcgaatcaaacacaatagagatgaaggcgaaatgtacgcgatgccgaacgactccctcgtcggccccgccacggagtgggacaagcggcgggcgagatccaacgagtggctccgccgcgcggtctacagctccgcccgtgacctcgacgacgcgcgggccagccccatggccgcgcacgcgccgctccgcttctctgttgcgccgacggcagccgccaagcccaaggtcgtcggtacattttttaaactttcaagtttcaatgttccatagatctagaacaactacctttccttttgtaaaaaaatttttcagggattttttcgttatgtctaccgttggtgctgatatgatttttattacttggccgaggaggattcaacatttttatccattcttcacacgaggtagaagcagatctcggtttactgctccagattcttgtgaaccaacggttaagcgagtgtaggttacagaatgagttatgtttgtacatgcacttttttttgttcttatatatgatttagtttctttcgtccttgtcctgaaactttctgtaatgttccactctcaggaaagcttccactgaaaggagagaagtattctttgaggctatgtctgacaaagtagcagatagttcttctgagagaacgactagtcctttagaatcagacagcgacgcattttataaaaatcttgatcccctcttttctgtattacatttttgtaagttgttaagttcaaaaaaaatcaagaagaagagttaaaagattaaattgaattctgcagggtaaaccagattaaaccagaagatgtggttgcccagcgaggatgaggctgctgaaatgtgctactggtggttattatgtcataacattagatgtgctactggtggatagatattaacgtttacataacattcttcttctttttgatcaaattgatagggaaaaatggtgcaaaacgacgtacagtgtgattcttgataacacatgtcagagttaaatgaggggaacaaccatgggaaggaatggatcaagctaaaacaagaactatggttcagatcgaagccttaccctaacatcttgggctcctcgctgctccacggtgacctttccttcttgccacggatcgatccctgagctctctccccaccgaatcgatccacttacctttccttctatctctgtcccagacctcgccgccaacaagctagcggcccctcaccccgccgcataccggctagaaacacaacggcgacgaggtgcactagcgcccaacctgagactgcgctgccgctcagtgcgacgagccgaatccacagtgtactagaaaccctagccctcaatggggaaagctgaaatgttttggagagagaggagagtcaaatgttcagccttggcttctgctataatagagggactgaaagcattttggcacataacatagggacatttttgcataaacaaccaacaatgtgggaagtgtttcgatctgagcagtacacttttcatccgacggtccacattgaagattgcatttctcccaccgaatagtagtattgcaatggatacttccccggtcatttgaccaaaaaaaatgcgaaaagaaaaaggatgcacgttggttgggtacatgcatgtttttgactgcgtccgcctgctgccgttgggctattgcgggctgtcaggctgtggttggtggctgggggtggcgctgcgcgcttgtgccgtgccgggccatgtgacgtgccgtgccgtgccgctacagtaaccatgccgtgccgtgctgacccacgggctttggcgtcggcccaggcacagcacgcccggccgggctgtgctggcacggcccattagctcgcgggcctgtgccgtgccgtgtcagtttgtgtggcatcgtgcttgggccggcccgacaaagcacggcccatttggccagctataggctcagcggccacgaaatcgacgcctcggcaaggacgaccaacagggaggcacggacggatggatgaggcccagacgcagaatcggacggcccgcaagacgccgaaccaacagcaacatgtctcaaggtgattggtcaacagtagccaaatcgctgtgaggccggctaatctagcacctttaagatatttagtatgtgtgccaagctgcgctataggggtgggtgagccagtgtgggcttgtgtcaactcttacagtgtatatatttatatatactcgattactagctagaaggaagtaacgtatataattaagattaaagtaaacggcacaaaaccctaattttggcacatggcatgcatgtataatatatcacgggtcttatggtattggtcgtgcttcacaaaaaccccatggttgaccaattgtaccaaacctgaactgtagggttcatattaggcttatgtggcatgtccacacatgcgtctacgtgtatcatgactaggatatgcatgcgtggctatcccgaaatttgatcttatttatgacctagcccagtaaaacatactaaaccgattacattgaagcatggtcgttcacgatcttgtcataaatactgacgcgcggtcgttgatatgatgaatgtgttgtagccactagatcctcgagcttacgcttgtgatccttgtaattgattctgctaccacacgccccattaattgctgccactgtccttggatttccagctactgctcgactgcttggaggcccgaacagcatcatcggacttagcatactcgttggccttctcgaacatttgcttgaccgtcctgggaggcttgcgtccaaacttgccgacgagtaggtcgttgcgaaccccttttgtaaacgcagcaatgatgttgtcgtcggtgatgtcggagatcttgttacgctgctcagaaaaacgccaaatataatccctaagagattcatcgggcctctagatcacgttgtggagttcgaagtgtgtgctgggccgctcgaaggtgccttgaaaattggcgatgaagtggtcaaagagctcgccccaagaaccgattgtgcctctgttgacggtcgttatagaccaatttcaaccatcaatataactataataatggagaattgactatgcttataatgcatatttgttttagaataatatagttccacttgtacttggagaataatttgttgcaggaattgagcaaataaaataatgaagaaatgaggaaaactcactcctatgcaagcatatggataaggagggcccacatgtcaggtgtaaccgtcaggaaaccgccttaactgtcaaaaccgccataaggacctacctgttagccaccatgccaaagctggaggcctgttgggccggcccaggttcggccgaaccctagtggtgatggctcagccgagccctctacgtggacgtccaggatgcactctcaatgacggttatggggtaggaaggtcatttcgccttttctacaaccgtcataccgtccctataaatggaggagctcatttcacttcacaacacactcaagcaagctcaagattcctctcatactttattttagtagttttagtgctaagtggagtagtatagaatagttctcatagtcctcggagcttccggaagagtttcggtatggctctattagcttttctattctcttctgtaatactttcggaattaatgaaaaactcttctttatttatacttggtaatttacttagtacttggtactttacttagtatgagtactgctcttactttatatttgtgtcggtataattgtgtgggtagcctaccagagaagtgtaatggtgtgggtatagtgtccgattcatcgactactctatatcatctgcagaggtgtagagtagtatttattaatgtaaccatggtgcttagattagtaaatatcattatctgggcatatatgttgtgggatagtagaggtgggtcgctgatggtgacagctcagtatggtattcctctacgttagtatatattcataagacaaattcctgaggagggtactcctccgtatttatccctggttggacagcaatgacaggttgttgtaagaaactcggcaacccggggtggtctctcgaaataccaggagtgcactgttagggggtattggccacatgattgtatactagcaaatgtagattagagtttgagtgtatattagaagtataggaaatgagttctttctatctcttctcccacttaattagaattatttatttgaggaaatctataagcttcgcttcgtgtcactctacccttgtattaaattaacccctgcctagactttgatgaaggcaagtaatatatatatgtgtatatattagcatggttctctctttcacaatcttcccttgggattaaataaatatgataccttgtaatagttccgggtgaaatgctacaatggtatatccgtgcgcttgcggattacttctgtaaccataaatataccagggttatttctacgccattgttgggaatgaatatttctagtaatatcgttaagaaatactaatagcctcgtggtaacccagcgagccagttccgggccgagtcaacaaacgcaacaggtaaataatacgccattgccttgctatctcctcctgctgcttggattgcgagagtgtagatagtgagccacgactcggggtcggttttgccgtcgtacttctcgataccagtcggcttgaagccagtcggccaatccactcgacacatgtcacttgtaaaggcagcaactccttcatcgttcgcgtcatagcgatccggtgtgtggtgacgtcgtcagtcgtctctttctgctcggcgacggttaagggtgtcacgtaggtcgacaggctgccgtggacggggggagcgaggccgtttgtggtcggcatgatgctctcgatgtctgttggcggaagagtgaacggaatgctctcgatgagccctgcccccgtgctgtgatcttgagttggtgacgttgagacttggttgacaataatcccgagatcagagtggtgggacccaaatgcccgacgttgtacgaactgaaccagagggctgccgagtgcttcccgagtcaactaggaccgacgcggcgatcatcgtctttgtttgattcagaatttgagcgacattctctggtgctccggtagccatgagggtatccaagagcgcgattgctgcaaccgtgttctgctgtggagtacggaacacattagtgccatcaatgttctgttatccaatcagctcacatgctcaacgcccagatgttgttaacaaccaaatttggtaatgccacgccatggattcaaagctagagtcaaagccgatttgaagaaattccgttcgagaaagcagaatacgcatcggctataggaggtatcggctaccacatatcgattaagtgacagatccgacagagttaagccgatgcaaccagtctcaggaaagatggacccacgtccgtcatcgggattggtcgaagcacttcatagctattgccacgcgaggattggagtcctaaaaatgggcaattatatctattaattaggacatttttcagtttccttagagatatgtttggtaagggtccacctaaaggacttattcgtattttaagttgtgttagagataagagtcgtatccagcaaggacatattatgtacttcgggtataaatatgacccaaaaatcatgtaatcaaatgatgatagttcaataatacttcggcgcatcgccacccttttctattttcgttgtttcgacgagtttttgctttcgagttgggctgcatcgggttcgatctccgacgaagaggtaaaacttgttatggcggtttgcgttctcgggattagtgcttacatcttcatgacactctaatcatgtctatgtaaaccgccgagttatcatatataccgcataatctagattgatctcgtcatctaaacttcatcggctagcctctatcatcgaaaatggctgccaggtttaggtctcgatatcaagctagactatgcggtgtatctaccatattgaatgagttttcatcgatttgcttagatcttatgtttcttttcatgcttaatgctgcatcagttaggttcgatctgttaagtactgtcttgaaacattttatctagctctttctttgattgctaatagagatagcatcggagtttcagccgatcttacctgatttagtcgtcttgttttcttatttggttctggatcgtctaaatatgccccttatatcaagatctcacccgttttaaatatattaagcttcctatcaatctgctagttcaccctgctcattagattggtttcagttttgtatatttcatttgtgctgatatcttggtataaagtggtatcggagtaatagccgatacaggttaggtttgcccgatcggctatgctgtgaacatatataatccctactttggggcacatttagatatggagtgatttatactgtctcggtgcagcgaccgatcaatcccaatcactcaatctaagtgtgttccattagctagattatgtatcgttaacatctacagccgatcgagtagacccaacaatcttcaagttttatctgcctctgccgatctgacgcatcggcatggcctcggatgatacgtcatcggcaatcgtgccgatcggctatcgttgatgaatttaactctttgtcttttctctatcttgttggttgcaggatcaaaccagctggcacgctcagaacccgaaggcaatctctttggacctacactagagttaagcagatttctcaggccagtgcgtgtttttcacgtcaacagatgccaaagcatgttgccttcgttcctcagcctctcttgctagtcgcttccattcttgctgctcacgcagcaatctggcttgcccttgctcttgccgttcccactccaacctgagtcgctcggcttcttaacatgctcgttcctcattagcttcacgcacgagccgctgttcttccgtctcattgtctgccataaaaacgttgaaaaagagaggagtatagtcgtcttcatagttgtcgtcgaattcttcatcaaggtcatcgtaatcgtcgaaattgtcgaagtcatattcatcatcgaagtcaccatagtcgatagtctcagtcggagcgtaggaatcgatgcttggagtgttgaggtattcttcgatttcttctgtagaacacgattcgagtcgttgaaggattatgccgacttccttggagctagatccgactgtggtcgaagccgagtcagatctaggcctacggggagaaggcgctcttgaaccaaaaacagtagctagatcatctggtagccgcatcatgattgatggataaactgtgctgtcttgatctaatcttgaagatgaaaacgtcgaggtcccatctgagtggtttgaagccaagtcagatgagaaaaccctggagtagatctcggcctagtccgggagaccgaatggggcgagccgctatctcctcccgactggttcgaatccgaatcgagaagagagatcttgctgaagctgtcggtggtgaagtcgaggctaccgaactggtacgcctgcccgggagggaaggcgaagtcgtcgatgcccgaaacgaatcgcatcgcactagtcggccaaacacttgacgcaacacctacttgacacaccaactgttgaaataagatttcagcaatactaaaagggggtggcaatcaagctagaaaagtggatgggtcaggagacaaaggtttatacaggttcaggacttctcgatgagaagtaatactctactcctatccggggaaatatttcgccgagtgtattattgatctgacgatctgggggataagtctatgcccctaggagcacccgaacccctccttatatagggggaggtgccgagattacaatgtactacccatatgccttacagcctaggctaacagatatattacaattgtaactaaccaggactacgggatatttccttgatatacaagttagcataatacccgagtcctttcctaacataatctatctacatagtctatcccccgcaaccagtaggatatccatgctatgcaggtatatggtacccataatctccacaggcgggataggcgagaagttggaggtctagcggcggcggcggatcagcaaggcaaggaggtccgccggctgcggcagctcggcaaggcgaggagagtcggtagcgacttggcgaggaggaggaggccgggtccagcggcggctcagcaaggcgaggagggtcggcagcggcttggcaaggaggagcggtggtggcggctcggcaaggaggagggccgacagcggggttggtgcggttcggcgaggaggaggtcatgcggcgcagtggcttggcaaggcgaggaggtccagcagcggcagctcggcgaggtgaggagggccggcggcagatccagatccagagctcctcctgtcacgcccggaaattcactagtaatttccgaacttatttgtgcataaaatcctcgtccaggaatcagccgaggtacacaaactgacaatttaatatacagattcatcaaattaactaaaaacgataaatacttacttatgaggcacttagtcctcaacaagaagaaaactgcagcggaaaataaaatctagcgaagctccggctccactcccacaggcagctcaactggggtataagccaaacgtcttctccttcgggatcctttttcttcaactgaggttgattgattattgcaaggtgagcatatgacatactcagcaagccacacaacaaatatgcaagtgcacaaggataccaaaggatggcataatataggctcatttgcaaaagcagcatttagcaaaacatttaagagaagtaaaacagtggagtaattaatcagaaattttaatcaacactgaacagcacacccatgctgtacaggcccaaccattctgaacaaccatacccggctgaacagatctaactccaaaccaggagctaagcaaattattacccagtataacatccatagttatggtgagaggtgtgggactaatcacgaaaaacattgctcaacccgcccataaccgcgggcacggctattcgaatagttttactctggccagaggtgtaccactgtacccacaagacacagcctcaacatcatgtctaccatgcttcgcgatactggaaagtacccgaatagaggctgtgacaataccctctgcataacacaactcaccacagtgcatgtcacgcccggaaattcactagtaatttccgaactaatttgtgcataaaatcctcgtccaggaatcagccgaggtacacaaactgacaatttaatatacaaatccatcttaataataacgttacatacttacaaagaaaagaaaacaacagcggaattaacggtctagcgatggcttcagctccactcccacaggcagctcaactgggatataagccaaacgtcttctccttctggatcctttatcttcaactgaggtttgatgattattgcaagaatgagcatatgacatactcaacaagccacacagcaaatatgcaagtgcacaaggattccaaagaatggcataatataggctcatttgcaaaagcagcatttagcaaaacatttaagataagtaaaacagtagagtaattaatcatcaatttttaatcaacactgaacagcacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccacgggcacggctattcgaatagttttactctggccagaggtgtaccactgtacccacaagacacgattccacacatgttgccatgccccgaaataccaccacggcattgcaaagggggaaatcgtgacaataccctttgcacaacacaactcaaaacagtgcaccgttcctggatcataatcacccccttataaacaaggcatggactccccagcgacccccgcggacttctcgccacttctcagtctggcgcactataatgaatcatgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcacacgattaatcatcgtgagctaccatttaatgtaaccataattaataataatataacatagtttataattaacccctttagttagctaatgtttctaagcatagctaagcaaacttacatatagcatttagctgaaccaatccaatatataaggttcaagctaatcaatttattacccaaggtatcaaggaatagagcattcaatgcaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcgatcttcaattaatcttcttgatcaattccgacgcactcacgaaccttcgcaacgacggaaacgacaggctaacacgcaaacgaagaaaaagactaataaaaaccaaataaacagtacataaaaagtaaacaaacatgtagatcataattttagatgaattatgagacttgaacggcctcattctgacttcaaatgaatttattatgaattttacaagattaaatctaattaaagcccatttaaaaagaattaaattaatttaattcaatttatggacaattttaatatgtagatctttattttagaaaaatttagcaacttgaaccacctgaaacggatctacggttatttagttatgattttccgaagatttaatctattaaaagaaattggaaaaaaggaatcatgacgtcatgctgacgtcatcatcgccagcatgacacgggcgacgacctcgccggcgatagagaggtcggccggcctatccaagggcacctacgcgaagaggacgacgagacgaacccgatggtactcaccaaaacgtcccacgacaaccgacgacggccggcgacgacgcaagaggcggcggcggctcggttgaacggcggcgacagctctccggtggccggcggcgaagggggacaggcggccgggcttctccaccccttggcgcacctacgggcggcgatggcaagcggcggcaacggcgaaggcgacgcggcaagcggcggcgacgggctagggcgacggcgcggcgcggctggtggttggccggcgacggcggcggctaaaacgacgcggcgacgactctacggcgcactagagagctcgggaaagggggcaaacgaaagaggaggactagagggtcctatttatagccttggattgaagagatcggactcctcccgcaagaaatcgatccgggcaatccataactcggttttggagataaactcaaaaacgagttcgattcgggcaagatacacaacgatttgctccgatttttgaggggaaagatagaggaagacgagaggataaaaacccctcaaaaatccggaagaatcggggccggattgaggcggatttgaagcggcaaagcggcgcggtagggcggctcgggctcggctccatggccggctggaggttgaaggagctcccgacaggtggggcccacctgtcggtctccacaggagggggagggctggcggcttggctgggccggctgagtcggctgggccggctcggccgcgggcgggagagagaagagttgggccggaaacggcccaacaactttagggagggattttggaactttttcaattaaaataattcgtgaaatgatgtttcatttatttaaaaatacttcccttgctgaaacaattcccagaaaattctagaaaatagaggaacaagcaaagtatttaataaaattttatctaacccaattttatattgagatttagcaaattaaaattagatcttctcttttaagcttttaaaattatttctaataattccttttaaacaacaatttataatttaaggatttttaaacaagaaaagctcttaacaattataattagatcatttaatgattaaataattactgaactgttctttgtatcatttaggaattgagctccgaaaaatccgagaaaattctagagagtataattaaccatggagaatttaataaaaattaaatccatccatgctttatatttaggaaattttatttcccacattttacttcacttgtaaattaaagaacatttaatataaattctattaataatttattaaataatttataaatcctgaaacgaaaatcagggtgtgacagtgcaccattcctggatcataatcacccccttataaaacaaggcatggactccccagcgacccccgtgggcttatctccgccacttctcagtctggtgctccgcaatgaatcatgctatacaaaaaggtaaagccgttgcccacgctggcttgtggttggcacggttaatgtttcacaatagtagctcgcgaaccggtccttaattgtcatgagcacgactctcaaaaccatgtgctcacaacccaccattatcaagttttagttggcaagtaattaattaaccaatcacgattgaccatcgtgaactatcattaaaccatcattaaataataatgaatcataagttatcccaatagtgtgctaatgtttctaagcatggctaagcaatcatatctaatatctagctgaaccaatatataaagctcaactagtcaaattataataacccaaggtatcaaggaataaagtaatcaatgcaaacaggccataacgaaggaataggttcacaccacccagtgacattcgaaaataaatgcacagttgaaataaatagagaatttaaatatatgatcaacatgctcaaaggattgtgtttaggatctgtgtgacttgccttgcaataattgttcttcaattaatcttcttgaacacttccggcgcactcgcgaaccttcgcaacgacggaaacgacaagctaacacgcaatataaggaaaagactaataaaaaccaaataaacaatacataaaaagtaaacaaacatgtagatcatatttttagatgaattatgagacttgaacggcctcattctgacttcaaatgaatttattatgaattttacaagattaaatctatttaaagcccatttaaaaagaattaaataaatttaattcaatttatggacaattttaatatgtagatctttattttatacaacttttgcaacttgaaccacattaaactgagttaagatgaattagttatgaatttttaaagattagatcggattaaaacacttatattgattttaattgaattatgacgcaataatgaattatttttgaaaaggaaaaggaggattattgcgtcagcggctagggtttcggtggaccgggtgcacggcggcggttcacgggaacggacggccgagatcaaccctatccaaaacggacggccgagatcgatcggtccacgaccggctcacgggagacggggacgatgacgtcagcgatgacgtcaccaccggcggcggcggctcggcggctcggacggcgcacgctcgccggcgaacggcggctctacggcacaaacggagggcaccaagacgtagagggcgacgcggcgaactcaccggtgaccaaagaagcagcggagaagcaacggacagcgccggcgacgaggaagaagcgacggcggagatcgggttgacggcggcgacggagctccggcggtcttcggcggtggcgaagcggtggacggggatggcgacgactttgcgaacccgatggtggcgacggcgaccgacgacggcggctgcaacgacggcggcgactagggctacgcggaggcggcgctagacacgacggcgggctaaggcaaaggtggcggcgggtagaggagacaccgggggtccttatataggggctagcgagcggcgacggaggcccacggcgatcggcggcgagaaggaaagatcgggttcgggagagagagagaggaatctgattcgatctcgaatccaccggtttccaaagaaaattagccgatgtttccaaaagagaaaaggaagaggagatcgagaagattgtttcccctctatcaattcggccggagaaggaaaggatcgaccgaattttggaaagcggcggcggagcggctcggctagggtttcgggcggcggcggcggcgctaggaggaagacagacctgacagacgggccccacctgtcagcggctgagagagagaggagagcggcggctcggcggattgggccggactgggccgagggaaagagagagagagggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatgttgagatttagcaaattaaaattagatcttctcttctaggcttttaaaatcatttctaataattccttttaaacaacaatttataatttaaggattttaaacaagaaaagcacttaacaaatataatttgatcattattgatcaaataattactgaactgttctttgtatcatttaggaattgagctctgaaaaatccgagaaaatttcagagagttgacttaatcatggagaatttaataaaaattaaatccatccatgctttatatttaggaaattttatttcccacatttaacttcacttgtaaattaaacatcatttaatataaattctaataataatttattaaataatttataaaccctgaaacaaaaatcaggatgtgacacctccattgttcttctttctctagatcttgatccatagtttctttttttttcactttatttatgaggactatgtgaatgttgttcttctcatttgtatggtgatatttgatatgtgaatcttattcttctcatttgatttgtatggtgcttaatctgtgcaaatggtagctggatggggatattttcagatatattttgttgcccaaaatattttcaaattatttttgtaggtggtctgctttagatgtccagcggaccggttaacggagtcacctggaaaaataattttcgtaaacggacaaggggtccgcttgcaaaaaatctttgatttttgcaggcctctagggacagacggagactatgaccgcctgaaaaaaaaaattctagtaatgaatggactttttgcatggggtgaactgatcttgaataagaaaggtcaattgaagatgatgataaaaagaagacaaacacttgtacgatagcatgtcatatgatgttaatgaagctagacaaagatatatatgtctagattcattaatatcaatatgaatgtggaaaatgctagaatgacttacattgtgaaacggaggaagtacttatattcgttgatggaaattggtaaaaccgatacattttcattcgcaaaacgtagaattcttttcttaaaaataaaaattacctgaaggtacagcggaatttgccctgaatgggccacaacaccgtgggctagcccattgcccagccctgcccagcgcagtcaacatctcctcctgatggaataagaccactttgactccctcaactgaccaccgaatctaaatcgtatccctcaaccgcaataccagaaatctcaacccccgaactttcaaaactggtgcaatttgactccctcggcggttttgggggcggtttcactgacgtggcgcctacgtggcgatattgacggagtcttcggtccacgtggcgttgacatgacatttacatggcagtagaattaaaaaatatgcatgggacccattagccattcacacaaaaaaatgtggacccactgacatgtggggcccacatgtcagcccttccttcttcctcctccctctctcccttctctctctttctctccccttcttcccattcggccgacgggcaggagggcgactggcggcattggggcgcatcggaaccggaccgggggcgcggcggtggctcggccgtggtggcttgcggtagtgggaggacgaggggaacggcggcggcgactcgcagcagtgggaggacgaggggaacggcggcggcgactcgcggcaatgggaggacgagtggaacggcggcggcggcccgcgctgctgcttgtcatcctcgtcctggcggttaccggcgtggtctctgacggcccgtgctgccgctcgtcatcctcgtcctcgcggttaccggcgtggtcgctgtcggtgatgaagcgactggcgcgaggggg

SEQ ID NO: 13777 - DNA, 1445 bp, Oryza sativa
tttttttttggtgtgaatgactaatgggtcccatgcatatattttaattctattgccccgtaagtgccacgtcaacgccacgtggaccgaagactcggtcaatatcgccacataggcgccatgtcagcgaaaccaccccaaaaccgccgaggaagtcaaattgcaccggttttgcaagttcggggtgtcgagatttctggtattgtagttgagggatacgatttagattcggtggtcagttgaggaagtcaaagtgatcttattcccctcctaattccccaagctgccaaccaacccagcggcagccggcgggccgatggaaaagctggtgatgagacgcgagcggcggcggagcgagctgttgtaacgcaagcggtggcgcgagtgaggtcggcggcagtatcctccgtcgtcgcctcgttgggagcggtcgcgtctcacggtcaggccgccgctagctgggatttgaggtgcgtattttgactgaattacatatggctatttcatccacgaaccatatggaatgagatgtgaggtgttatatatgatgcatgtttaagaacaacggttcaaattaaatttgtgtgtactttgcttgctattgttcccctttgacatgtcggataatagtacttgttaatcacggatcaaaaggaatactagcggtagcaaattactgttactgcttataacatacagactgctataactagtgttccaaatgctaacagaagttcagataacaattacaccaaacatgagaaacttaattgatcgatactagtagaacaagtagtgctgaaaagatcttgtgagctaatttacttcattcctcataaatcttctgtgtcaagctttggtggtttcccatggctgtcttgaaagtgacaacttatatgtttcctttgagctgcttccaagccattttaagcatcaccagttgttcggctacttctctcatttctggtcgttcatctatattatcacttaaacacttcattgctagaatgccaattgcttcaagggtggccatgttttcctcagcagtgatctcattgtcaaacataatcctcccactgttttctttctcataacaattgacatactcgacaacaagactgcatttcttactatctaaaattcgtttcctggtgatgagttccaagagaacaactccaaaactatagatatcactcttccgtgtgaaaagtccggtttgaatgtaccttcggtctatgtaattgatgtcagctgccacaacccatgtgctatcttctcctatctgtgatgatccaaaacctgagattttaggcacaatgttgtcatcaaaaagtatatgggttgttttgacatctccatgtagtatgggtttggatctactgtgcatatatgccagtccttctgccgacccaacagcaatatctagacgtaaatctagtgggaaa

SEQ ID NO: 13778 - DNA, 3184 bp, Oryza sativa
ataatgttcttatggatcagttcgggaaggttcagctctttaccacatcgatcctcttcatgttcagttccttttatgtatgtcttcactgccacctttctataattctcaagaattcctaggtagacattaccaaatgcacctctaccaataattgttgaattgttatttgttattacttttatttcacgtgctgtgaacattctttttccactaatatacagaggggttcctttctttctagatttgtacatgttccggttgaaaatgcctgccatcttagggaacgccatcaaactggagctgacattgtttgtaccttgctggctttgttctttatcttcattctgtgtttcaggaaagaggtgccaaccaaaattttctagtggagcaggttgtctcaaacagaatttcctaagcatccgaaggtgcccagccaggtcgcacatatccggacgtctatgaatgtcctctgttaggcattcctgtagtaattttccaatctccactaaaaccttcatgttgctctcattgcaaattttgggatcaagcaattcagtcaccccctttccttcagcaagagcttgagccagacttgccgcctttttcttggtgataagctcctgaagaactattccaaaactataaacatcacttttggaggtgagacgtccctcccgacaatacaggggatccacgtaacctatactccctatacacttaacagtatgagttttgtctgtcgagagaagtctcgatattccaaaatctgttatttttgcattaaaattgtcatccagcagaatattggaaggctttacatcaccatgtagaacagggctgcacatagaatgtaaataccctagagcatctgcacactctatagcaatatccaatcttatgtccaatgaatcaaggctattcttgtcatgaagatggtaatcaaggtccctattaggcacatactccatgaccatcattggagcatttttctcgatgcagtagccaattagcctgactacatttttatggttgatttgactgtgaacacgtacttcttgggcaaacatttcttcagaatccattttaatatacttcttcactgcaacgaaatggttatcatcaagaactcccttgtaaacttttccgaatccaccatttccaagattggtgttgtagtcactggtaattctttttatatcttcttctgtgaaaggctttatattagaaatgttctcctctatccattgtgccctttcaatatactctttgtgcttgctttctgaaagatccataattatacaatatgatcgttcttgcttcaaataaattgatgatggcctggtcacatgataagtataagttaaatatcaatttaaatgcattgttagatttttttttaccacacatgtgcatagtataaaaaatatatggctatattccaaaggtaattgtccctaaaaagcagagttgcaacagaccttaacttgaactgctgacagcttataaaacaaaaagcataacctaaattaaattttcaacaatctcatgaaaatcgatgtcgtttcttatatgcatgtgacaagaaaaatggtttatgtttgatacgagcctgacttcatttgacctaatatattttgcagaatacaatcgccttcagctctattttgcgccgcaagttttaggataaatttgtatgcctttgaacttttggattcagggtgaagatttgttgtgtccattatgttatgccgtctttccctgtttgggacaccttttaattatacgaggatttaggccctgtttgattcagtttagaattattataatctaaattattaggagtaagctgaaacaaacaagtagattattatgctagattattataatctataagccagattactaaaatacaataatctcctctagaagagcttttttcagattattgagtggctaaagacccactagccttagatgcatctaataatctagagaaacaaacaactcgtagcttattttatgtcagcttattataatccagcttagagtaatctgatttaataatctagattacaataatctcaagctgaaacaaacaggaccttagttgtgtgcgagtctaacttccagtaaaattcatccaattaccaaaacagatacagattgggatagaagatccaaacagcaccagtcgacgtttatgcaagctctatgaccatcttggtggtataatggtatactataaaattataagtggtatttttttttcgccgagaaggctgaaggaggccatccgagtacattaaaaaggaataaagtttacaagaaaaaactcgacagaagctgtcgaggacggaggtgcatcaaaatgcacaaccaaagccacatgctaaccacacagacacaacccattgagagaagaacctagcaccgaaacgacccccgctatgcgtgaccgatcgccgccgggccaacgacaaaacaacaaagacgagactctgaaaaacgatgcccccatggaggtcacgacatcaaagacgccgccatcgcccatctaaggaacatgtggttttcacctagtgaaactcaccaagggagaggggtatcattgccaacgcccccaaggaggttacgacgcccaaaggcgtcaccgctgccagcccgatgaaccatcaggcgaggctttcgcccagaacccatgcaaccttgcttgaagttcgtcgcccatcaactcaggaaccatctcgcaagcagattagcacgaggcctccaccgcaccacgtcggcacccctccaccggccgaccaccacacttgctgcagagagctgccgccacccctaggaactggcccaggcctcctccgtcccaccatctgccggcctccttgctagttttggccgaaagagaacccggaactagacagcgtcgtgatggcgatctgagcttccctcgctaaccggctgccgcctcaatccaacatagaaactccccacatagaaggggaggagctccaggaagggcaagggtgcagatcgacaacgaggaagacgacccaccgctgccagctcccttagcactgccattgctccctttgcgccctgcctcaaggcctacgaccgccatctccacctcgaacgccaccaccgctgcaccagatggtcagaccgcggcctccgggcg

SEQ ID NO: 13779 - DNA, 3055 bp, Oryza sativa
ttggcccacaacgccccacagccgcccgcgcgccgccgccaagacctggccgtcgcgcgggccctatccagacaaggggcgaccagattcagccacaaaggtgccggatccaccgcctccccgagccgccccgccgtcttcacctccggccgtggttgtgggcgtcgtcggcttaactctgtcctcctcgcgccaaggaagaagtcgcctaagtggagggcctcgccgccgccttcccggctcaccactgacgagctccggcagcggcgaggtggagagaggggcggggctgtggtggtgtgggcggcatctttgagtttcactctgctagtagtaattgggggaaaaaaggagggtccaggatggataaaaaaattgagtttcactctgctagtagtatacaagcttctgatcggcatctttgatgcaagaactagccaaacagatctaatccaagaactcgttgaacagatctcaccttgttgtttattgacaacaaattcttgtaacataatactagtgaacaacagtagagaaaacctagacagacgaactagctagtatatatgaatacagttaatttctctcttgagaaacgctcaccagtggccggctggtgtggaggcggcgtcgatggcgtaggaggagacggacactggcaccggcggagggaggggggaggcgactggcgtagtcaaccgagcattactattccacacaagggaggtgaatttatccagatatttgatggaccttgtactacttttctagctagtgacatgcaatgcaaggcaccacgcatagaaaatccaaattaacagtcaccggagcagtaattgacaagtgacactgcctcaagcactcaaatgttctcggaagataacaaaagcaaaaatatatataaaaaaaactttaacacgatactaacccaggagaaaaaagtggaccaagtcatcactgtctaataatccctatgggcactgcataaaccgctgactctcaacaagaatgagaaaaatagccaaaacaatcttagttaattcctacaagtccactccgtagaatgtctatattttgatccacatgaaccagcatatcgccgctcagcaggcagcagcaaaagttacattagcatcacacttgtgttgagtttataacgaaaattctcagtgttgtatcctttcagtttataacaagaactcatgtagcaaagcagtcatttgaaaagaagtgaacaataatatacttcctctgtcccacaatacttatctttctagcatttaaatattgtcccaaaatagttgtcactttggagtactacttgttacatcaaccactttcaattcaaatttcttcccattctacaaccaaccaccctcctacatccaactatacattatttattaaaggatattatagtatttttctcctaacattagtacatgctaaacaacctagaacgacaaatattatgggacggaggaagtaagaacagttaattcctaatgatattatagtatttttctcctaacattagtacatgctaaacaacctaaaatgacaaatattataggacggaggaagtaagaacagttaattcctgatgatattatagtatttttctcctaatattagtacatgctaaacaacctaaacgacaaatattatgggacggaggaagtaagaacagttaattcctaatgggacacttcagacaacaataaatggatgaaaggaagcagatttaagcatccaaatgcatcgattttgagttaggaactgttattggatgaaggaattagaattaagcatccaaacgcatcaattttgagttaccgacttggcatggtgttaaatagtagagatagagaaatgcacattgtattgaaactcgggggccagtatatataggagatacatggggtagagataagaaaagattacagatatgaaagaagtccacacaaatcaaccatatcctaacatatactctaacttcccctgcagtccaagcgtaaacagcgcggaggcttagactaaagaaaaactagcaaaagtgctcaacatggatgatagcccttttatgccgtaatcgatgtagccaaatcaaaggacgcgagggagccgtggtctcgatgaagccatgcatagaatacccatggtcgatgtagccgaagttattagatttagccatccaaacatagtcagcttatgagttactaacttgcctttacaatgtttcatgggttccttgctactttacaaacttctgtatctcaggatgagaaaatatattcattataaagctcccccccccctttctctatcgctggcacgtactagacgatcgtgatcaaataagtctttggatcgggatgatataataaactaagtttagagatctcgatgaacaatttactatttacaagctcaaacctacttacggactgttgatgcgatttactcatttttgaattatagaattgcacagattgacacttcagattaatgcatcgggatctaaacaaccactgtcactgtccagaaaagaacacgttcacttcatatcaacacacacgttaccctttatgaaacggcactcccactgaagaaaaaggcctctgaagaaaacagcaaaaaggctccatcttaaacaagtcgcttcataagagtatacgaacaagggctaattaaagaaaaagtgtgctatccccagtattgagtatttgccatgatggagatataccatcgtaaacgtcgactttagagcttgtggataggagcaataagcaagcaagtaggatcaacagaacaaaaattaacgatactaaccagccgtaattaaaaagcagatgctattgtattaattaatggaatcagccactctaacaatccctactggcattacatgaacgacactctcaacaggaatcaatgagcaaagcagccaaaacatattgttaagtcctacaagtctactctttagaatgtctaaactttgatacacatgaaccagcgtcatatgccatagcaggagtattttggaagcagtttc

SEQ ID NO: 13780 - DNA, 2185 bp, Oryza sativa
tattatgtcagacagtaaatacattaacatcaccattgtggtgagtttattaacagaagcaatcattcagaaaagaaatgaacaatagaagaacaattgattttggctgggatacttcagacaacagtcactggatgaaaggaagtagatttaagcatcctaaattccaaatgcgtcgatttgaattatcagctactactgggatgaaaataattagatttaggcatccaaactcatcaattttaagtatttacattgttttatgggtttcggttggtagtttacaaatgcttgtatctcaggatgagaaaatactcactcaaaagatcgtaactttgataccatagcaacataagttacacactctggaatacatgagctaaagtagattgttctaccactggcttatgcagaagacgatgaactatctgcatcatagaaacttgcgatcggatacacggcatatataggacgggagtcgggggagtccaagaactcgtccattttgcaaagctccttgaaccgcaatgactcaagattgaccatgaagatcctggtggacgacgcgacgaacagctcattgtaatcctgcgaaaaccccagcaccttggtcggattgacacactcccccgcgctcagatgaagaagattgtcgaggtagatcggttcgagcggcagccacccggggaggccgtcgaaatcgatcatccactgccatatctgcatgcaggatcttgacatgacaatgagcccaagctctgtcccctcttggagagtaatcgggtagaggccatcatgatcttcatggatatgcgtcggcacatacaccacggagaggctgtggttcaccaaattgaactcgaggatgttgttgtcgtagccgaagagcatccagtagaggaaatccccaatctggatgcatctgcacccaagcgagatgcaattccccactggggtttcggcagcatggtctccccaatctccggtctccgacgagtagacgaaggcgaaggcggtggacctgtcggtgccgacgaggaccaccttgaaggggttggacttgcagttgtcgccgtggacgtggtcaccggcggcggtggtggcggcgcagatcaccgtggcctggaagaagaccccctttagggcatcgagctgcggcgggggggagaggtggatgaggtcgccggagacggggtcccagatgaggatctggcggcagccgaggccgctcttccagttgaggaggaggaggcggccatggcggcagccgtggtagtaccagttgccgccgagctcggtgtcgtcgtggaggcggatggagaagcgctcgggcgggacgcggtcgggggcgtcgagggtggcgcggaagaggggctcccggccgcgcgggttgacgaagaagccgagcagcggcggctcgccgtggtgggcgcggtagcggcggaggaaccccggctcggcggcgatgcggcgccaccgcctgcagactgcgccggcgcggatgagctgggtcggcagcggcgggacgcggaggaggatctcgcggagcacgtcgtcgctcagcggcatctcgtccatctccggcggcatctcgtccgtctccggcggcggcggcggcggcggcggcgtggtgtggcttatcatctcggcggcgcggctaatcttgaccgttggatttggcgagtgtacggaaacaaagtaatctgtggagaggctgtactaggaattggttttatttatagcgatcggacggctcagagaccgccacggagtcgggttggaaacggtaattatgtctgacacgaactcggattaaaaactggattagaattagtaattggcctattgggctttcagcccaccgcccccatctgggccggctcacgaaggaaggagaggaacgagaccgacgcggatgacacatgcggccatacggacaagaggtacgtgaggtaaaatagcgtcatggtttgaaagtgtatctcttgttcttctcttcccatttttttctaattattattatcttcatttacacttttataaatatatgctttgtgatttgttgcattcgtacacatccgaaaatgcttcgtttaagacgtccggacgagctcaaaatatcggacgcttattctaatccaatggcctgttcactttaatgtcattttcaaccatattatttttt

SEQ ID NO: 13781 - DNA, 8775 bp, Oryza sativa
aatctgaacaggccccaaatctctcagccacctcctccaccacacattccctttcattctttcttctctcctcaaagtctctctcttctcaaagcctctacacaggagagttgcaagccatggcgaggcatcgtctccgatggccgcacggcggcttcgacaatggagcaaggtgacgcgtgataggaaagaggtgctcgacctcgccggaggccacatggcgacggcagggcaaggcggtgcgtggtagggaggaggcaatggacctcgtcagcggccacacggcgggatatacagcgcagtattgaggaggaggtgctggacctcgctggtagccacacggcggtggggtgtagacaacgtaggattgggcaggaggcgctgaacctcaccggcggccacacagcagcggcaacaatgtggcagaggtgctagatttggctgttggtgagaactggacagcgcggctggtcttaggtgaggtcgcccacctcgtgccgctattcttctcccaaaagcatcagttacttggttctagcagctatgggtagaagaagaagacgaatgtgggttcattgcattggagttttagtgatgttttagcatattgtttcattttgttgcactttattgtattaaggtgtttcattttgttttgattcagtgttgcattttactgattctttgtgttgcaaccagcctatttcaaattttgcatttgattgaaacaattttgttcaagtaatgaaacatttttcctcggtcgatgaaacatctgaaacatttttcatcgagtggtgcaacatgtgaaacactttgtgataatacagtgcaacaccatctgatcttttgcaatagatcggacgtctgatttgtagcagcctccgtacacatcgcttaagaaattgcccggttaatcctaccataagtgtgttcagcaaaaaaaaagatgtccattattagcataactaggaaaatggcccgcgcattcgcgcgggcatgtgtcgtaggctatgttaatttgaacatatgctatatacaatttctccataaattgtttccatcagcattgcttttataattttctaacctagctattagttagctttatagcaaataatatttaattaatccctacaagtaattatttataatcttcttcatcatctaaaaaaaaagaaggtagacttattttatgttagaaacatgtataccaaattaagtgtcatgtcaaaagtaaggtgttttttaattgaatataggttatcattgtttattgacggatgaattgatgtgatatgaggctcccctaaatgcatgtgtttatatagtctaatataattatgtagtttaagagacaatccatatgcgaatgttctgtgtagaatatgtgggaggctccaggcaacctagcgtgaatacagttggatgaagaaatatagttgcactatatatttttatatatttttttttgaacgtgatgcatcatgaatacacacttgtttttttaagatgagatagatgtaacggatgaaaataatgggttcatcggtttaaaaggcctaggagtatatgcggggtaatataaggcgcctttatactaaaaagcaaccatctaatcgacttaaataaagtttaggacactttggcagaagatcgtttggcttgtttgcattatttgagcatattaattgcaaaaaatatcatgaattaatcagattcttttatctaagtaaaagcaccaatttttagacaattagacttgagtagttatatttcttatataatgtatatctaatttaactctatttgcaaaacaatgcacatacaatcagtgtttgttgaattttttattcttttatggcaatttgggtgattatccctatgaattgttttctatgtagtcgcttgaaatattcatgtttcagctattttttgcgaactgaatgtctaatttagtcatgtagggttgcaaaataatatatgatggtgcaacttatgttgttgagttatttcatagtttttaatggaaatttgaataacatgtaaaaaggaagtgatgttgtgcatcattaaaaaggattgatgtataattacgaaatatatgttgttaatgttttttttatattccatcgctatttggataacctgcaaagtgcacggtagaatgtgaccaaatgtcatatttttatataacaaaatataggcacatggatcttgaattgtgctttaattataaataaagcaacaattatattagaaaattatatgcatagcttaaaactatggtattttcaatatttgtttatctctttattgtagtatctgaaaatagggaggaaattggagaggaccaatagctagagatgggttggcagtgtaatagtgttgtgcatatatgattggatagggtggtggaggggacattgtttttctaatgtttctaaataatgtaggtgagaatttgttgttttctcattctaaagatctttaagagatgatatatatgtggaggcttaagattgttgtatagagaaagaagatctaatagttaaaaataatgggtcattgatttaagtgaaaaccgacagatagatgtttttttcgttgaattctattttttctaacttttaaaatgtgatacattatgacttaatagcgctatagagcacgctaagttgatttttattatgtaaaacgattctaagactacataatatataatttcactttttttttaatgttttgttgttagtgggtgaggagattttgttttttatagaggtagatttaatgagttcgtcggttttaattatctatatgtgtcaatccaattgttaaattataggtcaccaatttaattgaaaattgttggtttaatatttcttctttataataacttttagaattaaaattgttagttaggaaataggaaggtgagagaaaggattaattattggagacagaggaagtgtacgaacgtatgtgcgtagagtggtgggaagggtgggccagtggtgagaggatagttgtgccggtggaagagaagagaggaatgtgggttgtattttttgtttttgaaaaaataaaatctaatagttaaaaatagaggtccaccgatttactataataccacgtggtagtttaggagtgttcataggtgtatcacgtgatagtatagtgcctttgtaggttaatggacttttactatagttttttttaaaatggtaattaggacaacatacaaagggtagaagtctagtccctagaaattattcctttacgtagaaatttacttacgtaaatttaccatggttgaatctatagttttttttaaagacaccatcgatctaattttgatgggtccgcaaatttgttgattatttaggatgcttgttgtttagcgagtaaaagaaaatagtgcacacctgcatttgttgaagacctaatgctaatttcattaatccctagctgattacaggttagcctatttggataaccaaattaggctgagttctttacctcacattcctaactttatctctattaaatggtgtcacaatcctaactcatctctattaaatcgtgtgtttttttaaaaaaaatctatataaaaattgctttaaaaatatcatattagtactttttcaaaaaaataactaataattaattaatcatgtgctaatgtacacgtcgttttacgtgccggatagacggggtttccaacccctccttctgaacacagcctaaagcaagcagcacgcatgttgaaagcctagctatttaatgttttgatttgtcggcacatcgttgtggtgttatcgtattactctaagtttctgtatgacagtacgaggttgtaagctagtacatgctccctctctactcataaaagaatagattttcaggatagtatttaagtcaaaccttaaaaatataaattatgaataactctcaagttgttgttgagtttgaaaatgtaaaaattatatgaatagatttgttttgaaaaataatttcataaaaatatacatatatcacttttcaataaatatttttatagaaacaagaagtcaaagttgtgttttggagatcatgtcgctatctaaaataacttccttttataaatatggaggaagtacagagaggggaagtaccaacacagagacagagaggagaaacgcacatgtgtgtatgtgcggcaggaggatacatacgtgtgcctttgttttgtttggaaatatattaatttggtccaatatccggagaagtagaggaagagtgtacgtatttaattaggtgggccagtgtggaagagaaaaataaggaggatcgtggagtctctttttttaagataaatctaatattaaaaatagtgggtttaccgatttattagattgacacttgtcagtttaagagcgtttgtaggaagccacgtggtggcttgagagcatttttaggaagtttaatagaactttagtagataatagatagatcttccgtggtcatttcgaccttggcgctttccgaacattgccataggcaaaagctaattccaagactttttttttaataatgcactatgaaaaaaacacgtgtgttgcaacatggaaaaaaatgaattatgttgtatgtactattaaatttgtaatcaaactaatttttctttggtaggtttaataataattttttatataattaggagattaattaaggtggggctgctaagtactttgaacttaggtattaaatttgtacattcctggacattcagatagagactgctcaaacaagataaaaggtgatgataggcccttcagattttcagaagagctccactgctcgccactacgtcagtttgaaaggtggatcaagaacagcatcttttatcccacgagtacaaaaagatgtggtgatgtaggtgggggataacaatcaaacacagcgagaagatcatccacacataagcgatatgatccctgcacttcgggaactaggatcctaactggaatccgttggtggctcgtcaggtggggatgaagtaatcatgtcacaccgtaaacgctcaacttgcctaacaggagaggtgcatttggaagtgcagaatccttagaaggccatagtactgtttgagggggtgactgaaggcaaatgttcaaacagtagcagtgcgtcgtgaaaatttgaggagcctcgtatgccacctgtgcaggagaacgcccaagaacaatactccacagtgcagacacatgattcacagtgcagattgtttttaagtggagccctccagtctttattcccttttacttttcatctatcctctctctcctctagtcctctattcgttcccaccgtcagaagagatatgactcaagcagcgacgcctgggcggcccaagcagcgagcagcagtgcggtcgtcctcgcgcggagccgggcggagcgccggcgcgagcgagctcgtcctcgtgcggagccggatggagcgcctttcgcggagccaggcggagtgacggcacggttggcgagccctggccggcgtagatcgaggggcagcgcccggccggcgcagatcggagggcggcatggccggtgccgccgctcctctttccccgtcggccccgccctcacctcctcctcctcctcctcgctcctctcccctttctcctctggcacgtgtgggtcccgccacctgagacgaggaactcgtagccaaaacttgctccgcgttcttgaggaggccgcgcggatggacgacatggcaacgaatattcggttttggggaggaaggctgaacaccacatcggcgcactgtaaacgctcttagaggtttgaaaagaataggacttatgtgccctgctgtcacgccccgaactagtcctgaccagaactagcccgtgacgctccaaattaagctgttaatcgataccagtcccaggaaatagtgctggtatcacaggaagacagaatatcacagcaacagcggtctctttattatagagtagaggtacagtcatgttgggctgcggatagatcccgagctcacaactgcattacaaaagggaaacggaagccaggacttggaccaatcaacacaggcgcgacttgggaactaggccgaaaccctaaaactcatcgtagctggcttgctcctggaagaactcctcatcaacaggatccgcttcatcttcttcagcaactgaggggggggatatttatatagagcaagggtgagtacgggagtactcagcaagccatgggaattaagtgtttaatgtaggcttcaaggaaaggctgttgtttttacaattgattttatttgaacacctttctgaaaacaactaagtgagtgcttctcaaacgacacggttgagacagtgcgtctcgtccggtcggagtttgtgcaatgtatcagtctttagaattgatcaagattggcacccggccaacaactttcaaacggccacccgggccaacaactttcaaacggccacccgggcctagctgatcccgtcagctgctgatttttcaaacatcgaacccctttccacaacagcaatttcacaagcagtagtcaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgacttatgtttggatgaaattccaaggaatcggtccttaagtgcgagagcggggaaaccgtacacccggtacgttccccggtccgcggttttggaaattcatttagttcgcaagcaccgacccaggtgtcgggttttccaagtcttttgtaaaacccaagttttacccaagttgtttttcagattttaagtttgaaggcgtccgtcgatactcgcacagggtgcacgaatatcgagacgcatctggatggttacaaggggacatgatataacaattaacaaagggaggatcaatgcaacaaattaggtaggtccaccaaactgccttgcagacgggacaacagattaagtgcgatcctatcagtgcataatatttttcaagcaacataattaaatttcaaatataggctcaagatgttcaaaggtggcttgccttgctcgagatctggagcttgatcctcgaaatcctcgcacaacgggtcttcgggctccggaactacacgcgaaacgggacaactcaacaaacggcgaaaaaaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaagaaaagaaaagaaaagagggagggaaaatagacttttctcgggcggctagggcgcggcccaagagaattggggcggtctggccgagctaaatgggccggccggcccaagacggtcgcgcgcgcgggagggaggagagagagccggtggaccgggctcaccgtccgcggttccgggtgggacccgcttgtcagcggctcggctcaccgagcggagggagtacgtggcgcacgcgcgcgggcgggggaggaacgcggtgcatgtgcacggtctgtggaggaacggatgcggcgggcccacgcgcagcctcacggctcgcggtggaacgcgcgcacgggaggggctgaccggggtcggcccgtcccgacctcggctgagctggcgccgacgtggcgcctacgtggctgccacgtgggctggcgggaggtagacgacgacaccggccggaacggacggcggacaacagcggcgagcggcggagcgaaccacggcgataccggcgaaaatgagcacaccgggtggttgcacgagacgaggggagacgagccaacggctcggattcgccggaggaagcttgacggcggcgaatcgcggcggcggcaaccggcggggagggaagagggaaacggcgacgaggtcacgagcggccgattcccggcggtgagagcatctacgcggctacgggaatccgatgttagcgtcggattgggcggagctacgccgagcgaggctggcgacgagcgggtgctacggagctcgagcggcgatggcggcgagcacactgtgggggcggcgccggctagctacggggaggctactcgtgctaccaccgaaaactaagggggggagatggagcgaggaggaagaacggagagaggcactaccgtgcgggtcggggcgctgtgacgagaggccgacggcgcgggagtaatctctccggcctcgggccggggaagaggaaggagagggcgcggccgaagtccccttccgcgtccttgctcgtgccggctcctccgacacgcgcaacgacgaacggcgatggcgaaacagaggggcggcaatggcgcggaggtgaatgggagaggaaaggaaaaaagg

SEQ ID NO: 13782 - DNA, 5849 bp, Oryza sativa
gagggccgcgggagaggggaagatgggccgagagaaattcggcccatcgaccccgggggaggcaaaatagacttttgcggaggaatttgatttggaaagatttggattcggatttgaacttgacgatagatcggggattgagatcttgagatggcacggaccctagacgacaagcgaagaaacaaatttcgcaattagggtttttaagagataatttttccgctaggcgccacgacggaacgggcgctacacctgcagggagaagcaaccagtacggaggctgctagtaacctgatgggtagccccctcatgagcaatggattgtctaagttggaattgtcgtggtatggggaatgccgcgacaattcatgacctgctcgctttagttaaatagcataattcccatattgcttttctccgtgaaactaggcaaaagttggatcgtgtttgccgtctctgtagtagattcttaatggtagccttgccttgttttggcatgaacaaggaaatcaaagctattaatgaaagatatattaatgcgtatgtgcgagtgtcccctgttgcgcatttatggagattaacttgtgtctatggagaactaaggggttgtttggtttgctcccaaagtttgctaaaggttgccacacctcatgttaggcaagtttgaacaagttagcatattatttggttcatagccatacttatagcaagattccttctcatctattagggccccacatatcatcaactcactaaagtgtggcacaatccaattttgctagctaaggtgtggctcactttttgtaagccacaacttagacaagtgtgacataaaaagtacggtgaatggtggcaaacttagtatagcatccaaacaacccctaagaacagagaatctctatcgtatgtggacgcaattaagcttcatgatacttacttctgatgatctgatctaccgtggattgctaattggcgattttaatgaggctctttggcaggaagaacatttgtctgctacctccagacccgctgcacagatgcaagcctttcgtgatactctacaggtctatgagattggtaatcataacccagcaaggaaggtgcagaataaagtgggtggcaaatctataatggtgtatgggatgaataaatgatacggaatatatattttcttgcctgccgatgctgatgttgtattgaaaatttgtacgtcacacctcgacaggaaggggatttcgtcctagcctggcacccagagaaaagagttcggcatataaattagcggtgagtacaaagattatggattcgggacatggggaatccagtggcagtagagacaaatgttctgcatgctgttcaaaaaaaaaatgtttcactttatatggattaaatgttgcagtgacttgaaatatttgctgaaacattgtttttatataaggtaaaacagctctgatttaaacgattaaaatattttcgatctacctagtgaaacaattccgatatacttggtgaaacaacgtgcaacatttaaaaataatttaataataagctaaaaattttttcaccagaatatatccatgtgtggtcttgttttaaagatttaattacaacggatttaaaagtgcaatcggatcatgatttggataaataatttaagagaaaaaatagtttaaatagtttttgcatgtatgcatgcttgatgacattggatggctgatggcgtgcgcgtggatcggacagctcatggatgcgtccgatttttcgtctcgcgccgtacttccgacacgtagcgttctccagaatactttccatgcgctctgccagtgtcttcatgcatatgatcggtggaatgcaatgagggaggtctggatgcttcctgcacatgaggatgtgaagtatacctggaaggattgtctccttttaattcttgcgaacctatctgagctagagcaggcttgtactttaatattgttgtggcacatatggcatgtacaaaatgatatcactcatggtaagtccctgccagtgaaagaggcgtcgaagaacttcttgatgagctctatgaactccttaatgctgatagatacagcaacatccagccgctgacttgaagaatgggaagcaaaagtggtggacacaacttacatagatgggacgaagaatggacatattcagtcaacaagagcaaacaaatacaagacatatcgtattaacagttcaatcgcataacaggctcgatcattgtttgcggagtgcttgcgttgtgaagagatggactaatctgttggatgattacacattgttatacctaatttttatggcctatgaccagagttaaacctatcggtttagccgatttgatagggcctcaccgaaatgccgaaatttcggtccgaaattttgaacaattaaaatttagttgaatttgaacaaatattatcaaaattcatgaaaaaattaaaaaattttggccgaagtaatatcgtatcggaggggactggaatttccaaccctgcctatgactactataagggagtagggggtcttggggatgtggagtgacacggatcgtagctgggtcaatcgacccactgcttaatgggtagatccgtccttggaagcaagtaattgatcaatcgagcatgcgccggaagttagctcctagtcacagacctaaatctgatttggagttgcactagaaccaacctatgaatgggtgggtaaagctgaacgtggatagctccttcagtccttggaatcgtcgtccgtgactgtagcggcaatgttatcttcatctcgcgcaaagccatcacccactgttttgatgcccttgaggtggaattgatggcatgttgggatgggttgtcgttaacgctacagtggaccttgttcccaattatagtggaatcggactgcgatgtagcaataagatccttgttaattagccaaggaagatgattactccaggtgggcattcttgatctgggatacaacatatttagtctctgaaaagagggccattaaattccagaagattagccgcaattagaatagaattagtcatgaattagcacagctctagggagattaggggtgcaatcaggcctaattgttaggccatgaaagcacttgtgtctcccagctcatccatgaggattgtactaattcctatcctgattaatgatatcctcttttccccgctaaacaaaagaaactgtctatagaaactaggaaggcatgtatatatattcaggagcttgtccagctaggaatacacatatactatacgaccatttttcgctgttacctatcttactgttagggttataaataccatatacctaatagtaatcgattaaacttggcggtgcccaccacatatcaagtcttatacagaatcatacctcgcatatagatggagttccggataagaaaggaaaagtagagttctatatggaaacgataaggactactcggattgtagccacattggtcttcctagttctacttggacaaggggcacctatgggtataaatacaagcccccctaggaggagaggggacaagccaacacacgccagatctcgacataagagattagcctagacataccccatccgatgcctacagaggttggcaagagggatctagcgccatctctgatctcgacgaattcatattcaaggaggaagactaccttgtcgtcgactacgagttggttatctatgctgccaagtcgacaacagttagatagctaggttaccctaattattgtactcgtgtgattcagatgaataaaaacaacaccggcttcggccaacaggatgtagggctattgcctgtcagataaggggcccgtatgtctccgtctctttaacctcaatctcgcatataccctggtaccgatgatccctataccatccaaataccgtagtcgcgatctcgaatgtcaaacagttagaatgatataaacagacaggaactggattagaagtgaagaaacagatgcccttacgttttctaaacgaacaaagaaaaaaacgagctgatttcatggtttgggcatttaacttgtgactggtatattgcaatcaagcagttcctagcaaaacctcctgttgctaatcgctatagatagcccaagattgacaccgaaggtacaaaacagtgttgaccaacaatttcatgtcatttgcctgcttaattttcactccttccaccaaaaaagaccaaagcaatgtcaagagctgagcagttgctcattgtgcttccccatcaaatgacttctgccaaaccgactgaataagcatgagcttcaagagaggatccaccagggccaccaaggctattcatacatcgcatttatcatggttatctgcaagaaggtatagtcagcttacagcaaataaaggccatctattcctcaaataatttctttcaaagatggaaatattcaacttaggggctttagattaacagaaaaataattaataagaccatcagaacaatctcaaacatcaaaatttgtattctttagcttcagatcgactaccaacttcccctgtaagcattcagaatggattaccatacccaaaaaaaacaacctccatagtccataaaggaaatgacaacagaaaacacatccatgggctacaacaaaaatgtgtttagcctgacataaattggttttggtgcactaacctggtcacaaactgggcaagtttcactccgctccatccactcaagtatgcagcaaagatgaaaatgatgctcacatttagtcatagagcggggattttcttcatcatattctggtgaataacgaaaaactgttattacaggaattcaattgagattgaagtgataatcggtgtattagaggatcatcacagcacatgtacatcagaaaaggaagcaaacaatttatagaagaactcataaaatgttccactatttcggattctctatctacaaaccagtcaagtgttcaagccatcgttagtgtcgataatcagtttatatgattacagactgctgcgtattgcgtgtaatgcacgaaaacaacaatcataggcccatagcactgccagttagacagttacatatttggcagactctaggcattcttttcagggatttatcattatttcctaaccatttgtcatcacacccaactgaatgcatcttatataagattatgttctcactaaagtgaactgacctattaagcaaacaacagtgggaaataagagcagtaaagcatgcgtataccaaccaagtaaacatagtttaattaagatcctttcaaattgaaagtaaattatcctatgctcaagagaaacagaaccttcaagacagattgggcaaacatcctcctcatcaggcttatcttcagagacacatttttgcaatgactcattatcatccatcattaaggactccttatgttcatgaattttcctcttgatgcctgtcttctccaaatctacataagaatgtggaactctaagcattgatccataacatggagatcattaagcattgctcattctcagagataatcaatttttaccagggttatctttcaacactagaccaacatcataaggcaaaggtgtaggtggtgctcggtaagtgtcaggagtggatgtatccagatttttgtctattgcaacaattgtagaggccggattttgttgatgctgacaacacaaggtgaagaatatcagtatccttgagctaacttacatgacaagccaaggatttacagtagaaaggctgacgagtaaaagaagccatccccatgtcaacatactaataaaccgtaattctttaaaaatgtatgcaat

SEQ ID NO: 13783 - DNA, 989 bp, Oryza sativa
aagagatttaaaaaaaaaggtatttgaatctataggaaataggaagggatgtattcaggagcttgtccaactagaagtattatacaaatgaagcctagactgagagactacgaccaatttttctttttcacctatgttatgtatgatatacacagacactaactggattagaagtgaagtaacattcgtcctaagtttaaacaaaaaaagagctgatttttaatgtttggactttgaaccgaatgactgaatgatcatgtgaccggtatgtatatcgcatccaagcattttcctaatcctcctgttgctacttgctataaattagccaaagattggcaacaaaggtacaaaacagtgttggccagaacatttcatgtcatttgtctccttaatttcactccttccaccaaaaaagaccaaaccaatgtcgagagcagagcagttgctcattgtgcttccccatcaaatgacttctgccaaaccgactgaataagcatgagcttcaagagaggatccaccagggccaccaaggctattcatacatcgcatttatcatggttatctgcaagaaggtatagtcagcttacagcaaataaaggccatctattcctcaaataatttctttcaaagatggaaatattcaacttaggggctttagattaacagaaaaataattaataagaccatcagaacaatctcaaacatcaaaatttgtattctttagcttcagatcgactaccaacttcccctgtaagcattcagaatggattaccatacccaaaaaaaacaacctccatagtccataaaggaaatgacaacagaaaacacatccatgggctacaacaaaaatgtgtttagcctgacataaattggttttggtgcactaacctggtcacaaactgggcaagtttcactccgctccatccactcaagtatgcagcaaagatgaaaatgatgctcacatttagtcatagagcggggattttctt

SEQ ID NO: 13784 - DNA, 6612 bp, Oryza sativa
cataatcgttatgcaattttcaaaagcgtgatgccaacaaaagagagataacataattaataaagaaaattcagcaggtctacatacatagatataaactggtgctccgacggatgcagatcttgtcgatgaacaacagcaaccacccattctataattgttgaaagttacttcagtctatcctctagcagctgatatcactaaaatttcatctctcaaagacctacacaaaaacagtcttatattggtgcaggaaaaacaaaagtacatcatgcttagaagataaagtatacataaaacgagatgacaaaaaagcaccaatcagtacacatgtataaaactgtgcagagagcttagcaagtgttgttcccatgtggaattatagttaacgattggttataatgatgatgatgaactgatgatttttgatatctcgctctatcaaaaatatagtacttcaattttgacaactccacttaccgcataacatcaaaacctgaaaatcagaccaggaaacaggaattcatctcactagagtgtgtactacagaaattgaccagagggtacattcaggaaccacaacatcacatgctgagttccaccacccaagcaagatgacacaaaagatcatcctctatagattatagaaatgtattatgttttgtcctgtctaatttgttttaccacaaaagggtaaataacagagccagcagcccagcacatgaggataaaaaaatgtacatactatacagggtaccagcacatgagcccagcatatggcatactcatattgtgaataacaaagtgggataaattgacagatttaaaattatacagggtaccagggaggggttcagggccaaagctttaaagccttgaacaaggaaaccactttctattggacaagatattgtctggaatttgaggaagcctgagaaactcatatggagtaccatcttaaagtagtgaaatttgtcacatatagcatttagtgtcttaaagtagtgaaatttgctctgattacactgctatcgctgcaatcaattatgtgaaggaactaaaatggcttagcactagaatgaataccatgatgaatctagtccctctgtttcaaggtttcgcatagcaaaaaaaaaactagtactcagcatcagcttccctggcaactataatcatctgactgatagaaataaaaatgtggcaaggcaatgaaaatttcctgtttcctagcaaaagaaatccttttccttgttagcagtatctagaaaataaatcctgcaggcagcaagaacatccaattcgataatgataaccttggcattttacttgcatccatcttcatagactgtcatacaagttacaaaaccaaaatacgtcctatctctagataccaaaaaatcagaacacactgagaataccacagcacacatcagtgaagaacaaaaatgcagatcgaaagcaaaaacagtgcaattcgtcgttacagcgggaagctgcactgaatcaaccgagttgatccgatctttcaacacaattcgaccgcagaaagcaatctatgtataccagtggcaaagaacgcaaacaaacttgatctgatcgcgcgagccgtggtccgttcaactaggaagcaatcacaattcacaattaagagttaaaaacaaaaattacaaacttactcaccaagaatattcatagcgcttggattgaagggagcaaaaactagaattagtagtagtagtagtagcagcagcagcagtagtaggagattcacacggaaacaaaaggaagaggagaagcgggccaccataccagcgaagaagagctcggcagctgagcgagcgagctaggttggcgaacaaaccccctccgcctccctcctccgaactgcgctgcttcacctaaagagaagagaaagacaagatcgcgtgagaagacgacacaagtcagggagaaaaattcccccacgcgagacgaactccaaagacagacgccacccgcccgccccgtggatcgaacagaaggcggccgaggggaaagggtgatatcagtagtactccgtactactcggtagtagtggtccgtacccgaggacggcggcggcggcggcggaggaggaggagaagctgagccggcggcggcggcgagcggtggcgtgggggagtggaggagacagagaggaggaggatagttttgtgcactttcccctccccaaaatccgggggttgtgggccccgatatgaggaatgcaaatcggaagattcatttaagcccattcttttcttatatatatttctcttttttccttgattttcgttagcacgattttcaaaactatactcccttcatttcaaattgatctacatattttataggtatatcaagaccaagaaaaactaataactctttcatactgtatgtactatagcaacaaactcgatgcatgcatcatccccactattttctagccaatagcaaatcaaaatattgcatgtaggttataaatacttgtgtgcatggatgcatgcatcaatgtccatttactccaatgcacaaataatgaatagccttagggcccctttgaatcaaatgatttatgtaggaatttcatatgattcaaatcttataggaaattttcttatttggccctttgattcaaaggattgaagcttttaaaattgtatgaaattcctatggaatagcacattgcatgtggattttggagaaaatttagcaagagctccaatctcttggaaaatttccttttgagtctatctctctcatccgattcctgcgtttttcctgcgctctaatcaaacgaccattcgtacgtgaagaggaaaaaatactttaaaaacacgtaagcgaagtcgaactcctcacggaggataacaaaccaaaccagttgaataaaagttatatataaattaattatatactataatttaaattccaaaaacttatggcaattgttagatagtctgttctaaaactacaatttctacatacctttatttgtctttcaaattttatttattaacttaacagtaatgtataaaatatgtaacttatacctataaacaggtatatcatccacttccaatatcctaaaatataataatatgtagcattcaaaatctatcccaaaatcacttccaatatcctaaaatataataatatgtggcattcaaaatctatcccaaaatatgaaatttttttcacgtatgttctcttctcagcaattacaacctttccctactttgagttcttatattttgaatggatttggaaggagggtagtataagtttttatccatatttcagcttaaaaaaaacatggcgacgacttcgaatagggaactggaattgcatttaatttatctattgcatgaaattaatgaaacttgttactactttttatatacttatcctactttactgcatttacactttttattttactttgcagtaaaattgattgaatttaaggattcacaagctcatgtgtcagtgaattaaaatgatcacatgtgtccgaaacacaccgggataaatcctcattagttttatctaaatggttcttcatccttccataaaaactagacttattctatattttggttttccaaataaattagtcatatttgtttttcgtgtatctaagacttaatcggaacccttaagtcattttaatactcattggttgcatgtatgtatatttttattttctttgtgtacatgtaagatgaattattctctttgggtgtatttggtttggagacaaagtgggataggttagacctatcctagttttgtgggatgggatgattccagttgtctgtttgttttttggtatgggatgattatagttttctgtttggtagaaaggattgaggtgtgatgggatggacggatttgtactcaccgttagtgccgtctgggggcggaggagctcggcagcacccggatctgagaggagcggacggcgctcgtggagatggcgccgctcgcggacgagcggcggcggtagtcgcagatgaggcaggggtggtggtagtcacggaggcaaggcggcggcgctcgtggatacgcggcagagctcgccgaagtggtggcactcgcggacgagcggtggtggcagtcgcagatgaggcagaggaggtagcggtcgcggaggctctcagatctgagaggagcggcggtagtgctcacggaggtggcggcgctcgcggaggcttccggatctgagaggagcgatggcggtgctcgcggaggtggtgctcgtggaggcggcggcactctcggacgcgtggcggagcttgcggaggtggcggatggcgaggtgacgccgttcgctggtcccaggtgggacgagttcatccgccatatttttgcggatcggttgatcccgaatataagaggaatattcctcttcagggaccaacccatcccactcacccctaaaccaaacacctctaaaagttggttcaccacatcctatccttgcaattaaacgctacctttgatggttataaaagtgatgtgtctgactcttgaggatggagcaagtattatactatcgtagcacgggcactacccatcatgcacgcacacaatcacatgattcacatggcatatctatgcatcacacgcccaatagacacaggtacaaaataacaatgttataaatcaaacggaaattctctaatattgtcaagaaaaaaaacatccaaattcaaaatcctgttacaaagttgtgccaaaaatatcatatcagaggtaaattgtcgccaattttccaatgcatgactcactagcgtgcggacaatttttatttatttttttagacctttttatgttttaattttattaatagaccattccaaaaaatatttctaaatctaaactttttggaggcgtgacctttggaggcgtgaccaaataactctgtcacaccgcgtgtagcaggcatgacagttttgttctgccacgctaggccaaataacgctgtcacaccaacatgagtgatgcgacagtattgttttgctacgccagtttgactgacgtgtccaaaaggttcagatcttgaaaataaattttggttgggtttatttttaaaattaaaaaagttcaaaaaataaaaaaaatacgtgcaaacatataccacatttttcctcaatcgacaagggagagatctgaaacttgacaagcaagatttttttttaaaaaaaaattctttaactgtcacgctgcgcctgctgcgaatggcgtggtaatgttatttaccatacttagagggctaaaaggttcagattttggaaataagttttaaaagagtttattttaaaaattaaaaaacaatgaagttcaaaaaataataaaaattcgacaagttgagtcaagacttcctaccaaaacagctataataacatgaacagttagcacacaaactgactaatgaacccgaaaatttctgaaaattcatccaaaggcaagttaataattcagccatctagcactatctatttgttcctttcttctttctttccagggatttgcaaaaagttgttcagtcacttggattttcgaagagagggattgtggatttgaatgaatctaacttgcagctttctcaatttagtttgatgcaagcctcaagaggtctaacagtgtacatctagggagaagttaatccttgttagatcacagcagctgcaagataagcacgcctgtcctgaacaaactgctgccgaaagcgatcaaactgtccggttttgatcgtgtctcgtatcaaccggaaaaagcaaaggtaatgatgtgtattgtgtctgcaaattttgcaaaagcaaacaaatgtcacactcataattttataaacctactaaaatgcgtcattgaacttctgacatgacttacatctccagtagaatctgagccagcatctcatggacattgagcaaatgattaaggtaagcacgagtgtggttctggcatgtgaaacagctacagctatcaactatccttgacgtgtctttcctgaaaaaaaggaacatatgtccaaaaaaaaatatattctagatgttaaaaatgcttcaacatctgtgaagaaatgataactctaagtgcctaattgtcaagcccaaaatctcaactcaaccacagatgggccattgaatcaaacttaaaatagttgccgatcccatggatgggccaggggttcgggcttcccaagcaggcctatgttgcctaattgggctgatggattcacatcaacagtggtggttaatatttagtgtacatagaagtcagtgcttccacttttcatgtgcaattcaattttagttgattttgctagattcccaattcaaattcagaattgattgtatgacaaaatttaaacaaaatatccgaggagcatttcttccgcaaacaacaacaatacagttcaaacttatgactaataaaaaagtttgtatgcccaatatataactaaaatgatttcttgaaagtatttaactgcatccttactaattagtgtgcataataaaatgtattttatgcaatttctatagagcatgggacctaccgatatgtcgttgcacgcgggctgcagga

SEQ ID NO: 13785 - DNA, 2035 bp, Oryza sativa
gatggaaactaacagcacaaacactaccaagtataaatttgctgcatagtggacaagagacatcacaagcacctggaagaccaagcctagagacaactcgaggtttctccggaggcaagcaaccctgaaagaataaagtaaaatgtacagttgtacacaaataaattacactgcttgataaatttatggaaaacatataaaatgtatgaagaacaatggcttctgcttgttaactatgaagtacaatcaactgcaatctgagactagtgcaaatgatagtttggagtatttaactctttatgatgctatgacatgaaaacaggttagaccgttagatataaccattcaacacttccttcaaaaagagtcctacaaaatagtttgatgctttgtcatgtaaaatcaacagttgttgactcccagagacatctaaagtaaatgatgttacacagcctaaaaaaagaaagaaagaagtagatgatgtgacattgaagttgtgctatagtaatattgcttagtatggctcgtgtcagcatggaagttcataaaggttagtgctgcattattacttttgcctgacttcacttttgcaggttaacatattcatggtctttttacatgtaaaatgcttccttaacaaatgatcagaaaatgcaagataggcgtagggacagcagctttgcacaaataccatccaagattgacgaataaaaagattccaccaaccttcggtacataaaaataacagattgcatgtcaacaatacattaagggcattatagaatcaaatgtgttacagtgattactgggtaaagaatagtattctcaccactgcagcatcgagtatactgcaacgttcttcaggactgtctccaaagcccaaccctcctatccaaaaacctgcataaaactttgcacaaaagttcagtggatggaacatataatggtttatctgagtaatttaaatttgaagtatcatacagagtcacatttactgaatcgacaatggtgcaaagctgagcaaatgttatactccatccttgtcgtaagaaacaagtaaaaaggaagtataactactgaaagttaatggtgttgagtggtaaatgaaaataacctgacacattcctctttgacacttcagtggcacatagcttccgtagttctatactagatccacccacaactacacctaaagtatttgcaccagaatcctgcatggatcagtcccacaaaactaaaacattttcagtaatgtaaagcaactgcatgagcttgatgatgatattttattaacacatgtaaaaaagaacatgtgtatgataaagacatcagattaagtaatattacagagaatttacattttatttcttattcctgtagttttgtgacaagatacttgcactagaggccttcaagcatgtagcagcatctcaattaattacattagtacttaggttctctaaacttaaaattagtctgagaagtttcacttttgacataactcaaaaggaagtcataaaatctaaacagacatatggctaaaattcaggaagaaacactaaacacttcagctgaatatagattaactcatacctcatccaaagcaatacatgcatcaagccagcgtaatgtgcgctcaacagagactttatttcgtttctcagtaacccaagctggaacctcatctgccaaacttgcccacaaattaggcttcatgcaggaaatcaattccatataatctgatggtttaaccttaaaaaaattgaaggaagttgattagttgtacataaaaagactctaaacatgcatccacaaaatttggagaaagaaattactagagctaccaaccagtcttcggccagctggtgtctcaaaggaagcaccaaatttattgcttgcttcacttgttggtaaactctcaatagaatcaccagctgcggctatgaggatatgatcaggaagacccaacatatgatgcaaaccaccaatatttgatattgtttttgatggagggccttccatactgaaaaaacaa

SEQ ID NO: 13786 - DNA, 9792 bp, Oryza sativa
aattaccctgcacaagcataaattctgcactcatcagttagtggaaagcagggcgaaaacatgataaggcaacatgctcaaatgggtaatgacagtttgggagcacgttttcttcagcaatttgacatgcctagctaaagaaagatataatattcatcttaattctgtttcagtaagccctagtgaactgagcaataatgtacttcgatgcccataacaaccgtagatataaactttccctgacatcgcttcagtacaacaaattacaatagcaaagatatgtgaataaacaataaaatacaaaggttatgttttcacacacaaaaattgacctgacataagttggtcgagggcgtggatgtacgcccagaccacccaagttcaagccctcgtcgaggcgaatttgggtgcatgtttcttcctaatcaaaacaacaggcaacctaattcctcctaggttggtcgattttcagtcataatatccatcaactcaaatgttcgtccgtaaccattgttaagcttgtaaatactactgaacccattttctaatagtacttaagcatattttgcgggggattgcaattcataaccagagcagccatcctggtccatgcatttagcttgactgtgcattctcacttgaacataaatgtactcaaaaactaatcaagggttttatttgacaagtgggggaagaacaatccaaatagggattgggtcggtcaatccacctcccaaaacccaaccccctgaatccatcgtttggtaggaagctcaattgcaacctacgaacatattcagcgagcacaaaatttgccatccccattctgcctctctgccctctccctcagaccctcactgccccatcagcaacagctatggcggaaacaaatcggggaagggagagaagaaggaggagggagacgacggcgactaacttgacaaagagccgccacgccaccgccgccgccgccgccgtcgtcgcaggggaggaggacggggagtcggggagagcagcgacgagggttttgttttttctttttttttttttcctcgatggcaagtactttgtttagaaggcccaatttcagccctctggcccagattgacaggaatggaccgtgacaggaaaaaagtctaccgcacaccccttcgttatggatcgagttccgcaaagcaggtatagaaattcccctactattaaaaccaatacaaatcgattctctggatagcttggattacgatttcgttctacgtggtgcccaataaatttatgatacaaaactgggcactcaaagaaaatcacaaatggttttgtagttggggtttatggttgaggtacgtgaaagaactttgttcctactacaatgtaaaggtcaccactaatttcgcaatgggcgcccggagaaggtcacaagttgcaacgagtactcaggccagcataaaaatgttacattcaaacactatttctttgttacagttacaatccactaactacattaatcctatttatctttgaagttcatcctcatttaggttggttcagttggaaactactttcctccgcacgaaaaacaaaacaacatattaacgtatgatcaattgagtattagctattttttttaaaaaaaaaggaataatatgatttttaaagtagctttgatatataaattctttttgaaaaaaacgtaccatttagcaatttagaaaaacgtgcgtacgaacaacgatgtaggtagaattgggaactcacacaaaagaacacaatatacttaatgctaatttatcttctctcataaagccacatcataattatagttaaactttggatgggcaaattgcatcttttctcttcaaaaaccacaccatacaacataattatttaaaattttaactcatatatactatgttattacacaattatccgttactgccgggatacccatatagttattataaacaaaggagctttcacatttagctacagtcgaccattgcatcaaagtgaatattaagatatcagtcgtaataccaatggttttttaataaaggagtttagaatactgctgcaatgcatgagataaatgaggtcactcccaataaaagtttcattctcattaaatagaatgccatgtcaatatttttagtgatgtagcaagaaattgataaagaaagactctttccaatataacaatataacttgtctctacatgtatttcctaatacccctctcaaaataattacaattctaggttgtttagcatgtattaaggtttgataagaaaatctatagtgcccctcgttaaatggtatatagttaaagttaaaggtgggagggtggttaaggatagaataggaaaaattttgaaaaaaaaaagattgatgagataaataatactctattgtgagataaatttaaatcctagaaatataatcattatgagatagaggtagtacaaaacaaccaagtaagctattttaactatcaattaaatatcttaggagtatgtgacactcaaaacataaaatgaatcctcccaccaagatggcccaacaagcagaggtgtccacacgtggagctttattaccaacatactactatatactagtatggctaactatatgacatgcgcaactagggattttccatagagcacctgcttagaatgcggccattgcctctctttacaattcttcaaattgaaaagtgatatatagatgttctacagcttctacacagtaaaaaattctgcggtgctgccaaacgacaaaattctgcagcaacttataagtaatactaactagaagctgatcttattatacaaacaagcagaagctgtcttccaacaggttctccaacaaactagtagcagcttctgcacagctatgcagaagaatggtcccaaaggacacatcatatacaagctccaatagtatcactggtaacctcacgcagcacctgccagcaaaaggaggaagcaaaacatgctaaggcctcaacaaacagagaaaaataatcaatcaataaatggagaaactaagtgtaaggaatgttagatcaacaaagtacaaaatagatttaggcagaaaatttctgcaaaactacatttagcctaaacagagttatgggggaagttaaaacttcatctcccataaaagacgacatgtcgacatacatgatcagtcaatttcctgatatacgattgcaatctagcttgtatatagcattcttcatttgccaaaaaaaagaggtaacaaaacaaccaagctctttccgctaatggaacataatatttgaaataaaacaaatacggttctgttgttgcaacaagaactatcaaagctagtttaatattttcgccaggtaaaactagtttaatatagtctttgtaataaatttaacaggcatatgcaggattaaacagagaacaaaacacaaactgaagtaaaagcatattaatgtcagcacctgtggtataaaaggcggtgtagggataaaaagttgcagatacatcagcttcaaacacctttttgaactgcagtgacttgagctggacagcaaagacaccaactgccgtccatataaaaaacaaatcatcttcctccacaagacctaatatcctgactggaggccttctaaccaaatgactatccgtcaacggtacagagggcacttccagcggaaggactgcacccaactcaatggtcttgcgcagcacccatcctgtaacgccccctgaattaatctccaatgcccataactgaaggttgaaccctgtcatggtagccagacctagcccaccatcctctgccttcatgatatggacattccttctgtatacactatgtgtttctggtggacactcaatatgatataatctagaagtggccagctcgaatgcaagaatatgctttgacttaagtggccaatatatgacattcccaacaagaatgctaggcctggaatcaacctccgatggtgctggtgaagatgccatcatgtcccaggtgtccttctctgacgagtacctagagatataagcatagcctatattggtgaatacccatactatgaagaaggggcatgagctgcagtcaccatggtcattgtggccagctgcgcaaagcaccgcagcatggctctcgggcacacgtccataattgatacgaggattcacatcaggtgtaactggtacagcataccggttgccagtcatggggttccacacttgtagactattccagcttgagctaatgaggaggacacggctgtggcggcagccaaggacatgccagtaggggtcaggtagggagaatgctcctaccgtgacacattcaggagggttcccaatgggtagaaagcgagggatgctggtggaattggtgaagatgccgagaacagggggtgtttgatggaacgcacgaaagcgcttgataaatttgttatctctgatgaggtagcgccagtgcttgcagacaagggatgcacgaaggaggcacgtggggtgttttgggaggtgaagtaagatctcaataagggcatcgtctggaagcatgtttgccatggtgaggaaggatgggcaatgcaacttcaacttaaaaaagaagcaaaaggcgcattatttttttttaattattgtcaccaggaaacaacctatactcaatgccaaagatggaacaacattagcaacaatggtgacaagatgcacaaaaaacccgatagctgttcaagatcactccattaccttagatcctagtattttgattagcagcggtagttttggcaaaggtgtgatggtttccccggctatactttgcaatagccaatatctgaagtttgctatagtctatagaaacaaagacaacggtatatatcattcactgtggatactgacttctgctccagcttttattgataagaaaaaagtgacctgcacaattgtacacgaataatttcagctcttgtcattgagcattgacatttccttgcaacgaactacttcctccgtttcacaatataagactttctagcattgcccacattcatatagatactaattaatctagacattattatatgtatagattcattaacatctatataaatgtgggcaatgctagaaagtcttacattgtgaaacggatggagtaacaaataacaacataagcctatatcaagctactaaaaaaaataatgatgtcacaatccgtccatcttttcatgcctaccgtcattcaattcaggaaccatggctacaagtttgcgtacaaagcatagttgccggtgacagacacaagtttgaagtaggttattatacaatggtgtgtataaggaaaatggaaattagtgagggcaaaatcagtacaatgtggttagaatagccatccatatatattccttaacccaaaacattgttgatttaaaacctccaccctaaatcaatactcaaatcgaggtcatcagaatatactagctagcaccatcataccatttaacttacagctgaaacaaagcaatccccaaagtaagggtaaggacggatctagctcggaggatgaggaagcgctacgagaggagaggacgaggaataccttggattcgattcgacacgagacgcaggtcggtggaagaggccaggtgcagctagcccctcctcgcccgccgccctccgcgagagtagagtagggctcactcacaggggagggcggggactcggggaggagaggagccccgccccgtccacgccgcccgcgcgcacggtcggtccggcctgctcgccggcaaggaggcgaagcggcggaggggaggagtccggcggcggcggcggcggcgggcaggggcagtagctgcagcagtaggagacggagagaggagagagagaaatagcccaacaaggcaaaaaaaatcggttggttacacgtgtgcgtgtcagaacactcagcagaacacacgagggagtaccgtacgatacagaaaggcttgaacacagtcgaatctaggattcggatcctctgcattagagaagctaacagcaagtttaatagtatagcctattattagctccaattaatctataaccaatctaatagctaatttatacaataattgtttactatactattaatattggtcccacctgatatacatacattgtgtcttggagtctgtgctgtagctggctatagatctgtagcccgctgctcttctctctcatcgtttatcttattaaaatatgtttatagctggctattgtatctactctaatgcagagggtggcattagctcctatcctatccatccatccaatggttgcggctagttctccattagataaagcaaaaaaattaaatgggccttagagcaagtttaatagcatagccaactactagctccaattcatatatagccaatctaatagctcattcatacaatagttacatattacactattaatacctggtcccacctatcatacacacataacgtcttggagtctatgttacagcttgctacaaatctgtagcccgctgctcttcctctcctcatttatttccttaaaatatatttgcagctgtcttatagcctgctattgtacctgctcttagaggaagagcagcagacccatgttaattttagacgctaaaacagagcgtgactcctccttttccctccaatttcttcaaacttgcctcatatgagtcttttcatttctctctcacatgccatacctctttcaatttctctcaacactgaagtggatttagcaaactatattctgttcattattggtatgcacttattgctacattattgtgcagaatgattccagtgcaggaaatctatttggtggaaagcagtgacatcggagaggtggattttatgctgctctgcatattttggtttatggattataatattattttcttcctccctaaaatacattttgtacttaatcagggtatactgttatttccctatgtgaaatgccctttgtacttactccctcaatcaaccttgttatttttttttgagaaacacagtacaaatatagacgctcacaacatgcacacacccacttctatgaacgcacacacgcaaaccctaccagtagttattatgaagctttactttggtttgtgacacaagtcagtgcttcaaacatgcaagaaccatgaacattcagacttgtagccatctcttccctgtcaaaatatatgaacagcataaataagaaagaggttcactaatcacagccgttggatagagatggatggacaggattggagctaatgccacactcttcattaacttctctaatgcagaggatccgaatcctcaaatctagattccagggttcacgtttcggaccaaaaccggtgaatgggtgtggattaacctgtgacgtggattcagatatactctttgttctaaaaaaaacaaatcctgaaaataaatctggacatagccctacgatttaattttttataggacagatggagtagtcgtgttggcgcaccacgcactagaactcagcggccctacggcatatttgcgaatgaaaaataacctatgaataaaatttttatgtacgtgttcttagcgatataaaaacaaaagttgaaaaataaacatcgatgaaaaaactccaaaatcaacctcaaatttaatgttaaaaatttaaattttaactgataaacataagcataagcgaaaagatgaagccgcttcagtgtgaccttctccctctacgttgataatgccagatgatgatggctgtcttctttgactgttaccatacaaatcaccactgatatcaacttccctagtcaaaacagaagtaaaatgaacacttacaacaagtaaaagtccatttataagacaaacccacccggcagcaaggataaacttttctcaagcctgtgcatgcaaccatgataaacttttctcctaatactctcaacatatcaacaactaggatgatatcaccatatcagcctttcaggttttttttggttcgaaacagggataaactaaccatggtcagtttcttgttgcttggaacagtcagagcagcagcattgcatcatgtggctgaccattatgacagctgtgcaatattggtgtccaacagtacaagctaagtagatccttcaagtaaaaaagaacatgatacattgccatgaacattatcaagtacatcaagcttataatccccaggggagcacctgaagtttacagcagcatgtgcaagtggcacatatcaggtgccagcatatagagacctcacactgctacacgccatataaaagattgtggaaaacacattcagtaatctctgctcccccaattgaaatgcctcagatgatctatcagataggagtatcatataaaccagcagttgaagtaccatacatgcatttgaggagcacacaactgattaacaaaagcattcatatacatgctcagagtcagtcttataacatgtctaccaatcccgacaggactattattggcaagaggctgaaatgttactagaaaatggtcgtcatggcagcatattacacagcaagatgtaaatactctctttgtttcaatattgaagtccaatcatcttgctggcctttctcaaataatgcaaccatctagcagcaagccagcaacaagagagaatgaattagtccctactataaaaatattaagatatgaattaaaaggatggatccatctaccactatgtgtatgcactaggaagtcaagctctgtaaaaagtgtttgttaccaggtttaactatatccttttttggtgtttgttctggggggaggggggggggttagaattgaattgaactaagtatttaaagaataactcttctaataaaaggtaagggtatttcgctatacataagatacatgataggtgcaagataaatgctagtaataaagatggtttctcaagcatttaaacaatagctcttctaaaataaagttgagtactttgctgtacataacatgcatgataggtgaaaatgattaatatggttccgtaaattttcattgtcaaactgaaactcaaaacgtaacaatagtacaagtccctacacttaaaaagaaatatagcagatctacacgtatttttatctgatatgaattacagttcggcattcaagtggtagtgtttcaacttttcaacagccaaccaaggtaactactactcagttcattacttgctagaatcacgaacagatgtacctgtcaaatagaagcttgaatggggataaacccaatgcaacctctccatagggagcaccagcttgaactccatagtatcaagctggagcatgatgacgccatttggcgtctgtagaaatgccacactaccatcctcagtaaaaccaagtagcccagaccacgctatcaatcgatcaaaaagcgcctccaattgccgcaatggtggatgaggaggaggaatgaacatgcacagtttaattctcttcctcatcacccaactggcagtgctatccgagtcactcttgcgcacccacagcttgaggtacaaaaatttcactgcgccgaagccaagcttgctaccaccctcagccagcataatctgcagactccaattcggagccggaaaatacataagatctgggccagaaaccacattcacagccaagctcttggcatccatgttgaactcaaggatgcagttctccacgagcagccagtagagaacattcccaacaagaacaggaggcttcatgtcaatggcagaaatcttttcccccgagatgg

SEQ ID NO: 13787 - DNA, 12281 bp, Oryza sativa
  unsure (1)..(12281): unsure at all n locations
ccgggtcggagacgaggcggcgccagcgcttgcagaccagggagaggcaggggagggaggaggggtcaggcgggaggatgtggaggatctcggccagtacgtcgtcggggaggatggacaccggcgatggctcgtcgccggcgtcgccgaggcggcggcggcggaatgggcttggcaccggcggcgggtccatgacaaacagttgtggactcgaatgggaagttctcttctttaggccgggtttagtccaaaataattctttaaactttcaatttttccatcacatctcaatttttctacacacataaactttcaacttttcaatttcaaacaaactttcaatttaatagaaaatgagtagaaaacgaaattagcttgagcaagtttggattccgccaaaattaaaggatcggagaaggctactgcttgtctgcttgagcgcgcgctcacgacggggacagttaaccaaggttgtcattatctgattcgtatagtagggtttgtttgggacggataatctggtaaaagctcgtggcttttagtttatcttatggtttttataacagaatctgaaaaaaaaaaatttagggagagcttataattgtgagagaagcggtagctacctgccttcactaaacaaacccgctgccagtcttcactaaacagacccttagtattttacgataataatatcctatcaagctgaaacataccgatcttacataatattctaacttttatagtatcccaatctccacacaattctataaaattttaggtagtatctcgatgttagattcctacaatcctataaaatattatttaaaataaggtgattgaaaatagtgtaaaaaatatgctcaaattcacataaaaaccgattaaatttatcaaaaccaatattatattatttaatttatacaacatattatatattttatataaaatatgtatttttaaaaatctgatagtatcttgaatcccgatcctatggtagtatctcgatcctatgatactacaaaggagaaagtccaaataccccccacctcaaaaaaaatttaataaaattggatggaagtccgtttagcattctgaactttgaaaccagatattgaaccccttaaattttacaataccgtttatataacccgctaagatggtttcgcatagtagtttttatctaatttgtatataagtttgatgagtttgatcacataacatacatattggacatatatattaaaattccgatctaaatctttcttttactccttgttagctaccatttacaaacaagtactaacataataattgtatggcataactatataaggataaatttgtgatttagaactgatgatatgcaaatatgttagattagttattcaaagttattcatttaagctttcaaaatatgcaaaccaccatccaaaaccatcttagggtaatatggatggtatggtaaagttcagggagttggatgtccagttttaatgtttttaatgtttagggtgctaaacggacttccattcaatgtttaggcgactatttggacttcttcctactacaaataacaaaacggtcttatataatatctcgatactgattaccttgcatttaaatgttcgctccgtccatacaaaacaaatataattacatgatatggcacaccttatgtgaagcctcacacttttaacactggagataaaaagtgccgaacttagattattatttaacaaactattattttgccaaataataactacactggagataaaagtcaggcaagtctctcttatgatcatgtttgtcgacgtttgatgtcgcaattccggtatttgcatagtatgggaatcgttggtactaggatatacgcgagattgaggtaaaagagatggagacaggatttttatacaggttcaggcccctgaattgtcaggtaataaccctacatcctgttgcccgaagccgatattactcttattcaccataatcaaaacagtataatatttggggtagcctatctaactgttgtcgatacggcggtctgaaggtctgactcgtagtcgacaacagggtagtcttcctcctcgagtccgtgcccgacgagatcagagatagcgctttcgtctctcttgacagtatccggagacaccgtaggggactagccgtgcttatccccgaagtcaatatccgacgtcttgtcttagcgtatgttggcttgtatgttgtgacttctgttgttccttgtatgttgattgtctcttctatggtgggtgtcttatatttatacccataggtgtccccttgtccaagtagaactatagaaaccaatatgaatacaatccaagtagtccttgtcgtttccatgtagaactctggttgtctttccttatccggaactccctccatatccgaagtcagttcccgtataagacatggtatgtggtgggtcctaccaagatttagtcaactactattaggtatgtggtatccataatcctgacaatgttgatagatgataattctatttcaacttaaaaacctatttcataaaaatatttctcctagtattgcatcaaaatatattttctagaatataataatatgaactatgatgatatgattgacaaaccgatgatgatagagatcattgggatactagtatggtgggtagggggagctcagggatatgatgattgatgatgatggccggtcagggctctccctacatacggtgtataaatataaggactaatcatcccctcactcgtatcagagaaccatatgtaccgtgtcgaccatagatccattttaagacgggctggacctagtaccttatcaagtttattatactctacatgggtacgtagtagtaggatgggagatgatataaacctcatgaatgccgatgatgtgcattctaggtgcatatagtagcgcggtggtatggagagctgataggctcaacacaaacatggagtgtaataaattgaagtaggggaaaagttctgtactcttagcatggtgccgcatctagtgaagtgagacagtcaaacatgttaagagtatctatgggtacaatgatacaagcctgcgcgatgcataaattgtgattcacgcctgtctcttggattggagcctaccgggagttgctacaaactctattcaatgttacgagtatactctagcttttatacgcttccttccgaaaactcttttacaaaacagaaatatactttacttttgatgacgatgaaggtgatgatgttacaaaagtatagtgttatagtatatagatttaggggctgctcagattgatgccattttcaatcatactatttttttttggcaaagttgcaaaaaaatgtctacatttggtttgttgcaaaatttgatatatacataagaaattctaccaaaattttggcaatattgccaaaatttggtaaggtttattttggctacaatctgaacagatcttatatattattattcatgcatatacattttgctttcaatgacttgctgagtacgaaagtgctcacccttgttgtataacccctttgtacaggtttgattccttgcaagtgtaagatggattagcgatggcctttaggactctcagggacgaattaaaaggtagttgtaactcactactagaaaaaagatttttcatagcgttacattatcattttcgctgacggtcatacacgaaaaccatcggcaaaaacataacgaggggtgggggggctacggaccgctagcgattttcgctagcggccgagttaagcggaccgccagcgaagatgtgctattttccctggcagtccactttggtaaagagcaccgctgcaaaaaatccaccgcccaccaatatttttcacgcttctccgcctctctccctcctctcaacgcctcgctaggcgggggtccaggggcagtgactcgcgaggcggggtgtccggcggcggcgactcgcgaggcagtggatccggcagcgccatgcctcgccgtcgccggatccgccgtcggcacgccttgttgccgccatatctcgtactaagtttagtttatagggacaatgggagtacacaaataaattattccatggtcaatactcctcaatatggtttgaggaggtactagggtccacttaaacactacagaaaaaaagtgtgaattaagagttgatggtaagtgttttttattactcactccgtttcaggttacaagacgttttaactttggtcaaaatcaaactacttcaaatttgattaagtttatgcacaattatggtaatatatataataccaaattagtttcattaaatcaacaattgaatatattttcataataaatttgtgttgagttgaaaatattttttttcctataaacttggtcaaacttgaagcagtttaactttgaccaaaatcaaaacgtcttataacctgaacgggagtataagcgtttcattatgtctccgtttagaaaaggtcaagcggttaccattggtattgtcttgcaaagagctttgccgtctaattctccgaaaaggattaatgcatcactggttatccaaaagctgattataagccataatagcttattagcagaaaaaaaaagtaatctacgtgtaaaactcttgtatatgtatttttagcgacttaaaatctaatgccaaaaaacaatgttgaaaatattttaaaatcaacttcaaaactaaattttggttttcacttattctttttagtaatcgatggggctgttagtcgaaatctactatgtaggtactatgttctatattcttattatgtatctccattctccactcgatgtggccgggaggcgcccccaacagatttgccccatgctggaaaatagataaaccacatctactcataggaacacgctctttgttcctaccatcacgattgtgcctagtgtcaacatcagcaaaataccttgagcaagcagtcaagcactcatttgcgacatatgcctctgcaatggagccctcaggccttgccatcttcctcacaaagcgtttcaaggtcaacaacctacgctctacagggtacatccatccatattgaactggaactcttaggattgcatcatcaattaaatgaatgcacaagtgcaccatcacatcaaaaaaggcaggcgggaaaatcttctcaagcttgcacaatattattgggatttcacctctcaaaggaaaatgccttagaaccttttctggaatctgccttcggctatctgcatccctccatcttgaagcaccacatattgggcatgcatccattttagccaactcctttcggaaaagaacacagttattcggacacacatgtattgactcatatccaagtcctaatgcacgaataaaattcttcgcttcagcataggatgcagggagagaacaatttggaaatgctgaacttaaaaggtccaaaaaagcactgaatgcaacattgctgattctgtaaaatgacttgatgtggagcaacttcaccacaaaagaaaacctagtatagggaccaccggggtgtagcacctgtttcatctcttctaatatggtggcaaactttgacttcgttcttggtccatgattttgatctgggtacagatcctgtaccatacggtacatttgatcatcttctgggtcatcctgaggctcattcgtctcaaattcaacattgcagctaacatcttcattcaaatgctcaacattttcagtgaccatgaccaatggttctccatgatgtatccaccgagtgtatgtgttagacatcccgtacataagtaagtcatcctccacacgtcctttatattgatgtaaccattcaaacacttacgacatgggcataatatcttctgactgccactcaaatttttagaaacaaagtccatgaactcggtgaccccctccggatgctccttgctaaacaacttacaattcatccaagttctttccatctgttacatattgaaataagacaagcatcgaatcaatgactgattattgcccagactactattttcctatttctatcacttcaagtctgtggtttcagttcaaaatttaaaaccaaaacataagttcttctcatatgtacctttcttcctaattgaaggggatggggcagtctctggtcgacctcacccgccgtctgaagtgatcccaggctagagctcttgggggcttcctagcggttgagcccgtgaagcccggcggccaggatctgcagccagccggcccagccgtcgagatcctagaggcgggggcgggctactgtcgtcggcgtcgggctcttgggggcgttcccagcagttgtgcccatgaagcccggcgtcctggagctgcagcaagctggcatcgagctcctggggacggggtggggcttgggatccagccggcggtgccgggctccagcagccgcgttgggcgaagggcgacagcgtcgagctccaacagccgggcgctacgttggggacagggtggggctacagcctgcgtcgtcgggctccagcaggagcaatgggaaagggcggcggcgtcgggtccatctggcgcgatggggaaagggcggtggcggcggcgtcgggtccagcagccgcgatggggaaagggcagcggcgtcggtccttgccagatgtgcgttgggattcttatgtctcccagcaatagtgtacaagatgaaaagaatcaaagattacatagcatcggaagagtagctcagtggtttgtttcattgtttgtacttgggaagccagaggacgtgggttcgattcctcctcattgcaagaagtgctacaatttttattcttttcaagttaatattacattttttattcttttcaagttaatattctaaggtcccacatgtccacctagacatgctcacgtggctgtgccaaggtgttccttttttttaaaaaaaaaatgatttttaaattatgacaatcatattcattcgcttttgtcatgaactattgtcacaaagaatgggaaaggcacatggtgacatttgtttatgactaaattacaacttagtcacaaacgcttgtcattcaaagaaaaattgtcataaacgcatcactactgtgactaaaatgtgttttgtcatatgaaatttgtcatagaaggccaaatttcttgtagtgcggtggaggtatgtttgaagtgtatagtggcaaagttgacattcggtgttatttagctatccaaattgctagtctattcgttgtgtacatttacacgattaatcaggcaaagaacttacatttctttagaggctacgacctcgaaatgattacacatcggttcacattgatgaagcccataaaatatatttcatagatgcatatatcatataaattttgaacggttggatcataatctaaaggctagattgcatccatgtttcctacattcttttaacgaaccggtatacgctggtggagaaaccctttgtagtcccggttcgtaacccccctttagtcccggtttccaaaccaggagtaccaatccgggactaaagatcgctatctttagtcccgggtgaaataaccgggagtaaagattgatctttagtcccggttggtgttaccaaccgggactaaagatcgagctgaccttttttttttttgcatggccctgttgctgcatggtttatatatatatatatatatatatatatatatatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcatagtagaattcacccttgggatcaaggatttcttcgttgatgaatgccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagctgcacaagttagttcctgcttttgctttgcgcactacaaataaatgacaaacaacgagagatctaattaatataaacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttgtggatattggtcgagcattgcgacgtttactttccgagggtcgatgaatccagtatcgaaaaccctccgccgttgggccctttgaatctccattctacaacgataaaagggagtatattattttctatagtctacttatatacaaggacctaattaattaaaggagacgtatagtaagaaatctaactgaacgatatacttacaaaatccaacaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcaacagctcaggcttgacaagcggtttaccgagttcgtacatgtatttcacttccgccttttcgattggtgcgactcctagcaattgatccgtagttagaccggtgtcagtaataaattgttctatcgtcatttctttaccggtcaccaacggctcgatctcctggtttggttgctctccaagctgagggactggtttggactttccagaagatgctttcttcagcgttcgctcatagtccgatagcttgatggcctccttgacagatgcagacatacccctgaagaagttcctgacactggggtctataggaatcttcttttctggacttcgaggcttgaattgtctcttgacttctgatgcaacgtaagcgtcaagctcctcttgcgtgcaatcgtaccccgggtccttgttcttggcggcgtcaactttcgccttcttcgttgcccttgtgtgggcaggcggtggagctgggggggcccttgactttgaaggtgccggaagaggagcttgcgggggagtaggtgtaggagcacgaggaggagtcggtgcaggatccagaggaggagtcgatgctggagcctgaggtggagacggtgctggcggagcatgaggaggagacggtgcaggatcctgaggaggagatggcggagccggaggagatggtgcacgagacgccgcttgtcgcccagggaggatgatgtaccgcctgcgccatagaataatggcatggcatgtgtctcgtagatgcgtctcaccgtctcctccagggtaatccagctcgaggtcctcgtacgcgccttcgaccaactcaacttcgaccttcgagtatcctgctggaatcggcctgcagtggtaagtacctgaagggtccgttgggatggccatgcccgacgccaccttcatgttgtgagagattatttattagtaatcaacatatataagcagcaactagcggaatggctaaatcttacctttattgataagttcttgaaaggaatatgcagctcacatggtgtccgctgagtgatgtcatcaacgggacaggtcgattcgtcctgtgtttgcatggcgtccatgctctgtgatcctacctgccccgttgaggcacagctgctacggtttcctgacgggctcaccattgcaggaggaatggtcggctggggatcatgggaccgatgtgcggccatgcgttcatcaaccttccttgccacctcctcttgcatgttgagttcgtagctcgatacccgaaactctaggtctgcaatcttcgcctcggtatctctcttgctcctcatccgactccggtacgtgtggatgtcctccttgaaaccaatcttccaaggaatcacccctttccctcgtgttcgtcctggatgctctggagtctgcagggcgagtgtcagctcgtccttatctctgtctggtcggaacgtgccctgagaggaggcttccactgcatctgttagtcgtcgcgcagcctctcgtatctgatcgccgaagaccagtgagccatcggctgggttgagcgttccaccgtgagcatagtaccagaacttcgatcgtttcggccaattggctgttgccggttcgatacccctctcaatcaagctagcctccatctgctcccacttcggcatcgcgacgctatagcctcctgaccccaagtggtgatggtacttcttcttggcggcattttctttgtttctttccatcatcgcttgcccttgttcgcctgtcttatatgcaacgaactcgtcccagtgatcccttagctntgggaatgtgtcgaagttcagtgtctgccccttcagtatatacttctggtacatatctcccttgaacctctgaaactgtcctaccattttcttcagagtccaccttttcactttgtcctctgtacccgcaggaagggtgaatgtctcgagcattgtggtccacagcatctctttctccgaatctgggacaaagctctcatgatctccgcgtgcccttgttcttcgccagtacaccatactgacaggcacgttatcccgcacaacccaaccgctgtgacgtacatagttcttggcggcttcggccggggcactaggacgtccatcttcttccacttccgttatgatgtgccgaccctcaagcttcttcgctgcacctcgttgcccgcgtgccctcttctgtccaacggagggttgactaccactagcctcctcctcctggttcccctccacatccctttccacgtgcccctgctggttcccctccgcatccctctccacgttcccttcctcgttcaagtactggtttggatcctcgttcccctcttcttcattccagtactggctgcttccctccgcgattgtatcgtacaatatctgttcctcatcgcggtcagccatctgttgatacaagaaacatctgctaagtcacgagacatttatgttttaacaatctaagtcatgtatgctaagtgtaaatgtcgtacattagaaccctacacaaccttacgtgctaagtctaattacaaatcgtgatataagctaagtctaggtgacgtatattatacaaccctagctagtaaataattatatactaagtctaattacaaataaaataatcttatattaaaactcaaataatattacatgctaagactaaaatagtcatgtgtatgctaagtgtttcgtgcgtatatgctaagtctaattaagactacaatagtcaattgctacttgtcgcaccaattccgtagtcaataattacatactaagtctaattacaaataaagtaatattatattaaaacttaaataatattacatgctaagactaaaatagtcatgtatgctaagtgtttcgtgcgtatatgctaagtctaattaagactacaatagtcaattgctaggagtcgcaccaattccgtagtcaataatgtcatactaagtctaatttgcaataaaataatcttatattaaaactcaaataacattagaacactacacaatcttatatgataagtctaattacaggtctaataatcttaattaattgcattacaaatataacgatcatttatattattacgtcacttgcctgctccaattccttctagggctagcgggctgcaggaa

SEQ ID NO: 13788 - DNA, 4047 bp, Oryza sativa
gagacgacggcgagatacggcggcgtcggcgcggggatttgccctaggcagtggcggcgaaggagagaggccgagagagatcgatcggccgaaaacgtctaagtgttggtgaagaagacgagggcgcactgggagaaccacttgacgcttaggctcatcaggccctctgcccttctttcctttgctagacatgtccttcacgaaaaagacttgcgttacatcattggcaaggacaaaaggttcgtccgagtatccaaccttgttaaggtcaacagttgtcatcccactgtcatcaatcattacgcctccaccagtcaacctaacccattggcaccggaacagaggaaccttgagaggaccatagtcaagttcccatatgtcctcgatggcaccgtaatacgtgacagttgttccatcgtgtcccatggcatcgacacgaacatcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcgttattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccagatcgatgaccttctgcgaaattgcgttcatgaatgcacatagctttgttattgttgcctggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctttgccttgctaagagtgtagctggctggactcaagtaatggcttcctttctcctttggttccgggtgaaggtcgtcacgttgttccatatgcttcaatcattacgtgcttccagtgtatctttcgactttccgtatacacctaggaagccaagaaggtttacgcaaaggttcttagtgaggtgcatcacgtcgattgcgtagcatacgtccaagaattcccaatatggtaactcccaaaatatagagttctttttccacatcgccgcgtgaccatcttcgctctctatatgctggcttccaggcccctttccgaacactacattaagatctttaaccatagcaaacactgttttcccgctgcgatgtttaggcttcgtacggtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcatcatgtttgtcctcgtcccacacggggacaccttccttcttccacaactgtttaagatcttcgaccagtggtcttaggtacacgtcgatgtcgttaacaggttgcttggggccttgaataataatcggcatcattatgtacttcctcttcatgcatagccagggggggaggttgtagatacacatagtaacgggccaagtgctatggccgctgctcatctctccaaaaggattcatgccatccgtactcaaaccaaaccgtatgtttcgtgcgtcctttccaaattctttaaattttctgtcaatgtttcgccactgcgaaccatcggcggggtgtctcagcatcccgtcctgttgacgctcttcagcgtgccatcgcaacattctagcattccccttgttcctgaacaaacgcctagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcttcttcttccatttcaacaccttgctctccgtgggatgtccaataattatagcttggaatgaaccccgactcaaacaagtggaaatgaatagtcctggatgcagaatactccttctgattcttacacttattgcatggacaacaaataaaacccctttgcctactagcttcggccactttcaaaaaatagtgcacgccgtcaataaactctttggaccgccggtcagcgtacatccattgccgatccatctacatgagttaaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagaaaaaaaagtgtgcaaaacataggtgcaaatgtagtatgacaaaaaaaaacattggaggatgaagttgcaaaccttttaggcacctctgatttgtatgtaatcaccaaaataaattcaatagaaattttggcatgacctcccctcttttttgaagaaattttgaagcttgctcgggcagctggaggaggaagaagacatatgtataggggtgtgactttagtcccggttggtagcactaaccggggctaaagatcaccgggatctttagtcccggttggtgctaccaaccgggactaaagtcacaatctttagcctctgtcggcgtcccccaccggcagcccgagcacgcgtcaaaatttcctcagggaagaggggaggtcatgccacaatagctatcaatttatcttggggattacatacaaatcagaggtgcgaacaagctttgcaacttcatc

SEQ ID NO: 13789 - DNA, 19213 bp, Oryza sativa
gagtcccggttggtgttaccaaccgggactaaagatccggggggggcctgacaggccctgacagcattcgaatcgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgtatgtattcagaccctatttagatgggactaaaacttctaagtctcagtcacatcggatgtttggacactaattataaatactaaacgtagactattaataaaacccatccataatcttgcactaattcacgagatgaatctattgagcctaattaatacatgattagcctatgtgatgctacagtaaacattctctaattatggattagttaggcttaaaaatttatctcgtgaattagttttcatttatgtaattagttttataagtagtctatatttaatactttaaattagtgtctaaatataaaaactaaagttaagtccctaatccaaacaccacctcactctctctattctttcctgattaagggtttccattagaacgcttttgacaccaataaccggtgcccgttgaaaaactttatatatatatagattgcactaaaatatcaaataaatctatttttttagtttataataactaatactcaattaaaatgatatttttgttttaggtgcccttagttaattttagtgctgatctttccattaaaggccgagtttagttctaaactttttttcaaacttttaactttttcatcgcataaaaaatttcctacacacacaaacttacaacttttctgtcatattgtttcaatttcaaccaaacttttaattttatcgtgaactacacacactgaaaaaaagaaatctaaatcctcatcaatctcgaacgggatgcgaatttcatccgatttataaccgctccaaaacccttctagaacgtctcgtcgttcaaatcgtccgcaccaaaaacccacacctccttttccttcttcctctgcaagcaaagcaacccggtcgaacaccacacgccgcgccccctcctccactcctcctctctcctccgccgccgcggccatggtgctcgagctcgaggtccgtatgccctccacccctcccctcccctcccctccccatttcgtccctcctctcgcttccccccattccgcgaggcgagctctagccgcggcgagcccggccgctacggcgattgaatttctgacgggttttggaatcgcgcgcggtgcaggcgacggtgatatgcgtggacgactccgagtggatgcggaacggcgactacccgccgacgcggctccaggcgcaggaggacgccgccaacctcgtcgtcggcactaaaatgacggttcgtttgcttgcttcgctgcctccgcttacgcggcgttggattggattggattggatcttttttctttttgggtggggttttgattccgggattttgggggcgtcgtgtgcattgcagtcgaacccggagaacacggtcggggtgctggccatggctggggacagagtgcgcgtgctcctcgcgcccaccagcgaccccgtcaagttcctcgcctgcatgcacggtgcgtgacttgccccctaattgccatctaattctgtgattttgcctgtttctccaacgatccagaatgtggggtagttcattggtcaatccatgatcactttggtttggtttgttgtgtttcaggattatcagttcagataaaatgattgttggttaatggttgagatgatatattgatcaatccatgatgttgtttgccgaaaatgtaataacgattccagaatgtgggcattgatcaatcctcttttgtttggtttgttgtgctccatcaggattatcagttcagatagaatgatggttggttggttagagtgcagatagtttattgatcaatccatgatgttgttacttgtttgccaaaaatgtaataaggaattaaggacactgatcacattttttgttagtagagtagcacgaaggaaccattaacttagcttatcctcctggaattcaattatgaatatatagtcctgtcttaagaaatatacacaccttctgatcggcgagtcttctccaggatgatcagtttagatagaaatgatgttggttagcgcgcagtcgtagtttactgatcaatccatcatgttatttgccaaaatgtgacaagcacactgatctctttattttctaaggtagtgctaagaacactctaaggaagcattaaattagcttatcctcatggaatgcaactctgaacatatgttgtcaggatcactgagtctaatgtgttcagtgttcaacgaataggtaagaagaaccacgacgagttgtcgtttctgtgttgcttatggaatatgttaatcgcattttgttgtacgatttggctaaattcatgcaaagaaacaatgcttagacatatctggtgtctcccctgtatggtccacttgtttgtaaaggaattgtggtaataattgtgcatttgtactgtcataaactcatcacctatatttgctttcattttgatatgccattctaaaagtattatctatattacaaggaagagatgatatggatgtaatgagaaccacaaaatgttaaatcttgttgtgatcgatcaaatacttgatagttgttaacactgctgctttaaagaaatcatgtgtcacatattcctataactgaaacactttttatggcagggctggaagctagtggtgaagcaaatttgactgctactctaaatattgctgaactggtacttaaaaatcgtcccgacaaaagactgagtcagaggatagttgtttttgttggcaggtaccgcaaaaaagttgcatgatagattctgttccaaacttctcctatcacaagtctatgttgatgtgaattggatgccgtgtatttgtgactggagggagcaataacaatctgaaatttttatttgagctgaaattatgctacattgtcccttgcagccctgtaaaagatgaaaagttagagacaattggaaaaaagctgaagaagtataatgtttctcttgatgttgttgaatttggcgaatctgacgatgaaaagcctgagaaactagaagctcttgttgctgcagttggtggcagcagccacatagttcacatcccacctggggaagatcttcgtgccgtccttgccaagtgaacatctattatgttatctgcaggatcttacccaaatacctagtgctagagtatgctatcactaataagtaataatcctattcctttcacagtacaccgataattactggagatgaaggagggggtgctgcagccggtggagcatctagatatgaatacaatgttgacccaaatgtggatccagagtttgcagaagcacttcgtttatcagagatagcaaggcaagaagctgcagccgatggagcatctagatatgaatacagtgttgacccaaatgcggatccagagttagcagaaacatttcgtttggctgcaggggaaccttcaacctcaaacactgatactgttctcttggaatctgactcagacacttatgttccttttcatgagttcatacaaaataatccttttgtgactggagcggaatctgcctcagatagacctgctgacgatgagagggcaacggtatgctactacgtgtctatgttacagtgttactatccttattgagatcactggctttctttgtgcacaagtccaactactatcaaaccatgaactctatggctgcagaattccatcaagcatatatttgtatttgcggtgatgtctatcagtttattgcctcggagcactcatccctcaaaacatcaaaaatcactgtgcacccatgtgtgctagtgcgtatagcaacaccctatgaacttaactgcccttgggaagtgcttgttctgtcccgtgtagtattctccagaaaaaaaaaacataactctagcaacaatctgtttccaaatcagtttttagtaaacagtaatctgattatatgaatatgaataaacaggaactacatttagacttctaatcttggatctgtttagaattttaaatattccctttttcttatttgggaaccttattttcttttgaagcgccttgaatgtgttgctagaatcttgagccacttcctcatttgttgtgcttaccttctaaagatgcaaattgccctgaaaaaagattgaaatggtcatgattattaatcatcatcatttgatttctttggtgctattttactggcaggataacattaacaatataattggtgagataattatagatgctattatcaatgatttaagatttgaaatatatatcctatggttatcagcatatgcaaaatgtagctacaatataagtcaggattacttttctgggttccttgcgttttatttgggaccttttgtgttttacattcatgttcaattgatgatgtttgaagttttccatttccgtcgcagcaacttttattggggtgttgttgttgggggggggggggggttccaattttgttttatcttctatggaacattacaatgttatcagacaagctagttatttatgtcattcaggaagaagggttccgtatgatacgagaagctcttgcaaggtctgcaaatgcagcacatgctgaaatatcaggcaattcctcatctgggcaggagttggaattaggttaagcgagaagattaactacatattgttaacatgtgtccattgtttttgccatatggaggttggcaggttgcgcttctggtttttttaagtcatttctttgttaataatactggcattaaacaatgtgagtttcatcaattgtgtactttttacaacctaagattattttatttagttgtataattgatcatatttttttgctatccacatcagaaggtttattttcaacagaagaatacctgttccaactggtaaggtactgttatatgatgtcaaaaattgtgaccagctagagtaatctgaatgaaaaacataagcaaacttgttcttcacaattagcagatagagggatccaaaataaaatcataaaaacatgccatattacaaactatatatgctgatgatatctttgtgcattgtttatccaacttaggtaaggctgaattccattatcgacaatgagtaaactatgtttgtgcagacccatatccatccattgctcttgcactgcattcaaactgagtcactagtatgttttgtgaattgatacttgtttctcagaagaattgaaaggagatctatttttggttgggatggctctatatatttgttgatattctcgtcgtatgatctattagtctctcaaatgtgctgtgatgtggtgcagatccgcaaaggactggagagatatgctttcagtttgaagtggaagatatcatcaatttggtgagacatgaagcttgacgttttctcagcagccatgattgtcccatactctccacaatccttacaccagtctcaattatattgatttactaatgaacgtttatttctaaaaacaaattgcgtacagatatgctggcaagggtggcagcaatgcaaatacaggaggtatgctttttgtatgacagtttctgcttgttaacatatggtttgctattatgttcatcttaaagttaaaaaggtatatgatgcagacctgcaattttgacccacttacacatctctcacctctcaaatatcccatcaagtattgcttcgctagcttggctgtgttcccaactcatctccctcgttttccgcgtgtacacttttcaaactgctaaatggtatgcgttttgcgaaaaatttatataggaaagttgttttaaaaagtcatattaattccattcttcaagttttttatagctaatacttaattaatcacatgttaatctattgctccgtttttcgtgcggaggggaggggttcccaacccctccaagagaacagtgtgtttgaactctttgaagcacacctattttgcacttgataggagcgaagagtcaagagcttaccttttttttatatatataattcaagaaacaactgaattccgtgcattgatcttttacagttaattgtttcaacacactcccaaaaccacattaacgatgttatatttctctttgactgtttgtttcaagggttcatctaaattttctctatacctgtctgtgtaaattcatttatttccacattggcccatgcatctgaatactggtggagtgatgctgttgctttgtttgctcagcaagaggaggaagaggagggagacgagcaagacgaggcagatgatgacgtgtaaatgtcgtcaggtggttctgtttccttcgagctcctttgttagctctggaccggatttgtagtcagatgaatcgatcatagcatacataggaatatacgattggtatagccatcttcttattgtggttctctgtaactatcgattgaaccaccatattgcgtagtcaaaggaagaagtagagaaagagctgagcctgttagaagtagtaaaatactttgtacattgctgtacatgttggatcttggatttccctggttttgttacgtcgtggtagagggaggtccagtacttgcgggtatgttgtgaaaaacgttcatgtgtacccagaaacattgaggttttgagcttttttatctgctatagcctatacattggaattccttataatctgtttgttctgcttttacagggcgatgtctaattttctatgttcaccgtgagaaatgaacaatttctcataaaattcatgtgcttttatgtgtctcaaataattctcaaataatacgggaggaggagaaaacgtgcggaattggaaaatcatacgggagaataatttgttttgctgccaccaaatggaaatgtatacatattaaagggttaattggatatatgccattgcaactttgctaaattaaaaaaaataccaccactattcattatatcaactatatgacactggaaatttctaaaattggaaccatgccactcccgtcgctttttcatctcctctctcacgccatttcaggtcctgtcctagcacacgcacgcggaagctagggcacccgcggagcagggctgaggatgcgcgcgcggcgcttgtcggggataggagccgcggaggcggcggagccgcgccgggccggctgaggtggctgaggtgcgcggaggcgcgtggagccatggaggcggcggatgcgcgcatggccggtgggggcggcggggccacgcgggggcgggcggggctggtggaggcgcgtggggccggcagaggcggcagagtcgcgcgtggcctcgcgctcgtccaccgcctcgtcgccaacggcgacccgcgctctaccccatggtcaaggagagcacgcagctctcctctgatgtcgccgtcgtgctcgccgtcctccttgaccgctttttcgacatggagcaccgccaagcaaatcgacgacctcctcgccttctacggctggtgcgatgacgtcggcctcgcgcggtaggctgacttcgccgatgtcaagcgcatcaacgacagaaggcatccataggcggcgggctggacccgctgttgctactgctgcggcggcggagccgcgtgtagccgtggataggggatgaggacgggaatagagacggcgtgagcgagaaggacggaaaatatgactggagtggcatggttctaattttagaaaattttagtggcatgtagcatatatatcgaatagtagtgatattttttcaatttggcaaagttgcaatggcatagatctaattagcactattaattaacgtgaaattacttcctccattcattaatatatgatagttttaacactagtttaagtgtagttttagcatcgaaaaacgttgtctattaatgactgagggattataattcatttaaggaaaaaaaagttcattttgctcccctaaaagatttggcctttgtctcctaaataaattttcgactcattttacacctgagctattagcattattttttttactttatataagttgtattttgctataaagtttggtaggattggtagatgcattgtaaccttaccatttaatattttctcgaatttgttatcattgtttacgttggaagtatatgtaaaactatctctagcgcttccgcacattgtatggctatactcaaccttttgtccaaatagacgggaacattactgccatgtgggttctcgcaaagggttccattagagacatactcaaagaccataattggagcatttttctctgtacaacatccaattagcctaactacattcttatggttgacttggctgtggacaattacttctttggcaaactcttcttctgaatctatgcgggaatatcttttcaccgcaactgcagtgttatcatcaatgattccgttgtaaacttttccgaatgaaccatttccaaggctagtgctgtagttgctggtagttcttttgatctcatcttctgtaaaatactttatgttatgattattcttagctatccattttgccttgtcagctccttggataaaatctctaagcttattttctggaagacctagtttatcttccattttgtgatgtgaataattaaagatctttctttgaatgaaatgctgatcacctttcaccacagaaataagttgttaacatagcttgtacaagagcaactcatttatttcctgttgtagtataccttaatttgtgtcccattaccatattggatttgtttcacctgtatatttgatcatttttgtaatgcatcttagtagtgagctgtggttaggggtgtgagtaaatctcacaaaactaaagatatgttggtaaaattagcttacaacagtttaaagtgtgacaaaactagaggcttttttcttgaatttatcactaagccacagattttcaaggtgaaccagaaatgttttcttattctaatgagtggatcccacctgcagttgatagacaagctgatgacttctggtgttgcctttttttttctttcagaaaatggattaaaccagcctctacatccgaaatggatgtgcatggccattctggtaccctctagcatgcacagttttgatttatgaaaacagtacaagtaaaatggacaataagatgttatgggttaggattcatagggggtaaacaccatcgggaggatagccgggcggcgacggctgctagggatgagagggggacttaggttgggagagactaatcttgattcattgcttaattagaataacggtacaatctatccttatatagatggagggaggacccaatctaatcttatcgaaccgactctagctatccttatccctagggcctcgacccatcggcccactacttatgacaaatatgtaggagtaaaatgggatcctgttggctttaaatattcaaatcctaattttctagttactgaaatactgaagggagcagctagattatagatggtaacctgtaattgaatttacagttaagatccaatctatgctggcaggacatttgtgtaagtatttagtaagacaccctgttttgtgaaaactttccaacggtcgttgaaaacttataatctgtaatagtacttttattcttgtgaaaaaatgagaatacaactaaatcgagaaattatcagatactactatactagagaggaactctagaagtaggaaactaggaaagaaatcgagagagatgagttgataataccaggcctgaacagaacaactgaagggtcagccgagattcatccagcttcgcttcggctggtgctgatttgatttcaagctactattattttgccatggctgcttgcatcctagcttagcttgttcaagctaatgcttctcccatgaatgcatgatatgcaggcaaagcccaggatgatgagacgacgacgacgacactgccattgtatacaatacatgtctctgtcgggcagctggtgaacgaactcgacgaaagagtggagttggaattgactagcttgtcagcctacgcgcctgttgttctcatggtttacttctcgcactgtcgtagaaacatcgatacaaatctcttaattcatcgctgacggttgttagaattcacagtgatattggcaagttggcagctataaccaattagtacccccccttcttttttatccaaaaatgtaagcattttttttggagttaggtagtacagtactaagtaggatttaggtagtatatgcattattaaaaattttaaaagtaggtgtaattaaacaaggtaattttgtgattggttcataagagtagtcatagaaattacatttgagatacttatgattggttgaaataagaggctaggtgaaaaaataattacatttttggactaaatttaaattatcaccatcaatttaaattttaaattaaactagaaaaggtgcccgtgcgttgcaatggatgaagtctattttaattttattattgttatagcaacaggaaaaaaataaaattataataattactatatgattagatatagtttttataatatcagctctttaagaaaaatatattcttcaaatagacctagtaatcttatgtgcaattcataatttaccataataataataagaatataaaaaagtcttcaccctaaaaagtggaagaaaaatcataagatgaaaccaagaattgagcacaatctcataacggaaaatgaataagagtggagaattattgttttaagggtaactggagtctagtttaatttttcattatgaggacgatataaaaaaaacgtgcataacgtgtaacgaaagcacttcggtttttagtagtgtgtgatctccaactgctctttgttagacgaaaccaggcatagtcgggacggttacttcaatcctgagaccagtcattaaaacaaagagttatcatggtccaagaataaaaaagacgttttctcaaatattttatttagtgggatataggattagaaatattaatatcaacgttaacagaaagtcgagtcaatcttctgttagttattaatttctctatcgaacaattgagtatgatatcacagaagcatgagttctccttgaaagccaagcattattttgtgcattaaaatatttccggttaattatccgccttgcaccctcgctgattagtttttttttacggacccttgctgtttagttgctctggacggaaacggattcgatttacatggcggggttgtttgacgcgggaaacgctttgtagacgatatcagtacgaatcgaaaacggacgacgtacgaaaacttgtggcaaaaatatcttaaacttttacaataggtaaagatagttagaaatatctatattttatgatgggagggaataattatcaccatcagttcttattgttcatcaattcttattgttagtttccttgtagactctgatattgtcatcttggggccagcggactcgtaggacgccatcatctcggtccgtgtggcattggcaattggttatggtaaatgaagtggacatggtgtacatctctaccattataagtcatttatgtttgagtcggtttttaaaatttgttttattttggaaatataagtccgtgtttgagtcagattttaagtttgtttgtttttaaaaatacaaaagaagtcatataagaaatctatttaaaaaagctcgcatactaatttgagatgaaagtcgtactcctaattacagctcatgattatttttaaaaaaaattcaagcgaatttacagtcatatgttgaggaaagcctgcaattgtttcaggctttgggtattactatttactcactgactgcatcaaactaaaactgagtatgcatcgtaccgaacatagattgtttgtcaacaataaaatttcttaagaaaccaaacagtcatggtcaaaacgactatgactatcactacatgtagatggaggtaaaaaggggcagcctattgactacagtaactgcttttgctagtgagcctgagggtttaaaagatacatcacactaactctcagaaaatacataatagcacacctggttactggtgttccagattaaatacaaataaaagtaagttcagttctgaaaacgattacacacaacatggaaataataatcaagcagattgctctgacaggttactttgctcctcacgcattcctccaacagtttttaccttgcccctgctcctaggcctttagcatcactcattcttcttctgtaaatgtcgtcaattatatacatcacgcaagacatttctgaatgatgctgtagactacaataactacacaatagagagattcttgaaaaccagccttattgaaacatgacttacaataatttaaactcaccttcatcactactaggatagggcagattgtgcctataattaaaactcatcttcatcacaggttcacaactagagtatgacgcactatcatataaattggacgaactgggattgggtggttcatcgatgtcgatggtgccctgaagcatctcaacaaccttctgcatggagggtcgatggtctgcactgaattgcatacaccacaaggccgttttcaccatgtgctctgctgtggccatgcttctggcagaatcataggcctctgcctggataatgcatggatccaggcagtccacaattcgttgctttagataaacttcctgatagactatattgacgaagtcaaatgactttctgcccaccaactcctcccagaacatggtgtcacggataccaaagacgatatccagcagcagctgaccgaagctgtagacgtcagcctttgccgtgatgaatccccgagagaaaaataacctctctggtgccatatacatgtagttacctggtactacttcagtagtcatgatggtactctcattaataattataggtgttggcttggacaacttggagcagaagttaccatccaggagaatatcccacggcgtgatgctgccattcagtgtgtccagccacttctcgtgcaagcatgctatcgcgttcgccacccccaacgcaataaagtgacgtgtattcatatccaagagtgacctttcccctgtttcttcacccttctccacaactaggtaattgcaaagggcaccattgggcacatactcacacactgaaatcggatgatccatctccaggcaacaaccaaagagcttgacaatgttctgatgttgcacttgagattggatgatcagttgcaaaacaaactcctcacgagattcactcacgttagtgaaaaccttcactgccactctggtattgtcatcaatgtctcccaagtaaacatcgctgctagagcttttactcagagcagttgagaagttctgtgtgatattaagtatttcctcatttgtgtaaatccttatgttgtagatgtcttttagtatatgtccaccattcttcttaaagttattggttgcgccaatccagttgaaaatgccaagactcttcctcctatagagaaccgtgttggagttggaattgcttctttcatgctggttctcttttttcaaatcattctgacctccagaaaagaattgccaacctgtcttttcccccctagttcaagagttttcctgagctctcggagacgtgcagcgacatcattcatttctggacgtttatcaatgtcctcttttatgcaatcttttgctattttccaaataccctcaagaattttcatgttgctctcctttgcaatgtccacatcaaacaactcctttgcacccttccgtttttgaggagcttgaataaatcttctagtgacatttttctccatgtttgttggctttgtttttgtaatgagttcaataagaacaactccaaagctatacacatcactttttggtgtgaggcgcgcccctcccatgcaaatgttggatccatgtagccgatactccctcgcacattcacagttagatttgtgttatctgttgacagaatccttgatattccaaaatcagaatttgtgttatctgttgacagaatccttgatattccaaaatcagatatttttgcatgaaagttctcatccacaagaatattggacagcttaaaatcataatgaacaatgggattgtacatggagtgcatgcaccctaatgcttccgcacattgtataacaatgctcaatcttgtgcccaaagagattggagtatcaccacaataaagaagatcactcaagtttccattagcagcatactcaaatacaatcattggagcattgttgtctttacaacacccaaccagccttactacattcttatggttgacttgagtatgaacaattacctctttagcaaactcatctagtttatctactctgataaatttcttcacagctacgaaacggttatccccaataacccctttataaacctctccataagcaccctttccaagcttagtgctgtaattgtttgttattcttttgatatcatcttctgtgaagtaagttatgttgtgattgttgtccggtatccattttaccttgtcaacatctgggatataatctctaagaatgttttctgggaggtctattttgtctcccattgtatgttgatactgaacacaaaagagctctggctaggaatctgaaattccaataatatgatcttcttttctcttctttttttctaaaaggaacaatatgatctgacagactggaaacacacaaaagcaatttgttaaaatctacgtaaacctgtgaacatgatttagatcacagataatgttaaaacagtggcttcatcatgcatgttttggggagagtggatgaattttcctaaatttatcactaagctacaggttctcaaggttttgaagcaatagcttctgtcctgatgagtggccccattcgcagcttctgtcctgaattctgattttctgaaaatgatatagggaaatactttcataatacttatgtagacatgcaacaataatccttttggcatccagtttgcaggatgtaaaatgggatcctgttggctttgaatccttaatcctttgatactgaaagttgcagtcagactataggtagtttcttgtgttcattattctggttggacctaacctatgcatgatatttgtggaagtaggacagcctagtatttttctaaaaacttatcagtccgcatgtactaatccatgcgtaaacagatcctctgcagtatgtagtattgccctctaacttttagttgataacaggtaggccccatgaccagcaggcccacatgtcagtgatcccatgccaaagggcaatactgtagaggagactcatccaatccatgatgtattttattcttgtgaaaaaaaggtaatacaagttaagaaaccattagatctagagcagctccagaattaggcagctcgagagagggaaagaaagagtaaagatacgtgaagatcaatcgaggtgcagcttggcttgggcttgtgatgagatttgatttcaagctactctgccgtccaacgtgatggctatggctgctttgcaacctagcttaaatagcttgtactaccaactaattcctctaaaaaaaagaggtcattttcagccctcgtgccgctcagccctgggacggcacgggcggcgaccaccgagcgccaccgccaaccacttctcctcctcccctccgcctcgccgctgcccaagatggtggcggcagggctccttgcctcctctctcgggcatggcggctcggggcgctgccaagatggagggaggatcccaagtggtggtcgtcggcgaccagcttcgacgacggtggggacagatctgggcctctcatggccggatccggcgtcccaactagtgtgtaggcggaggtggtcgttgtgcgcatggagaaggccggcgacgcacggggaggaggtcgacgacgtgtcgggaaggccgcggcgatggtggccctcggcccgctgatggggatggccggttctggcgccccttggccagatccgccgcctggatgacgatggtgagctgccaatgcgaggtgggggccagcgtagcctcgcgcggcgcgggaatggctacgggaggtcagccaaggagggagtcgggcgcgcgtgacagaggcgggggcctggtgctacgacggagggggcgggtgcgccattggcagttgcaggaggccctcgtcggtgtggagacaatggcagccacctgctgcgcccaccggcggttgtggtggcgacggtggcagcggtgcagcggcgtgtgggcgctcacggtgacgttggcttgccgtgcttcgatagtcagatccatggccgccttggccagatctggtcggtgcagcagaggtggcggcaggttggcagcacggccgactcgcgaggctgcctaagttgtgggtggtgggctaggcttggtggctaaagggacgatgtggcggttcggcaacgtacgttgtgcaggtgggttgtgtgtttttggatgacgcttgcgaaagccttggctggcctttggttggcttgacgacggcggcgccattaggcatcgttcccctccttggaggcgtcattatgtcgtctccctcactaccaagaaccttttccatgcaaggatggtcgttcatggaccccccatgtcgaagctctatgagcccagctatttggtgaggccttcatctcctgggtgccgctcttggatgtggcaagcgtccaactttctccgttttcttctaggtgaagtcggagctgatttattagggtgcgatgaagcttggcaatgataacacgttgcagttttcgagggaggttggtgttagctgtgcacaagtagtagtgctcaagtggcttgggctgatgttcaaagtggacagtcggtgtcttgctcgttttctgcgatgcctttgtcaacgatgatgtgatagctgtggagtcgaagctactgtgtcgctaggtgacaagctcggcaacgataacacttgcctcgcgaagtcgaagcctttgtgtcgctttcaataagctctttatcgatggttgttttgggctccgccattttttcttttttcgcggtgttggtagcttaggttagagtgttgtggttttcatccagttttccataattaactgcgcattgtaagttgcgcaaggtttagtctcgttttctacttaaaatgagacaccttcttctttatataaaacatcggaaatggcctcatcgttcgaaaaaaaaactaactcctctcgcatggttaattatgcagacacttgcagttccaggaagatgagacgacgctgcaatttgtgcactacaacacaaaattaataggagtatatgtatctatcgtgcaggaaaacagatggacaagagagtgggcttgactaattaacttcttctccacatactatacgcggcaacttgattaattaacttgacgtacgtccaatgattattagatcatatattccaccagtgtacgcgttcaaggctcacacgtgctcgtatatttcttttaatttgcttcaggattaaatcttgaacgagtcattgcgcaccatgcatcttagaacgggatgcacaaatttagatgatgctgctcagggctggtactatgattttgagggccctagacaaactcaatgatccctctaagctatatataaaattttatgatatatatatatctatctctatctcttctctaatacttaaaaaattttatgatatgatatatatatatatatatatatatatatatatatatatatctcttctctaatacttaaaaaataagaggtacttccatcgtccgttaataagtatttggttcggacaaaaaagtcatgtccgatttcagaaaaaaaattacgtgaaaactaaatccgttacatgaaaacaaaatcccgtcggtttccagggaaaaaaaaacaaaattgctgttgggccatacctacagaatgcctattgggccatacaatcagtttgagatttcctgtagcccaaactaatatgttttagcccaaagccatatttactaatatgtttcagcccaaagccatattttagcccaataggacttggccactattacaaaaaatgaaatgaagatgtttccgttggaattttggtacgtcattcatattttagttggttttctaattttcatgttatccgtatgtgagttagttttctaatccatcaaatccttgtcattcgtaattgtacgtctggcatcatcatcacgtcagtcgtatgttagttgcagtctgtttcacacatgcaagtccctttttcatacgacaattgcgtgcgacatgtgtgtgccttttttttatccgagatgcacgtgctcgagttcctttttcatgtgccccttgccgcgcgccgtgattggacctgtgacggctcgcgcgatttgtttcctctgcggtgcagccattgggcccacagttgcataaaattgtatcaaattctctatactgcacattttttacgcatcaacatgatctctgtttcccattttatatatacgtaataagtagccagtgtaaccagtttgtctcacttgggaaaccgaaaactcttgaagtgactaaaactcttcaagtgcactagaaattgatgtatgtacctaaaaaaatataaaaagattgaaagttttgtttctcatgcgcataatcggcttattaggctagaaaatcagttttttttaatctctaacaaaatcccattccctctcgctctagcatatgtcacctcccttgctaagttgctgtagaataaccacactatctctccttccacattgccatcttactaggttgtttgatgatcatgcctctctatctatatactcaactttttcgtattttcttcctgttgcaacgcacgagcactttatgtatatatatatatatatatatatatatatgtatatgtatatacgtacatgtatacatacatatatatacatatatacctacatatatacatacgtacatacatacgtatacacacacacacacacacacacacacacacacacacacacacacacacacacacatatatatatata

SEQ ID NO: 13790 - DNA, 11549 bp, Oryza sativa
ccatccgggactaaagatcgatctttactcccggttatttcacccgggactaaagatagcgatctttagtcccggattggtactcccggtttggaaaccgggactaaagggggttacgaaccgggactacaaagggtttctccaccagtgtcagtatcaggtttatgacagcttggttaactatgcaaaattgcacataattaaacatcaccatatcagtctcaaaggtatgcatgacagctattttaactcttatcactgaactatacgccagaatgcacgtgtacaaaagccaataggcttgtttggtcgtggactcgtggtcagcttaaaaattaacagtgggataattttgtaagcctagctatgcccaaaacgaagggttcgaaaagacagtaattagttataatctctccgtctctagcctaaaaatttatcctaaaagagtgtaattaaatttgtctgtaaaatagtttagttatagagtggttcattaggcctctttaatattagattattttttttcgtttttagctattgtaagtcattgaacagatgtagggagtactttgacaccagaagtttttttttaggtatttttgtttaatttggtgagtgtgcgtgtatgcatcctccgacctcaaccacacttcagtcatatttcacgcagaattatgagcccagattggcttattatggcctcgatcgaagaaaagaaaagctcaaataaaattttaattacaattgcgtgctcctacgtgaacctcgtgatactgtagtaatataatccaatatagtatttgctgtgtttcattttatttcttcagaccgatggtcccgttatgccggccagccaatgcttatactgtattcttcatttcctcctttaagagttgtccacatgaccgaatggactgtcctgtgatcgaacaagacgacatcaacctcaggttcatccgcattggatttgaagtttgtatgttatgtattaaaggtttaaaattttatattttatttaaaatagaaacaaaatttttaatctaaatgtttcaaagatttagattatggatttgtagagatggaaatatttagtttaaaagaaatttcgaaaacggagttgtgccaatcagagtacttaaaacaataagttcactttaggtctctcaatttgtcgttgaatccgaacttcgtccctaaaccgaaatatcccatcccggcatcttccaacgaacaataccatgtaaattttggtctctcagcagtttaattgccgattttggttgacgtggcgagtgggacccatgtgggtcctacatgttagtggccaattcttctccctcttctccatcttctcttgaggacatgaaggaggggaggttgacggcttcgccgacggagcggtactgatcagactcggtggaagaggcactggacgagctctcggggagatgcctcctcactgacccagccatgccgggccaccccatcgtttacgcctccaagagcctcatcttgctcacagggtactcacctagggaggtgcttggccgcaacacgagactattctagggtgcgaacacccaccatgttgtcgtgcccagggtatgggaggccatgcagggtgcacacatcagaggaagacaagcatgattgtagtgtcgagcataaacagccagtagcacatgcccggagacgggcgttgagccagccccacccttgcagtaccggcgccatgccgcacgcgtgtgccagcacaggcggcctctgggtagcaacaccaatatgtgaccccgtcagcgccgcagaccgggtccaggcggaagcgtcgcacggggcacagcggggccttgttccccctgtctgacacggggtatgtagcctagtgattggagacctcggcctccgaggccgtgcggatgaggccagggtttgggtgaaaggagtgagagggccgcgaggaagaggacgaggcggcgaaggcgggcggtgggggtgtaggagggtggcatggtgacgaagacagtgtcgccgacgactgattgtcgccaacgaaaggcttggaggggatcatgatgccggcctttgtagtggtgggtgaaggaaaggggagggtgcgacgatggttaggtttggaagttaacaacacagtggtggaacgggtcgacgtttagagaggaataagagttggccactggtatgtgaggcctacgtgggtcccacactccacatcagtcaaaaccgacaactatactaccgagaggccaaagttaacacggtattttgagttgggggttgtgctatattagttatttcggttcagggacgaatttcagactcggcgacaattaaatcgaaagacataaattgaacttattcccttattaaaaaaagaattgaagaagaggagctagggcctagggatatgggtcggctactgtgggcctaatgggccggtatttaaatacggatggcaatgatatgttgccttctcaaaatcaagtgaggccggccaattagtacttgctagcgacaggcctgctaaggtaagaggcccaaacttagtccaatccacgttctagcaaaggaataagttcaccagccattcctcaactttacaccgagtttatttgacatctcttatcctcgataccagaaatctctaccattaaactatacgaaaccgtgcaatttaggtcccatagcagtatagatgtccggtttcgctaacgtgtcatcctagttagaaaaaaaagtaaatgccactttggtccatgtatatttaccaaagtggcaacttgcaccagggcaaagtctaagttttcatatcacaccatctttttttaccatcctttacagattgcaccagggtttaccgtttaattgggcgaccaagctaatctttggcccaatccgcgtgaacaatagcgttttggctcgtgcggcggcgacgagtcacgcgcctcgacagtgatggggatcgacgacatgcatctctcgacgtcgatgacgcctccgcaagtccacatacatcgaccgaccgccccgccacaccatcgtgtaggattaaacatggtgggattcacgaagcagccaccgtcggtcgctgctgaagatcatcgacggcgacgagagccagttgtttgcttcgctgcagcagtatgcggcgccgctgatccgggtgagccccgagtgcagcgtcgtcgtcaaggatagcgagagccgagagctcgttgccgccaccgtctgaaggtagcagataaacaagcatgcatccatcaagtgggtagctaattaacaagataatgcctgtagactttagtgatggagctataccctatacctcgtaatagacacgccttgtgatcatcatcacgacgaggtccagcagcctgggcgtgtccgacggtgcagcatatcatgtctggcaccgtccgcagcagcggcggcaagaggggtctcctccggcgccatgggcggataagctactgacctccggcgccggatgctagcttggccctccaacagcgatgctgtactgcaggccggggggagcactctcgctatacgcgaaggcgttgtcgatgtcgagcgagccctcacgtcattgctgtcgctgctctccatcactaccgaaaacgaatctaaatgtatctatatgcatgggacatttatcatggccatatccgggcgcgatatatactgcgggttgatgtcatatattcgtggtgcgtagcaggcgaaaagatctgtccgatatacaagaatctatttaatctatgacaaaaaaaattcgtcatagatccctgaaaattcgtcacataaatttgtccgtgacgattctacttatcgtcatccattgagagtcacagattaaatctgccgacgttttctctgaaatcgtcacggatcagcacaatctatgatgtttttttaaccgtcataaacacttttgggctcatgtagtccagccccggcccaacctttgtgacaaaattaaacgtcacagatagttgagacatggcggccaacatggcagatgacgtggtcgttgacacatgtgtgatgacatgtcactgatgacgtggcaggtaacgtcaacaaatatttttaaacggcccattatttttttgacggcccattaatttttttgacagcccattaattttccagtgtaaaatttggtatctcagtacctccacgttagaaggtaccaaaatttacactaaaaatattagtacctcctggtacctgtaaaagaccttacaaacttcaaatctaccatggattttggatttgaagctgtgctaaatggaaccataatttcttaatgaggttgaagatgaagattaagtgttttatgcaaaacgatgttgtaataacgtatggttaattgagttttaattattccaaacttgaaaatagattaatctgatattttagaacaacttttatatagaaagttttcacacgaaacataccgtttagcagtttgaaaagcgtgtcacgagtatccaaaattcaatccaacttttgttggagaaaagaacatggcctaagggcaagatattgcaaagcacatgggacagatgaatcaaccagggtgatcacataattaataagcatataaaataccccaatttatcgatcaatatatcttgataaaaggtcataaaaaacacaccccatcaagaacttttcactaattccagtgaatattactactatgtaaacccttaattagccttaggccttagccattaccaagatgggtttacttaattgcctcacaacccctcaaaatgatagaaaataaattcaagaaaaaatacacactttttttttcaccatttcttccatccaaagaaaaaaaagtcttggagaaagaaatggaaaaatagagagacaccagaaattaaaaacatgaataatagtaaaaaccaccaccgccggcaaatctcgcatgcataaatatcggtgcgaatgaggcggcggcggcggcggcggtcaacgccggcgtggacgtccttccctcgccgacggcgttctacacggcgcacgaggcggcggcctttgcggcggcggccctgacgagggagaaggtgggcagcggcaggctgctggcggcggcgccagcgcgtgcaggaggtcctccactaacccccgcgtcacctcccgctccaagtcgtcgagcgcctccgccaccgccgccggcggcggcagcggcgccgccctctccagcggcctccttcggtgcggcgccctcgcctgcccctcccccgacctcggcgtcctcggcttcttaatcctcctcctcacaaccgtggctgacggcggcagaggcggcagcatgcgagggaggagaggtgttgccgtcgccggagccgacgccgccgccgccgccgcgtagtaggtgtaaggcaggtgtagtgggagagagagcgaggagtacagcgacgccgcctcgtaagtcgtgtactgaaacggaggaggagatggagcagcaaaagtgaagctgccctggatgcttctacgaggcggtggcggcggcgccacggcgagccgccggccgaagtagtcgtcgaagccgccgccggtgacttggccgatgaggaggacgttctccatcgatggatggatcgatctgaagccaagaaatcaagaggcaaagctagttgtggaaactctgcatcaagaacgtgttgatatgatcacttgatgatgaacagagcaaaaacacttgcaaaaaagaagaaaaaattgcaggagaggagatcaaaggatgtggattgtttgatcaaaataaaaggtgattattagtgatggaaatttctcaaactttgatctgatggaaaggcgctagagaggaagagagaagagtagggtaattaaaaaggcagaggggaatttaattagtagctaattaattaagaagctgctaattaacccgcctctcacaggcctccggggcaagggcaagggctcgggctcggaggaggtgatgcctttgctgcctatttatgtagagatcttagaggagggtggtacagttgactttccaagtcgacatcttgcttaattttatgctaatttattggtattagcaagtgctttgcacatgtgattctctaatcccaagttgttattcttttcttctgcacccgctgtactagcctaattattttttgacgcatcaatggcataggttcattaggaattcttctcttcaaaactaattatttaaagatattttttcgataaacacactacaaatgcggacactaaaaagttctgctcttcaaaattaattatattgatgaactaaaactgcagaacggtttttttttacgcaaattaacagatatattgtttctaaggaaacagctggagtctcttaaactcgagatggtttgattacacatatatttaggtgaaaagaaagccatgatatgatagacatcatgattaatatcatgcaaacaaattcacttgtaaatttatattaatatctttattttcaaataattgttaattttgcatatggccagctcactttgaccacaaattacttccatatgattatattataatgaattaaaattgtttggctagatttgtttacgacaccacatacttcaatagtacgacatattctaagcacatgaagtttttttttttgggaaaatattaaagttttaacttgaatagcgaatattgattatttgagatcggagatgatattattttacaagataaaaaataggaaaataaaatctaatccaaatgcacaaatttgagtaatcaaatgaagaaaaacattcatgggtctccatgcagaaacaacttgtcccaacttgcagcagttgcacatatacatattctccattttttccgatcaaaaaaccaataagagcaccgaccaagtacggcctgtcatcacgtcaccctctggacccgaccgcccatgaccaccatccaacccccaatcatatgatcgcacgacagcgacgccgccactgacagtgggacccacataacccgatggccccacatggaattgacacgggtggctcaaccacgccgcgatctctcgtgtggctgccgcgatttcccgggcgtggcgggaatctctctctctctcgctgcgggcatgtgcgaggcgaccaaccgccaaagcgatggtggccgtcggatcggggatcgaggcacatctggccgtccgttgctgcgtctggcactgctccccacatgctgcccgtattcgtctacttgtccttttcttttagattttgtcgagctgctgtctaggtcaccacccggtcattgtacatgtacatcaatatcttaactagccagattaataataattgtgcgtttttgctatatattcttaaataaaatagttttacagaattacggtatttaagaaagtacctggatatatactcaggtaccctaaaatttgtcttttaagtaacacaccgtggtgattttgccacaataaaacgcttttttattcaattgagactcactatgttgtccaaccgttattaccaaacactttttatatttaaacttggaccacttagattttttaaaagattataaatacttaaaaagcttccatttcaatcaccatagtctaactatggtcgaagtttaaaaatgcttgtcaacaacgtttttgccggggttacgactatatcacagctaaccagaatagtccaacaagcataaagataggagcggctgcagccctcgtctgccgaacaggcccaatatttctgaacatgtggaattataatttgtaggttttatatttaaaaaaattactcttaggtttttagattattgaacatgcttgctatatttatccttttttctaaaacagtattcctgatgtaattaacactagtgcacacgcgcatatatgcatccagtgcattttttttaaccagtgagatgcgcagtggaccggatcgatccgtacgtaggattggcgaagacggaaaaggatgaaatataattctccctccgtttcaaaatgtttgacaccgttgacattttaggacatgtttaaccgttcgtcttattcaaaaacttttgtgaaatatgtaaaattatatgcctacataaaaatatatttaacaatgaatcaaatgataggaaaagaattaataactacttaaattttttgaataaaacgaacggtcaaacatgtactaaaaagtcaacggcgtcagacatttcgaaacggaggtagtagtaatttgttcatcattagtggtggtgagcacgtgtactgcacatgaagattcggcaagcaccgaccatgtccaaattaaccgaaagaagaacgatcgatctatacatgcatgcatatataataaaagaaaagaaaagaagaaaacgaaggaagaagaatctcacgcgctcttagcttagctaacgatggtcgatgcgccggcccgatcgtacggcgcccgtacttcatctcacaaaatgtcaatcgcacgatcggagcaggttaatcgaactcgttcaggatttaggccccgtatgattgaaatttttatctcggtttctcttagtactactaaatggtgtcgtgcgaaaacttataagttactttaaaatacgaaataaatatactttttaagtttgtactacctctggctctgtcccatagtaattgtatttctaggatttgaatttgttttaaaataattatcacaatagagtactaatggtcctattaatcacttattgtccaactttctttctcttttacccttaactatcattccacttttaactttacactatttaataaggagcattataatctttcttctcaaccttaatatatgctaaacaacctacaaatacaatttatatgggatggaggtagtaataattaaaactcaattaatgatacgctaatgatttttttttcgtgccttaacttcattaccatctttattagaaatgaacacgggatggttgacattaatgaagattaagattaagtaagggcacacaaaacaagaaaatcattatatcaatattaattatttttaattattacaaacttaaaaatgtattgatattttagagcaagttttatactataaaaagttttcgcactaacacacgttctaaaagtttgaaaattaactatgctaatgaaaactgaggtagaatcggtatcctaatcagtaataaataaataggcctagtagccggccacttgctaaattgtttatacaatattatgagtatatattattgataagtgtagtggtggaatcctgacctagcatacaagggttatatatcctattctaacggtgaaaataactgtgcgagtttacagttggcgtgtagagacaacaattatttttaaactttttaattaactaagctatgtaatttttttaatatataggtatgtttctaagatgtggtttgcctattcttattttaatttgttagatatatatggagccattaggcctgccaccactgtaccgaggcctgtcgcagccggtggcatggttgagggctggaggctagctagggcggtcagatcccgatggcacgagctcatggcagtggtggtagcaataccgttgcactgactggggtggtgtttgtgtaggggtctacggcgctgtcactggctaggagagagtgttggccgggtggagcagatggacatgagaccgtgcagtgctggggaggagatggggatcggtggtctctctaaggacatggaggtgatgttaggagaatgcagctaggatgggacttatacacatcaaccgttgatttttattatatcacctatttttcaccacaagttcaaaagaagaccatctacaaaaatagctaaataggagctctcttataggaaactgtatgtaaaaatcatgtttttcataggaggtcacctaagaaaagcacataaaaaataaccttattttcacatgcatttcacatgcagttctcttatacaacaattagtcagaatcaaatttctcgagtgttttaaaagcataggaccaccttgtaagtattattagtggaatttcttaacccatcctgtaaaattaaaacaagggtgtctacaaaaattactttttactactaatatatttttatctctattagctagtgatattttattgtcactactgcaaaaattgacaacgacgaccttccaaacgaaccgccaagttgagccaaactcacccgtggcttgcagctccctcttagtcgctctctcgctatctgcccttatgtgttgccctcaatctcgccacctccatcatctctctctcgagcttaattagggttactagatcaatctaggcctctcatatagtacgacagcacagtcggtgccggcttctagctccgtgcggctataactaatttggactacgactagcaacataatttgggtcaacggtcaaactaatgccttcatgcaccggccgtggcctgcttacggtttatacatacgtgattttagtcagtcgatcattcgaaagcagattctggaaaatcgtctagtcaaaaagctagctgcaagctagcctgcaaatcgcgttcacaattttggacatgaatttccgaaattttgggtctactaataatgggtcgtggaagcgactcgtgtaaagtatgtgtgttattttaattttttatttttctgaatttagcaaaaacttgctcaaattgtagtttatttgaatttgtagatattcggattttccatctcctgaattatttgtgcttacccatcaaaagtggtaggtacgtaatttaattaggcatgttggtggccaccgcccatttgaacacgtccacatatcggctcctatgtacacgtccggccttccagacttccagtgcaacggatggtacgctgataaaagctagctaaccggcacagctagcaagcacactagttcttgacaccgaatactatcaggtagtgtttgcttggtgggatgggatgggacgggacgggacgggacgaatctatttttagaggtgtttggtttagaggtgagtgggatgggttggtccctatagaggaatattcctctcaaatccgggaccaaagccatccggaaaaatctggcggacgaactcgtctcacctaggatgagtgcacggcgtgaggcgccgcttcgccccgctcgcttgctcgcgtcgtgctctgctcctctgcccatcgtgcttgctcgcttgacgacgacggcgtgctcaagcgacggccacggcggatccggtggtggggaaggcggcagcggcgaatccggaggcgagctcgggcgacggctgcgaatccagtggtggggagggcagtggcggtgaatccggaggcggggagggcgacggcggcgaatccagcggtggcggcggcgaatccaaaggtggggagggcggggatggctcggtggcagcggcgaatccggaggcgggctcgggcgacggcgacagatccggtggtggggagggcggcggtggaggggaaggcg

SEQ ID NO: 13791 - DNA, 6753 bp, Oryza sativa
ccattttgtgctaagttattcttatgatttatgtaaattaattttatactttattgaatttacattcataaatgtatttacttaaaaatcttctctacactctgcttgtgaattttctctacatagttgtcaggattatggataccacatacctaatagtagttgactaaatcttggcaggatccactacataccatgtcttatacagaaactgacctcaagggagttccggataaggaaagacaaccagagttctacatggaaacgacaaggactacttggactgtatccatattggtttccctagttctacttagacaaggggacacctatgggtataaatacaagccccctaggaggacagggggacaaccatgacgagacgatcaacacccaccatgggacagagaaccaccatgaaagacacccatgacaattaacatatgcccaccagaagccacaacatacaagccaacatacgccaagacaagccgccggatatcgacatcagagatacgcctggatcgaccctatccggtaccttcagaggccggccgtagggatctagcattgaatctgattccatcgggtgcgagctcgaggaggaaggctaccctgttgtcgactatgagtcagatcatcagaccgctatgtcgacaacagttagataggctaccctacatattgtactagtgtgattatggtgaataaaaagcaacatcggctccagccaacaggatgtagggctattacctgatagctcaggggtccgaacctgtataaaaatcctcgtctccatctcttttaccttagtctcgcgtataccctagcaccgatgatccccatactgtccaaataccgtagtcgagacatcaaacgtcgacagtggcgcgccaggtagggggattttggtgcttcaggatttcgacgagatgggttcaaaagatggattctccgacaacaagctactcgacgaattcagctgagggagagatccaacctaaccagatcagaaccatcatcatcatcgacaacttggtctattgagatcatccaagcctcaagccccgcggcgtaccaaaagatgtcagattgcatgatatcaaacgagtacgcaacaaggtaattggtagattggttttttaaattgatctactaatttcgtaaatacatctggcatgtatctacaaaggtacgcaatattttatctgcaatttatcatacctattcagatcatacagtattgtcagatctataatttattatgtatacccagagcatgttctttatacaataatatctgttgcgcgggtgtccccgatgttaaattgactacgatctaacactgggggctcgctctgtcttcttctgtataaatcatgcttgtttacggtttacataatgccctgacatttacatctgctcgttatgtcctgataatactagaagatccatgcagttttttgagtacatactcgatattatctgctatatgtcttgccttctagaaaatatttttcaggaacaattgagcactcgagtaggttgtggtcgagtacgctctattatcaagaacattcttgacaaatgcggagttatcgcacccaacctaccaacgaagaccggcgacctatctcatagcatcggccatggctggactactcgagaaaaggttgttaacggataattcctcgcgaacgccgtcggcttgatcacccgacatgattgcgaacggacatccggatatgctaccagttgggtgtgtgagtcatgctggccacatgagacacacatgtaataaaccaactctagcacctccattggtattcgagagataattctacatgctcgcttgtcctcgaaccagtacgtagcaatctctcgcaccgcagcttccattggtgttcgagagataattctactcgtccgctggtcctcgaactagtacgtagcaatctcttgcaccgcaacctcagatggtcgaggtacgactatagcaataacgcagcggtccttgcaccacgacttcaaatgatcgagagacacctactcactggttctcaaccagtcaatcgtagcgatctctcgtacaattacttctagtggtcgagttagcgtttctcccactatctccatttcaagtggtcgagttacgactactgcctggtgctcgaccagcgatgtagtgtttctcccactacttccactttaagtggtcgagttacgactactgcctggtccttgaccagcggtgtagcgattctcctactacctctacttcaacaaagttgatatcaggtatacaatatcgccaagtgttttacccagaaatcccttaccacgacgacacctagtgttgaaacctatcctactgtccctttacgccatcttgacaaggccttcgaggaacctaagagaactttggctggggacgcccagagccgataaggccttgtcggatcctgtagagacaaaagaccatgtaagatctggtcgtgtaagagttctcactgtgcgtattaaccaggccatgtaatcggaaattgagttttccaacttcacggctgggggctaggattagtgcttgttcaaccaaggcaggtcaagggtccaagagccttatcctccgagaacgattctccgacgacaaggctgggggctagggagagtgtatgactctacaaactgactgatcggagtcggtaagagagaagacgctcatatacaaaacattggtctgtaaatttaattcatttacagttttccatacatattataacatgtcaccctttgagcattcgctcgggggctatttctatttgatattcttttctgagtattgatttcaggaaaattctattcgacattgacgaagactccatgtctctatggttctacacctagatcgactaaggcgagtacgacaaatgttgacaaagctccgtcgcacactctacgccttctcgatcgctcgagaacggttgctggatttcgacaaggaatacgaaatgaagagatggtgtacccgccgagataaaatttcttgacttcaatccaaattctcgattacagcaagacgtgagatttagtcgtacgctctatactttctcggtcgacatcagagattgacttagacaaaccctttcggtgcccgcacgaggctgataaaggaagtctaacgttatctctagactcaccgagaatggtcacgtgagctcaataacagttcctccgaagtctgcggttgagaatatgaactcgttcatttgcattgaagtcgggggctactgtcagggttatagataccacatacctaatagtagttgactaaatctcggcaggatcgaccacataccatgtcttatacggaaactgacctcgagggagttccggataaggaaagacaaccagaattctacatggaaacgacaaggactactcggattgtatctatattggtttccctagttctacttagacaaggggacacctatgggtataaatacaagcccctctaggaggacagggggacaaccatgatgagacgatcaacacgatcaacacccaccatgggacaaagaaccaccatagaagacacccatgacaatcaatatacgcccactagaagccacaacatacaagccaaaatacgccaagacaagccaccggatatcgacatcagagatacgcctggatcgaccctatccggtaccttcagaggccggccgtagggatctaacactgtctctgattcagtcgggcgcgagctcgaggaggaaggctaccctgttgtcgactacgagtcagatcgtcagaccgctatgtcgacaacagttagataggctaccccacatattgtactgatgtgattatggtgaataaaaagcaacatcggctccggccaacaggatgtagggctattacctgatagctcaagggcccgaacctgtataagaatcctcgtctctatctcttttacctcagtctcgcgtataccctagtatcgacgatccccatactgtccaaataccgtagtcgagacatcaaacgtcgacaatagttttttttatttcaacttagtcataacgtaattatttctactgttatagagagttagttctagtgcatagctaagttacttcttcaattttaataagtacttttaaattaataaaaatgtttgaatatattcaacatagatcttgttttgtcatatattttacgtagaatacaatgatacaaataaatcttgaaaataatatacaatttaaaagatataagtcattaaagagattaaaaaaaagacatgcatcataggctaaaggggtttaaacattccatatgcatatcttgtttattagttcctacttaattagtatacccttgttccctcaatagatagatggagtgatgagagctagaatatatagcatacaaaattgtgtacaaataaataattattgcgagctgaaaaagggaaaaataaaggaaaaaaagctagctagatgatcgatcgagagccggccagtaggtaggtggctagctatagaaatcggaggtaacgtttgatgacttcatcgaccatgagcttgtaggccctctccgtggggtggtagctgtcgaagaacacgtactgcggtgggtcgttgcacagcgggctcgcgaagttgcagagcacgctggctgccaacccgatgtatccacagcacgcatccttcccgttcttgaacccttcatttttcattagtgaattttatagtatgaaatagaaggaataaatggtaacaaaaataacaaataaaacttaaattagtatacatatacttgcagttaagtttgttatttttttacaactaatacgtagaagttaaatttgaacttccatgtttgtggagtgatatactacatattaatttatcttgtaaatttttttaaaaaaatttaaaaaatttattcataactatttgattgacatgtaataaacaggtggacgtccactcgggtaattaaaaatcgtctccaaagtttgagtgctatccgtgtggatgcaaaaagtgcatcatgatgttagaatagattatggatcgttcgtcgtacctagggcttggtatcggtgcatgacgtcggctaggatgttgtagaggtcgacgaggacgatcttgacgccggcgagcttcgcgttgagccggccgatctcctgcccgagcttgcggttgtacagcagcgccacctggttgcggggggtggcgcactgccgccgcacgccgccggcgatgatccgctgcgccgggacgcacccgacgggcggcgcgccgacgacgacgagcaggcgcgccccgcgggcgacgagcccgcggacggcggcgaccgcccgcgccgccatgaagtcggcgtactccggctccgtcatgccgtcggagacggtgaagtgctggatgacgtcgttggtgccccagcagaggaggtagagcgcccggtcggggacggcggcgccggcgaggcgggccttgtactcgtcgaacagctgcagctgccgctccaccgtgagcggcgtcatcatggtccggcaggtggcgttgtcgtagccgctccccgccgacgcgaagctcacgccggtcttcagctcctccgtgctcaggctcttgttcaggtacggcggcaccatctccttcacccccagcgctgacgctgctcgccattgttggatccatacatgcatgcaaatgatcgaattaacatgtatagaatttatttggcacatggttcggggtgtgtcctctggagcacatccttccacgatagccagttgtaggtatcgatgaaaaactttataacattttctttctatcttaataacatttggataaccttcttctgtcatcccggcaaagaaagtgacaacaatatcatctagacgaattacatgtactataaaattgatattttaaaactattttgaggacgagatcttaccatatatactctctgttttcaagagttgagtcgaaatatcccaagaaatatcagtggtcaaagtttaacgcattttttaaggggaagtttaaaccaattgactgcacgcatttaaaaaatcatccattttgtaacagggacatgtaaagccgtaaaaatatgaattaagataaaaaaatattatggataaaacttttatatctatgttatacacggtttaaaaataaatacttcaaaataaaatacatgaaaaacccaaatcaacactaaaattaaatacttacatttaaattttcgcaacgcaaagagcctccgagttgttactgtccctaggacatcgcagctaagctctcgcgtcgccctccccacgggcgacacgagaggagacgctgccgccgtcttcttcctcctcccctcctccatctttgcctcgccgccgcttgagcgggcgccggcaaagccgcacgcccgcggggatggcggcggcggggcttcgcccattaagcactcgggtggcccgggagctggcacggcggcgatggtggcaaacgtccggatccgcgcccgcccggccggatccggcggggacgcagttggcggcggggcggagtggtggcggcggcatctggcggtgtgtggtggcggcggacagggctggcggcggtggaaacccgctcagatccacgccgttttggccggatcttgcggggctgacgccgagcgacggcgggcggcggggaagcgggcgtgctggtggcggggaagaggcggtggcgggga

SEQ ID NO: 13792 - DNA, 3564 bp, Oryza sativa
cgttgtgacagttgcggtagcggctggacgacggtgatggggctgcggctagccggcggcgaggtggcgtcggcagcagtggctgcagtggtggtgggaggtggcatggtggcctcggtgggctagccgagggcgtggcagacggctgcatttcgccagcgtgggagagtacggtggagaggtcggagaccggcttggcgcagagaggcgcagccaatggcagcggaggccggctcggcgcgagaggcgcggccgatggagggaggacagattggcgtgagaggtgcgtctggtggaggaggtcggtttggcgcgagaggcgcggccggcggtggaggaggcgaccctggtgcgaggaggagctgctggtgggtgtggcgcagtcttcggcgcacgaaggttggccggcagggggcgccggtgcgggggtcccacatgtcggcagaggatgagtggtggtggagcatcggtgcgtcagccgtggattcgcaggtggtgaacggcgggtgaaaacccagcccggccttggctgggccgacaacgatggttaattccccctcctgagggcgttgtcgtgttgtctcacccctcaagggcggttgccgggtgaaagcccagtcttggttcctttgagccccgacggacggcggcggcggttttccgtcactcctctttttggagacgtcgtttttggcacccccttgcgtagggcgatctcgtctgtgttcctttgttggtctagcggcggccggtccggtgctagcctcctcctggtcgtgtgtgttggcgttgtcggtttgtggggggatgtatattttttcctttttcctgattatgacccttcagggttgtaatcttgtaattttttcctgatttatcaatagaacttcgcaccgtcttgtgcgagtcgttaaaaaaaaatcgcaacggcttttataagttaaaagaaaaacgatgaaaagatagatctagaaattagtaaattcaaaaggaataaatgacaaacagttacgaacgaaccgaggaggtcgatgctgatcttgccgtcggagaacctgccggtggccttgccgccggggaagtctcggccgtagggagggaagttggagcggacgatggtcgggaggtagttgttgttgcccgtgtccacgatcgagtcgccgaacgccagcaccgccggcaccttcgccgccgacgtccccggagccggcggcgctcccagaatggcctccaccgccaccgctccggcgagtacgagcacgagcaggtaggagattatcacggtggccatggctggtaatgacagtactgatgaactgatcagaaatattcagatcgtgggttttacagcttaatgatgagtgatctgatcacaactctcagtgagtggagaggctttgtccaggtgagtagaggtagttgcatgcaaacgcaagagacccggccaatctgcacatttctgtgtcttttcgttttagagtatttgagttactatctccgttccatgttacttgtcgttttgatttttttcttgttttatcattcgttttatttaaaaagttagtgtaaatgtaaaagaggataagttatacttaaagtatatttgataataaaacaagttatagacaaaataaataataattcaatttttttgttaataagaaaaaatcaaacattagaaaaaaattcaaaggggcaaataatatgaaccgaggttaggcatcgctcaccaacccataaatagccataaaattcataagtacagatctaggctagacatgagacaaccaatcgttgtttaatcttccaatttcactattatgcaccccttcgtcctgagcacttgaccgtttatttttgttacttttcgcttgacactcatccccttccttgtgtaagggtgtgtttagttcacgtcaaaattaaaagtttcattaaaattgaaacgatgtgatggaattatgtgtgtagaaaatttttttatgtgacggaaatgtaggatcgaatcacaataactaagccaaccagagggggtgaatggttggtatacccaaaaaccgaaaacttttagcggaaataaaagttaccctcgaaatcgacggatcgcagttgtcctgccggtctgaccacctggttgccatcggtctgaccgagattagatctccggtctaaccgccgagatcagctgccgctcgctgtcgcggccaccggtctgaccgcctcgccaccaccggtatatcgccagttagaccgccgaaacccgatgaaacataaatcgaagaactcttaaagtggatgacgactttattgattttctctgtgtttacaaagtgcaccaacagcactccttacaaaaatttcgactaaactcaaaaccctaactcaaaactctactcaattgctctcaaaagcgataccgggaagcctcacgctccctctctatttatatccgaggtagtcagcctaaagccacgaaccaaactcatactagaagtcctaaacaccttaggaaaccctttagtacaaaaaaacaaactttacataaccaatcgtaccaaatttagactccttgcaaattcgactccgcatcccatacgcacacaatacctccatcgtatgccatatggaatcttcaccaaccacgtacatcaactctagcctaagtatcccgcatgatctctgaccaccatggacgtcgtcttatccccaagccgactcctggtccatcaccgcaaatactctcccgaggcatcaagtcacctacacatgaaataaacaaagaaataatattccgagactaagctatctccaacttgactcattagtagcaaataatagtattacatacgtatagtatccatctagaagccataatcatgaaacaatcatggatatccaaacaaacaacccgaaaccgaaaccgacacagagtcggccggtcagaccgcgggcaaaccgacacagagtcggccggtcagaccgcgggctggtcggtctgaccgcgcgcataccgccggtctgaccggtataccctgcccggtctgaccggtcctgacaaacaacagtccctgtcaatcacctataaattccaatcatctccaaaactacttcgtgaataaattccaaataacaaaaccaataatctctaatgccaatttttcatcacagaataacaatcaaaaacacctttgattttacatgaaaagttagaggtttgaagaaaaagtttggaactaaattcggcctaagtgattttgccggttgctagagccagtttgtgtgccgacatggtgtcatgcgtgggtccatgggcacaccggcggactgctgtcggtttgccctgtgatgtgatgtgatagatgtctacttgacgccttagggtgagttcgctggttctgttcccatccagcacgtagtgaacacgaaaaacggagcaattcattagcgcgtaattaattaagtattggttaatttttttcaaaaatagattagtttgatttttgaagcaactttcgtatagaaattttttgtaaaaaacataccgtttagcagtttgaaaaacgt

SEQ ID NO: 13793 - DNA, 16091 bp, Oryza sativa
tccattttgtttttttggttcttcgaggcctaaatatattgattgattgattattacaacatatttggtatggtatgcgtcgattatctttgtcgttcacccagctactattattttatagctacgttcgccactgttggaagctaactaatgtgaagactcaccaaggcacgcacaaattatcgcatgaatcaagataatatttgcaacatcaggggagcaacaagaatattttcctttatttcatttgctggaagcacttattattctcttattaccagttaccgacagcaacatcatcctcagataaatccaggcaactatccaaattaagcctttccctcacagcaaaagagagaagaataaaaggccaaaacaaccgcagttcagaatttcagcaagaatgtgcgtatctccatcggtccaagctcaacaacaagggcgtggctgtcaactgggccacccttcaatggtgcaggatcagttttgctctccccggttactctccaattgagcttcttcatctctgacttcttttggtttgcagataggctagtctcagtcaaatctttgatctgtacaatggatttgagcaaacataattaaattaatgttaggtctcatctctttatgcttataattattttacagaaacaatttctgttaatgcagaaaaacaagggctgtgtgagtgtgacacatcacttactatcctctttccaaacagctttctcaattcaacctttgccattactgaatattgtgtgtcctcttgagcctgcaagtccaccaatataataatgagtatcatggagaaatatagaaagaaatttcatatgaactaaatgtatacctgaaaaagatgcgccaatcgaaggagtgtggtgccatcatcaagactctgaaatgttgagagatgattttaaatgaatttatcaccaatataatgctagaatttaagaggcaagaaggaatttttgtgataacctgcaaggtgatgattgcaacattatcaggaagactatagtttccttctaccgtacttgcttttgcaatattgttggatttccaactgcgttcgtcctgtcagagaaatataggccgagtttagttccaaacttttttttcaaacttccaacttttccatcacatcaaaactttcctgcacacacaaactttcaacttttccgtcacatcgtttcaatttcaaccaaactttcaattttaacgtgaactaaacacaccctatagctgctaattgtagaatctgtaacatgattttttaaaagaactgatacaaaaatggtataaatgtacctcatgtgcaaaagcaacaaggaacggtgaataaacttgttggctatatgttcggcgccaatgagctccatgtcctttcttattgacattgatatagtaagttgccctggcctgtaaaagtttctaccagtcagttgcaagatctatagagaatgtgatatcaagttgtatatcatgaataaaagagagagaaattgttttaaatgaatgtcgtataccactagcccatcgcacttttgatccacacatactacttcattaagtggttccccaactcctctgccatcgtctgcagaaagacgcctgacacaaattattcatggttagatgtataatgtgcgagggagctaggaatataatttttcattccacgaaattatcgctaaatttcaagatgttgtaaattagaaacctacgcagttaaacaatatagtgaacgaacctgggtaggttccaaaaatgatttttcaaaacttgggttgtcacatgaaaggattatttaggatgaaagggtggtgaaaggaaatagattggattataaaagtaacatgaatgaccctggaccttgacggcgcgacggagtaagatcacatcccgagaaggcagagccggtggagactaagataaatcttaatcaaatacctaatgaccagggatatgatctctccttatataaatggaggactccttcacctaatccacctgactctatccaaatgagctacgtacttatcgtgaggtcgtgaggggtgaggatatcgttcccattgggcctaggactcctgtcccaatgcccatgacataggttggatagaaaaggccctttttcatttttgctttggccagctcctctaaattcaagctgtattttggtttaaaaataacagtaccacattaagatataaaagacaacacaattagattggtgtcaacaggtaacagaaggaatatgatatcgagaccctaatggaaaatggtctggtgctagattcagtcatccagaactagatcaggatactccagccaatacctgtggagcataacttcaatctgaccatcttgaatactcgaagctccaacagcatgatccacaaggacagatagttcatatttcccatctgctacatatattccttgattgacctgcagagttaatgcataagaattagcaacaacagtaaacaatgttaatattgttcagaagcatagaagaaactgattgatacatgcaactcaatctatactactcaactggaatatatttcctcagatgggcatcatgctatttaaggaaaacagagagctaaaaggaaaaatgatactctattgatcttcaatgaaacctacccataacagtcaacatttgtaattttttttcttttgaaatagcattaagcacatatcgatccagtttgcacagctagcatagcttcaaaaagtgtcatccacaggcatagggataaaaacactgcattaatatgcatcaatttgcgatggtacctcattatgtgaaggttcaaaaaaaggctgtagttaaagagttatggtggtatctagaaaacctaagatgaatccactatgaaaattttaatattgtacataccgggtagtaatttcctgcaacaggttgagacaaattaaggtcccaatcatccctgtggtttctcacctgaaaatgaacgatgctttctgtgaactttggtataagagtacaaaaattttaaaacatccataccacatgttcaatatgactattaactgtttcccataaaaaaacaatttcgatataaattatgagaccactcgaaataaatatatggagtgcaaattatatagatattcaccctttcgaggaaatctcttccattagaatctgtataaaatattttgttggtggccatatttgttgtcagtctggtaacaacctcctttcctatgtcatcatcatcatcaacaggtattggtccaatctttcacataagagagaattgcagccaattagatgcatgttaaaatatggaatatcattgttcatcccaaacatttatttttgaggtggaagattttactaacagtatattcaacttcagcgtgctccttattcttgtagagtctcgtgacctaaaaagatcaagtgaaccacactatagttacaatcctgatggacgaacgtaaatttgagtcagtttttttttataacctgataaatccatgagctgaactgttggtggacttcgtcaacaagaggtccatggataactttcaatggcgcctaacaggaaataaaatacagaactgtatttataatatagataataaagaggtgcaattattttagtaaatgttttatttattatttatgtacttgagtgctctcttagtagcaaccggagagactacatgcgtaaaagcaacttgatagacaatacaagattatttgtttgattgtcccctgaaatactatactatgctattttagtttatatcttttgaagtgatttgatgttaggtgataatatgaaaacacaaaatattaggttccatgtacgccaccactgattcagcagtaattacttgctgttattcgaaattttaccctcatagaatctaggggaactaatgtcacaggacagtatatggatgataaataaaagaaaaccaaatgcaaatatgagatgggaaattctgttaccattcctgaaactatagtcggtgtagtcctatttggtctgaaaatatatgctccggatgcctgtaattaaccgtagataactgaaacggtcgaatatgtgaataatatgttttgcaattgagaaagttttagtttcacataaaacctgtgaatcttcagaatctcccgtgcttgaagcataccaaagaaagctctgttgaattggcaaatccacctgaaagaaactcactagttgtggtatcgcattggtagatgccatagacaatacaaacatataacaagtttatcactacaaacaaaatgaattcatatggcaaacttgatctattttataattatttcctaggaatggatctcgtagaataatttattatgccatcattttatttatcatgcaagttaagcaaaggagaaaccagtactagctaaatctaattttctaatgtaacattctgcatcaaaataattagacacgcatggataagaataataaattatatgcataatgcatttaaaaagatatatgttgctgcataaaattattgagaaatccccaaaaaatgggcaaatactacaagctcaaataggtttaaataataggcaaaatttgctacagaacactcaaaaaacgtgtaattggctgggagacactgcaaaaccatgatacggctgatggacactacaaaaattgtgtaattggctataggacactggaggcaatattttataatttccggctcaaaataggtgagaaacttttcgaaatagcgagattacccctggcgccgctcctctccagctcgctcgccctgtcacctagctagcgtcgtcgccaccttgctcgcggccgcctcctggtcgtgctccacgcgtgccctgagctcccacagcttctccttggtgcgcgccagcttggtacgcacgtcgttgagctccgatgcctgcgcctcctccaggcgatgattctcctcctgcagcgaggcgaccttcagctccagcagccgcgcctccacggcggtggcgggctgctcaagctcacgcgctgtggcatccggctcccagagctcatcgagctccgccagcaggagctgcagcagctgctcctgctccatgagcgacagccagagctccttcaacctctccacctcctcatcctcctcccgctctttctcctttgatcggtcatcgtcgcgcgtcatctcaccgccggtgcagccaccgtcagcatttcctctggccatgttggcagcggcgggaggcatcacgactctcgccacaatttttggctcgtcgtccccggctccaactaacgtgccgtgaataacgttctccaaactttatcctttcatgccaaagaagaggaagaattaagtgctccatcgcccatcgtcgccatcatcgtctttgtcggcgcctcttcttccgccaccaccaccgccgctgccgccgccgatgaccaacctaaggttagcatttggggatttcgagtgggagaagatggcgactgggtctggttctaccgtacccagtcgtgcatagatgttgcggcaccaggggcaatcccgccatttcaaaaaatttctcacctattttgacccggaaattataaaatattgtctccgatgtcctacagccaattacatattttttgtagtatccatcagccgtgttacgtttttatagtgtctcctaactaattacataatttttgagtgtcctgtagcaaattttacctaaataattttatataaatgaatgatgccaaaatcttgttgagatagatcaaatctatgcaggaattggtttacccaatggtcatcaaatcttatgttgtgtcacattttgatgtaacagccataaatttcattgtgggtgctacaaatattagaggaagattccttcaattttgtaaatagatcttctttttttcagaaataaatgaattttagactcactgcagagatagaattgaacattctcttgagttgtccagattttgatgaataggacatcttcagaggccctggtccaatttctattgtgtcattacttggagaaaccatggttgagacataccccattccattagatcctggataattcgaaggttaatgatgtaaatcaacagactaataacaacaaagttgaatacaacaggtatttgctggccgtgtacatccgacttttagtcttttagaggcgggttttacccattttcttaaaaaaaaaagataaaagaaggtattttgagcacccccactggaaaatgatacaatgtcccgccttatcaacaaaataattatgtttatctgaccaaaaagaataagcagcacttgcgacaggacaattcgataaacctaattatgtcaagattatgaagtttcacctgttccagtagattttgatatgaagtaggtgttccagccgagtggtggtacagaagcttgaaaaactagccaatactttgggggtttatcggacgtgattccaagataagcctttatgtataacttccttaaacgtgctgtcacgatatcaacttcaactagttgtgactccagagaagttccatcagaggtttttacaattaagttggcatcatttacctgcaaaatagttaaaataattatggaatacgggttagtcaaagaagctagatctagtaaaaagagcacatggtttatcggaaatttcgttctatgtgtttacaaagtatattgaagtattttgattaaattgaggtatatttttctccatatggatcattaagaactcttaatctataagttcttgtgtagaccatcagaaactactgaacagaacggttgagcagagctttgaaaaacttactggaactcttacaaagtcactacgttcccatccaagaggattataaacaactataacctgcataggatcatgtcaatatatgaaaaacttaactggcatttcttgtaatagaacagattactaatttgtacttactaaactctttgcggatgaaattccttcctcagttgaagggcagtagctaatattgagaagttggcactaaaaaagttgattgaacaagacaaatagtcacaccagggaaatatgttccaaaattgcatatggaaattttaaaatgttatttctgaaactgttgtgcaaaaacagtcttaacaattaatattaatgattggccaccttttacctttagttgtagaatcgtaatgctgatggaaaatctagaagaaactaatggtaaagagaaatgtgacaaagtactagaatcactaatatttattctttgtgaaaatgtaagcatcataaacaaaatcaagtacatatttatcttacctgactaaattttgttgctgtacatgttcctttggaacttgtgagacaacttagagcagtattaacacctttctcaacctgaaaagataggaatagatattttgctctattataaattatttgattaaataatagtacatcatgataaatcacggcaacaatttctgtagtaaatattatgaacctgagaaaccccaatcgcaaggcgtttcgaataatcatcagttgtgtgttgctttgccgttcctgagactgcatcatgatgttgggcaatccccagtggatcttccaagctagaagtaaacaatcctaaggaacttctacccaccaaaaattccaattgacgcgcagcctgcaggaaaacacatgtcctaaagttaagttattttagagcttctaaatgtctagtttaggattattatttttttaaataaaagtactattttaggcatcatcataattcctgtagttttcgacttgcattgcagaaatatcataccaggtaatatccactgatcattcgaatatatcgcttgaaagttggacggcttgtaaaatatccagtccagtaagcattttttgcatcagcatacctgcaatatgcaatagaatgagggcatgaaggataactcttcttactgatttgcgaagttcggtaacttacgggaaataatcatcgtatttgagtggccatgattcattcgacgcatgttttgcatctgtgtaaatagatggagtagagtacagtgcatgcacacggccatcctgcgttttcagcacactaagctttctttttcaagaagagaaaattacccagcggcttagttattaaaaccagatccagggcctagtcattctggttttgctaaacgaccatccatatgcttgaaccgtcgaaaaccgataaaacagctgttaaaccagggttcaatattttggttcaaaatgttcgaaacctcggaaccccaccccacccccacccccaccactatttctcaagaaaatttcatttcttttgaattcagtataattaattcaaattcgccgattcatattcttctgattaaattgcagaaagttaaaaatgatcagaagagaacataaacggcacacagacagtctgatcgatagtctgaagttaaatttgtgaatcagcaataccttgttcacataattgataagcctgtccatgttccggaaccaagactcagcatactggtaattaaaatcgtcccccatagtccacattatgtggtttgtgcgcgtaacatttgcctgtcacataaaaaaaaaagaaggcagaatccaaatctgggtttctgttcaatgctgatttttaactgggaagaaataaaccaagaaatggaaatttacctgttttaaggctgcagcaacaaaatcattcacacgttctttaagattgtagtcaaacagcaacatgtcatcctatatcgaaatggttgaacaatcaattgaaatttgtgtatctggggataactgaaactgctgatctgcaaccatgcatatacctgtacaggtacaaaatcatcgaaaatttcgaagccgaagccatctggagggctataatggacaggaaatgcatttgtgaagatctgcagtttaatcagatgtttaaatgaacagtgataatagaatcaacaacttaacaacacatgataagttactaatgaatagatatgaaactatttgcaagaaaaaagaacaatagtaacctgagaagatgaaccaaatgttcttgagccgcgccatataacctctaggcctttgtctcctttacgctttgctctatcttggtaatcgattctcgcaaaatgcatagaatcgaaaccaagctagaattgcaatgtaaacaaatgtaaaatctccacactctagcaccgatattatgaggaaaaaagaattctatgacacagtgaacttcttgaacatccagcaaaatgatacatctggcaaaatctaaactttgatatgaagataacttaaaacaacaaaaggactttaggtacatttgcacaaatacacataaatagatttgcaaggctttcagaaaatggaatagtatgtaggagcatgagattatagcggtccaatagttctataaggactcgacatgcatggtgctcaaatgtgatgttaatattacctctgccccaagcaaataaccttgaactgcagaatgaccaaaaggatcaatttgccagccagctcttgggatcttgttaaactgtttcttgattacccgatgaccaagtgtggtctgatcaatcatgtcaatataatggacggcggcttcatcatgcatacaccacccaccatttctgaatttaaaatttccaaattttctcaaacttctaaagacaaaatccaatatagcaatgagattgaatcccatacatgaactctagctgaccagaatcaactagcttgtggactatggcctggatttttgggcttttctctgcccaccatctttggaagaaagcctggaaggaaaagacatatgtcagtctctacagttgatgtggtccaacaccaacaattcttggcaggtagtatacatataggacttttattcttattactccctccattccaaaatataaggatttctaggatgtttagcggagattaaggttatgaagagaagacttcagtaccctcaacaaatatgggatgggtgggggtgggagggtaggcgagagtaagacggaaagaaatttaaatgggatatgattgatgggacaactattgttgtgaataatgttaaaagtccttatattttgaataaaattcaaatcctaaaagttcttatattttggaaaggagggagtatcaatctatgagttagatccattaagacatttgagatttcattttcatttcttaacttcagtcatatttttatgaacaatttccctgtgatctattgagactccaggaacttacaggagggatgccacctattagtctgtccaacatgtcggtgacatagaaagttgttttgaattttggacttgctatgaaaatttcaaagcatgaaatttgactttccaaaaaagtttcaaggcctcttcagaatcgattcagttgaaagacaagaaatgatttcttttcctcatggaaacaagttcaataagaaacagtttcttctctgaatgtagcagtttgtactttgaaaatacaaaaaagtaatttaaaaattcatacttttttgacaaggaaatttaaaattcccgtttgatatgtcaccagtcaccacatgcacctacgaaacgattcgtcctccataaaagttatcattgtctcgccataaaaaaaaggaagtaggaagtcagcgatttactgatattttttaagccatgtgttttgaaatgtcaattttctacttctctgaattctcaaatccgaatactacctctgattggtacagacaatcatagagaggcaattgtaggatgaaagttcgattgagtgagacactgaattatgggcatgcttatccagaacaggagcgaggtctggtatggtccatgggccattgcttgtcctctccctatactaaaatataagcacttctgattttttttttcagaagatcaaaacgagggatgaaattaaatgggagaaagttttgattggttgagatgaaaaagtagatgaagaaattaaatgggagacgattatgattggttgagataaaagagtagatagagttgcagtattttgaaccgaattttgaatgttggaaattgctatattttttggatggagggaatatcctccaaaggataaagtaaagcagacaagagacacttccccacaggccacagctaagctagaatatggtatcattggaacatagtacagtacaaagtagggattgatgcacatgtactactaatttatcaagcacattaaaatatttgcttctgattgtcgtggcaaagttgatgcaaaacacgaagccactgacagaaacgcaggaacagaccataatcacggatgtagaaacagaatagcctctcaaaaaggaaaaaaaaaaagaggaaacgattatgaagtatatctggagtatgttttgctttcatagtgaaagaatattatgagtgtgacgagcatctttgtaaacaatatgtgaagaattcctcatgaagccccagcaaagctcaaccaccttagcttctttcctaaattccaagcacaagatggcaacacgaaagtagcaccttttttggggttgctttctcttatctgatttagtccttgtactcattctacacttgtcatgcaattttgcagcactgatttcccaaaagaaaaaaaaactcataaattttgggtttatttagagctgaggcgaggtgttgaaaaagcaaacccaggaatcagtaactagtgagacatcatcaaacgagaaaatttagttacacgtagtaaaaattcagataatttagttacacctagtaaaaaatcaggcaatctagttacccaaatcatttctagcagaggtagcagataattagttacccatggtaaaatcatttctaccagaggtagcagaggatgttggtgaaatcatttctaccagaggtagcagaggatgttggtgtttgtaacagaaaacaatatcacagagagaaattaatcgagaaggaagaagaaggcgaatcgggcggagcattggtacgagcacctcacctgctctgcgaagacgaacttgcgcgcggggtccaggatgagcgcgtccaccacggagtcgagcgtgttcatcacgcacgcgccctgcaaatccccccatccccaaaccccaaccacaattaagcagcgcaccacggagcagaacagagcacgccgggcggcggcggcggcgacgcggacgaacacctagccgcgctggtgtgaacgcggcgaggctcggcgaggggagggggaaattacgttacctggatggagttgttggtgccgacgaagtactggtcgatggtcttgagccacccgacgtcgtcgtgggagtgcggcaccaggtgcacgttcagcttcccggccaccgccccggcgctcgtgttgtaccccgagaacgccaccgccgcctccgccaacgcaagaaccgccaccaccaccaccagcgccgacgacgacgacgccatgtcgtgtcggaagtgatcgatgcgttagaaactaggaggaagcatcagaagatgggggtggtggtttccacgaggaggatgaggatgaggaggaggtcacgggacggaggccggtggccggaaggtccaaagcggagggcggcccggcggccggagaagagacaagatcggtggcaggatggatcaacagggactgcaggatatggtcctatgtgaattttcctttgaaccctcaaaaaaagggggaaattggttgtatgtatcaataataagagataagtttttgtttttcctattgatgaagtatggccttgtttagttttcaactttttcttcaaactttcaacttttccatcacatcaaaaactttcctacacacacaaactttcaacttttttacacaaactttcaattttagtcaaaacttccaattttagtgtggaactaaacacagcctatatattgtagcgttggcaattttgactgaagatgttaattaatgggtttggtaattttgaataacggttttatgagtactaggtgaatgcatttgctttattatgggtaaaagaaaacgtattataatatcatataaataaaatatgtttccccatgcgatgttgtaacctgtcttttttactgtatagggaatatccgcttgtatgtggctatccattttgatttaattatctttaatatgaagaagttcatgggactaatctgctaaattcacaacaagaacaggtgaggactaatttgtaaaattacaattataatacattgtttgttttaaaggagtatagaaatggtgactaagcgtgaggagaagattaatgcggagaaaaagcagagctagtggtaaaatgatgacatcagttgatggaaaaataggagaagaaaagaaaatggattaagttagaaaaaatgttaaaagagtattgtatgcgaaatatggggcaaaattaccaagtctgttaactgtgtggaaaatccaagtacattcatcactgacttcaccgaattcctggaggagaagcaatgaacaattttctctgcttttcgccatagaattttcgcacaacgtacactttttgcacaacatttaatcattcgccttattcaaaaatttagtataaatacgtaaaagtatgagttaggattatattttatttgatgataaacaagtcacaataaaataaatgatattcgtataatttttttaatattataagactttcatattataagaatttctagtattgtccacatttatatagatgttaatgaatataaacatgtatgtatgtctagattcattaacatatatatgaatgtggacaatactagaaagtcttataatataaaacggaggaagtaaaacattatgcggaaaagtcaatggtggcatatatattttgaaatttgaaatgaagagggtataaagtcaagagcgttactctctttactggaagtactatatgtcttgagtatgtaatcgtggcgcattattgtatttcatctaacgtaattaatccgtatatatgatgactaaattaattgagtgtgtttccatgtgatgcgtgcactacacctcgtccctgatctaccctacgacgacgacgtcatttatgaacgcacacagtcatacgctgcgggcggaaataaacaagccagccggctcatgtttatcaattaagaagatcatgatccattcatcgacttgtacaaggcgacgatgcctcctccatttctaaaatatgattgatgtcttgacactataaataaatctggataagagacgactattctgattcggaagatgaaataaaaaaagaaaacagtgtagcagagagagacccggcctggtcgatcagtaactgcatcttcgggtgggaagtcgccgtagcgcttgtcggccacatctccgacgccgactgcgtccacatctacttcctccgttttatattataagactttctagcattatccatattcgtatatatgttaataaatctagacatatatgtgtacctagattcattaacatctactccctcctccaaaaaatataacaacttttagctcttaagattgtcctaaaatataacaacttctcaccaacattctcttcccaaccaatcacaatcctccaccatctcattcacttttcccacctatctccactattcattcaatcacaatcctccaccactcacttctacctactttttttaataaccgtgtccaactctaaaacttcttatattctgggacggagagaatatattaatatggacaatgctaaaagttcaatcgtccacaattattgcatgcatgcatggttgcatgttgctccgtccaggtggcatctatgcagtcatgcagagacccagctcagctagtttatccacactccttaactaattaagcactgatcagaatatggacacgacacgaataattggggaattgttctccaatctctttcctgttatttttgtacgagcaatacattcttataagtcgatttttttaagatagtggaagccgattccacaagatgatcggaattgggtcaatcaaatcaccttctcaatgtataaacaacatctttggttctttgctattgggcgcacgcctgagcgaatgcttcaccttcacgtgtttcaggtgtttctttttttcgaattttatttatttatttatttaaaatttaaataataaattaccgtttcgaagttccatagaaatgtactcctacctaaccgtaggacggagcatataaatcgccctatgctaaagtgagtaatatgacgtgacagactgagaattttgcaggagctccttttttttcttctgttggacgatttattgtcgagagagggccacatgcaaaaatttcctaataggttgtcctaacaaagggcaatttatcaagcagctccctggtcttattttgcaggcgacctcttcccgacaataaatcaccctatgagaaggcgagaaggggatgcctgcaaaattgccacgatgcgctcctcctatcatccatcacgtcatatttctcaccctacggtagaacaatttatatatgacccgccgtacgatagggcgggaagagtatatttctttaaaaaaccaaaatggtaatttattttttaaaatcttttaaaaaataaaaataaaaaattctttctttttcttctttttgtgcgttatcacacgctagaagctgcacagacaagacctttgtctccttcatctcttgttcgcatcccttgtaacggcaaaatcgggtataatacctcttctaactttaaaaatcggtgtaaattgacttctttcaatggttttaaaaacggttttttgatgacgtgacagaatgatttggtccaagtatactgacgtggcaacccagccatcaaaggaagtgaaaacagatatggatcccacgtgtaaatgacagagataaaaataaaaaatggtggctcacttgtcagccccacttctccttatcttcttcttcctctcacaggcaaagctggcacgcacggcgacggtgacaagcggca

SEQ ID NO: 13794 - DNA, 602 bp, Oryza sativa
  unsure (1)..(602): unsure at all n locations
ttcctgcagccactcccggttatttcacccgggactaaagatagcgatctttagtcccggattggtactcccggtttggaaaccgggactaaagggggttacgaaccgggactacaaagggttctccaccagtgtcagtatcaggtttatgacagcttggttaactatgcaaaattgcacataattaaacatcaccatatcagtctcaaaggtatgcatgacagctattttaactcttatcactgaactatacgccagaatgcacgtgtacaaaagccaataggcttgtttggtcgtggactcgtggtcagcttaaaaattaacagtgggataattttgtaagcctagctatgcccaaaacgaagggttcgaaaagacagtaattagttataatctctccgtctctacctcaaaaattaanctaaaagagtgtaattaatttgtctgtcaaaacatttcattctcacatggttccatcaggctctttcaacatcacatcatttttttcgtttttcgatcttgtcagaccatgtaaaccagtnaggtattatttgtaacacctagtttttttttcagtctttttgtttcaaatggtgaatgtg

SEQ ID NO: 13795 - DNA, 36164 bp, Oryza sativa
tcacgggtgagactccttttaaccccaccaaccttatcgtctctcgcactctcccatcgcccccatcccctcctctctcggcctgttgctgccgcccatccactccagctcacttctgcgtgcatcgtcgccgccgtcccaatcctcacaaccttcaccactagcaccgcccatcatcctctcttcccacttcctccacctttcctgcagctgtggcaactcccatccactctcaccgcatccaatggatcggcggcgatgacctcagtgtggagatggtgacgacgcacgcatgcatggagatcacgctgctctcgccggtgggaggtgattgggggtggggtcaccggggatgacgcataggcgatcgtgataaacgggaagatggcaaatgtgacggtgctggtggtgaatgatgcggcagcgggaaggttgtgagttcttgatcttttttttattttatttaagatgagttttttatcctacttgtgtagtttttgatgttgtgtagttcttcatcttgctggtgttgctttgttactgatgggaaataataattgaatatttctatctgtgatgtgaatggagattattgatgctaaatcaatatagagttcttgatctgtacatattgtgtatggggattaaaggcggcttgaagaaggtagttggatgcatcggttcattgagccgatgcttctagtctgtctctgttttttttaattgtgggaagtacaaaaggtgttggttctaccaccagcaccaaataaccattggtcattggtactagtagataaatgggccagttgcaaaaccgatttttttgtcaggtttgcaacccgacaccttttcggtactatgtattagtgtgtgccaatcagtcacaactacacaactatgattcatacttgagtcataagatatttgggcagaacacaataagttaaacaacgatatatttaaccagttctcagtagcaaccgcatgcaaatatatacacacacacatatacacatgcacacgcattattttacacccaaggatatacaagtccatgccaattggaggaaatcaacaaaagcacaaattaactagaaaaaaaaaaactagaacaaaacaatccaatgcacaccgattaagttcttgttttagtttagctctgaatgctaaataaatctgcaagcccctggagggataaagccaccctagcgttgtctcccttgttggcagtcgggtctccgaaaatcaccgatatgatgatgcgcacgacacccccgacaacaatgcggtcttgttccgacgaaatgctcttgagggggccctccttcatcatgagctccttgctcgccagcatgatctggcctccgtgtttcttctcgcggcccgcctgccatctcttcccggcgaggtgcttgacgcaggccacgtgcaggtacacgccctcgccgttgatgttggtgtggtagcaccacagctcacggtccggccctttctccttcttgcacaggctgcacttcctgggtgcccggacatcgaagtcgtggccgtcaagggtgatgggcccctgcaggctcgcgcagcacgggtggaggttcaggttggtgccggagcagtggtagacgaagccgcgcacggagcagtgatagacaaactttacaaacttcaattgtaccaaatttagactccttctaaattcgactccgcatcctatacgcacacaatatctccatcatatgccatatagaatcttcaccaaccacatgcattgatgtttagcctaagcacgccgtatgatatcctgatcattcggacgtcatcttctcccaagttgactcctgattcatcatcggcaacattctctcgaggcattaagatcacctacacatgcatcaaccaagaaaccatattctgagcacaagctatctccaacttgactcattgttagtaaacaacagtattacatacgcatagtatccatctagaagtcataaacataaattatccacggatatccaacaaaacaacccgaaaccaaaactgacacataaattatccactgatatccaacaaaataacccgaaaccgaaactgacacagagtaagccgatcagaccgcgggctggccggtctgaccgcacacatagctccgatctgaccggcagcacctgcctggtctgaccggttatcacctgtcagcaatatctcttgttcacctgcaaattcaatcatctccaaaaccactccaataatcctcaaatattaaaaccaataatctcatatgtcaattgttcatcacagaataagaatcaaacaaactttgatttaatctcccccttgatgagcacattggcaaactcatcaaaaatgttttagtgtttggaaaaataaaaacaaaagtggtaaaaagcatcggagtactcaaaaatccagaagaaaacttctttcgttttcctttacctgaaaaacatgcacttgtatctcttctccccttttgataatgatttcatcaagcatagtaattatgtttattaatattcaagagcttagcattatatatatatatatatatatatatatatatagcacatcatatcatgtgttgcaataaaaagaaaatgaacccatccaatatataacaagcatataccaaagtataatcatgaaccaaagattttacaattaagttcaaatcaccaatcaaaattcatgatttcatacaatttataatgcaacatgtttacaagcacataggttgaaaaataaaccctatacatatatacctattacatttatcactctttatcaaattatttaatcagtactcagtagcaaactgcatgccaatatatatacacacacgaattattttacaccgaaggaaataaaagtccttgccaattccaggaaataaacaaaagtacaaacaaaacaagccaatgcacaccgataggtcttttgttcttttcaaggagagtgatcacacaccagtttagctctgaatgctaaataaatctgccagcccctggagggataaagcgaccctagcgttgtctcccttgttggcagtcgggtctccaaatatcactgagatgatgatgcgcatgacgccaccaacaataatgcggtctttttccgatgaaatgctcttgaggggaccctccatcatgagctcctcgcttgccagcatgatctgccctccatatttcttttcacggcctgcctgccatctccttccggcgaagtgcttgatgcaagctacgtggagatacacaccctcgccattgatgttggagtgatagcaccacagatcgcgttctgggcccttttcctgcatgcaaaggcagcacttccttggtgccccgatgtcgaaggcaagcccgtcgaggatgatcggcccgtgcaggctggcgcagcacgggtggaggtcgaggttggcgccgaagcagtggtagatgaacccgcgcacgggatcgccgcaggcgtcacagaccctgcggcccgagggaggcagaggcttgggacaaaacctgaatatgcggcctttgtacatagggtgctgtagaatggccggcagaggttggagcaaaacgtgtgcatgtcaaagttgcaggcgtcgcagcggtatctgggagcgtatcctggctccaagcagccgtcacagcggaacggcatgtcacaagtcgtggtcaccaggcgaagcttgtgctgcgggtggtcgtggtgggtgatcatctctggctctgccacaggttcctcctccggtgctataaaacatgtgtgatgcagttagcactatatgccagtgtatatattcgtaaccaaagcatatatatctcgtagttaattaatccagttaagtatttatcttacgttaatcctagcttgtttatctatttggattatgcggagcaagttgtttgcgtttaaatctaactctatcctaatttcatcactaatatattaatgccattacctcgtgagagataataattgatatttcacccatccgttttcatagccaaaacccattgtcaaagttggataccttctcttctctcccaaaagggatgaaaacttttaaagctaactctaccgtaatgtgatcctcatatattaatgccattacctcatgagacaccctttgagatataacatttcaacaatcagcttgcctatccaaaactctttgttaaagttgcgtaccttctcttttctccaaacaggggtgacttcagttctaccccctccatcaaaaagtcaagacatatttcactttctggttttctaaatgagatggacatatttgtagttttgatgcgctaaattaaattgttgactagaacccaagcagtcatcttaatactcattggttgcatgcatacatatagttccttggttttatcacatggtagatgagttattccccccttggtcttggtgaaaaaaaactgccttagacttttggatggaaggagtactacatatctgcctagcttatttcacatggccactcatcagcaggcttctcatataacttttggctttccaaaaggtcaattaatttatcgatttcaaaaagatgtgctgcacatgatttcaattggaaagcttacaattatctgtacacacgtaattcccaaaatttaggcgtgtatgactagcattaccttttaccccaaacaaagtttgcccaaagtaagggttggaatagataaaaatgacaatgaggtgtattaccttgacctggtgagaacaaaggctccgtcaccgtttgagacctattaagagcaacaattcaacttagatgtacaaataagacagattagtgcaccagttctcaagctgtgtatccgcatatggccaacacatcaattttttttttttactgtgaagcatccctttcttattatgcttaaaattttctagtatagaattttaaataaattttgcgggttcaattttcgttttattttactattcatttaaaatgtccatttcattcactctaacaatttgattgggtcacttaaacccctaaacaatttttagctcatgttacaactgaaactattaactatggttcattatactgcttaatactcttttttccagattcatagtactaagttgtgtctaatacagtactatgtcactatattttgagatggggggtacattttttatcttttttttattttttacaagtcttattttaagctaaaattttttaaagccatagatggcatcattatctaagttccataatattttcaatttttttcatgattgtttgcttgaacatttaaattttgatgtttaagttagttttaggtgcttccaaccttgtaaacaatgatgaaagttctaaagaaaatgctgaggtaagacgtaatgcatctatcagtcctatcaaattcaatgcaaaataccatttatatatataggtcgagagaatctacaaagtaccactgagttcaacacacttcaacaataagccaccgaatttgttgatatccataatatgccatcgcattatccttaacctctatgatttgccatcgtcgcgccgtttgtattgttaattttcttagttatgaccaaaataccctttgaatcatctaaccctagcatggcccagggccccttttttcccagcatcgcatctcccagcgccgcatcaccacccttcccagtgccgccacagcgccacgcctcgccaacgtcgccatccctagcgccgacccgaccttcgggacccagtgccaccatccgtagcacaagtcagcggtggtctagccaccatcgtcacatccgacgggagacggcgcccctgttggagggctgctggtggtgctgccatcgtcatcagcgttgccgtcgcaaacaaggggacacgacgtcgacgcccctgctggagctactgctggtgccgccgccgtcgtcagtgccggcattgcatgcaaggggacatggtggccctggccctgttggagagctactactgtcgtcagtgcaatccctcaaccgctcctcaacagtcacggcaaatcaaagctctaccccctcctgtagccttggagatatttgttcataatcaaaatacttaaaatatgtgctcataattatttataatcatgctgcttaaataaagatatttttcatatgtttagtaccgttgtatgttctctttatagttattataactctcggtaccttgcacggtatggtctcagtgctgctgatcttcactaagggcatacttgtcttttctccaacgcaaactaacaggctgtagatggcgatggtaaatcgtagaggttaaggaaaaggcgatggcatattattgatatcaacaaagtcagtggcatattgttgaagtgtatcgaactcagtggtactgagtagattctcttatcatctatagtgaaatgttttcaatagttttatgatgtaaaatgactgaaaaatagtttacggggttaaatcctccggctaaatagttcgagggagtaaaatgatttttttcttattaattgcaaacttgtacatatatagtttttagtgaagtggtatactcaagagaacgtgatgaggaacatcacctgaccaattcataaagtataggtgttacaagtagaattggattttctctactaagaacaagaagtcaaaatttgagttttgaatctatagtacatacttcatgaaaactcaagaataattatgatattgcatatgtcattatatcactagaaaatacttgtatgtccaatgagttgtgttctaagtgtcattgagtaatagatgagttgttttgagtagcatcctagttgtcaattaggatgtcatcaggttgtcatatagttgtatcgagttgtagatggctttgtagcctttaaatagaggcaatggcctctagtttggaacttacttttgcttaccaccttatcaatagaactagatgttcctattacagaacatggattagatcttctttggagctttggactaagctcttgttgtccgtggattcgggctgccttagggcattatctactacttcctccgtttcaaaatgtaagactttctagcattgaccacattcacatagatattaaatatgtctagattcattaacatctatatgaatgtgggcaatgctagaatgtcttacaatatgaaacggagggagtaccacattaaagtcgttcctacaacattttgtgctatatctacatatcagcacaccgaagaagttcctccgataattgtgctacatcaacgtataatttccatccctaaactcttaaactattcggttagtctagttgccatccctcatctttgaaaccaggtaaactatgtcctcaaactatcaaaaccgaacacctttaatccctcgagctggtttgaggttattttgagtccacatggcaactaaggtgatacaattgatgacaaggacttcgtatgaaaggatcaaattttgatttggatttcgtatgaaatctcaatatccaaccaagtggatttcttggatcgagtcttttgttttgggtggaaatgtatcaatagaagtgaatgatgacatcagacatttcctccaaacaaaaaagggccttcgacaaggtgatcctctttcgccaatgttttttaatattgtagctaatatgctggtcactctaatcaattgagccaaagtagatggacaaatttgtggagtagtccctcatctagtggatgatggcatttccattctacaatacgctgacgataccattcgttttatgaagcatgaccttgagaaggctcgtaacatgaagcttttgctttgtgcttttgagcatctctcaggtctcaagattaacttccataagagtgaattgttctattttggtgatgctcgaaccatggaagaccaatataccaaactctttggttgttcttctggcgaattcccgttatgctactttcctattcattataggaaactaagaaataatgattggaaatgggtagaagaacgctatgagaagagacttggtagctggaaagggaaactactttccacgggaagacgtttaacattgataaactcagtgcttagtagtcttcccctgtatatgatgtttttcttcgcaatatcgagaggtgtactcaagaaactttattgttttcgctctagattctattggcagtgtgatgatcaaaagaaaaagtgtcatttgatgaagtggagtattatgtgccgacccaaagaacaaaggggatttaggaattcatgatttatatatgaaaaacattgcccttcctagcaagtggttatttaagctactcacgatggatggtgtatggcaacaattgattcgtaacaagtacttgggctcaaaacctatgtcacaagtcgagtggaaagctagggactcatacttctaggccagccttatgaaggtcaagcgtgattttctacgttttggcaaattcattatgagagaagcaccactgtgagaacaatacccttgcctatacaataaacaggatactatagcaaatgtgctacaaaactaccctccgaatgtatcttggcgaagggatcttattgagccaaaattagtggcatggaataaccatgttccacgaatggcaaatctagcgcttactcaggaccgagataagttccactagaatttaatccagaatggagagttttcagttaagtcacattatcttgccttggtacattcagatgtgcccaacataaataaagtaatttggaaagtaaaaataccacttaaagtcatgatcttcctaaggtatttacgtcgtgggatagttttgacaagggctaacctggccaagcgcaattggcaaggaagtaagaattgttccttttgtcacacagatgagacaatattacatttgttttatgaatgcagatttgcccgttttgtgtggtgcactatacaagtggctacagggcttttcccgcctcgtggtgtatccaatatgtctggtaattggctacggggaattaggaaagaccttaagtcgcttatcctgttaagggtaaccactatttgttggtcattatggttttgcgggaatgatatgacatctcttctcctttataggttattttttaaactatccacttccttcgtacatgggctatccttcagaagcctgattcacaagatttggttgcagcggcatgtcaacgcttggagtaggtggtcagggagtgttttactcaaggacatggatggcggtctaggctgaagattggtgctccctagattttactactttccttcacttgttacaaactcttttgtgggtgtgtgtgtgttttggctatgtgcatcctagttatgcagaggccgggagttttttttagtatggttctatcagcttgatgtaatcgactgagattaataaaagcttcctttaccaaaaaaaatgatgacatggatgaaacagctaacagttacctctcttctctaactattcctttccctcactcccaaaattccccattgtgagctcaccagcagcgatgggcacacaatccaacatgcatgtgagagtagtactggtgtggcgactcctgcgccctgtcttcttccagcagctgctgaagtggcaccatggctgcctgccaatttgctagtatacaccatcggaatctgtcttcaactgtcccattggtgagactgctgcccacctttcccgctgctatgatcagttcagttcaattttgactcaatattttgtttgctttgcagctacactagatatctattttcatcttattcttcttctgggtctgacattcactttacaagtttgcatcacctttctatgcacgttagcaaaatactggaattctcactgaaagcagtacgtgctggcatacatggccaataaggatgatgaggccaccaagtagatattcagccgattcctgctcagttgtctttcatgttaatcgtggctgctccttcataaaaagaaaaagctctggtgcaggcaccaggatggattgcacgtaggtgtatgctgtggttggccactttgctgacaccagcggagaggctacagacctgcaactgaactcatcattttccaggacctcatgccggctctgacgaatagtggctatgactcatgaacctttttaccaacacccaaatatgaaagggaagggagaaaagatgataagggccctaatgtggggctagctctatgatgtggaggacggctgggcgcgcaaagtcgatgacatgtcacacccaaaaccagccaagggacataacttgtctagtttgcatagttgagggaatagttttacctggtttataaattgagcgacgaaaactagaccaacaagataattgagagacaataactaggctttttcctacacgaaataatagtttcaatctaattatatgctagactcaaacttgtttatacatactaggtattatgatctttctttattctgctttcaaaatgcacatgtcaaattgtcaactgtatgataagagaactgcaaaggccacaatcaacataacagaacaactaagcaaacccacattgagtttgtcttggcgatctttactctaaagccagataaagttatccaaacagacgtcagaataaatattcttgagcagatgggtggtccaagtcagattggagtggtgatccgaggcagtttgttatgtaatctgatggataagttgggtagctgggtaatcgtaggtcgaccaattttagagttatatacaaacactagaaccccatcaaggtacaaaatggctgttacaggcaaaactatggtattgtagtttgagtagaatagtaattcttagcatgtggattcttgttattggagtataactatatggccaaccgatgtaaccctcaggcctcaatatatcatcaaataaattcttaagaggccggagtcaccttacttggctccgagggacatagacataacaaatatcgaatctcatcaacaatggcctgctctcttgcattatcgacttttaagtatttctaaggccctgtttgcttcagcttaagattattgtaatctagattattaaattagattattctaacctagattataataagctaacatagaataagctgcgagttgtttgtttctctgaattattagagacatctaagggtagtgggtctttagccactcaataatctagaaaaagctcctctactcctctagaggagattattggattatactaatctggcttatagattataacaatctagcataataatctacttgtttgtttcagcttactcctaataatccagattataataatcctaagctgaatcaaacagggcctaagtcaattccagggatctatgtgttctgaatttcttgtcagctggtgtcacccaaattacaacaatcccatctaaaaaagaaaaatgtttatgagtcaatagatgaacgcatgtttggctgagttcaaatttttggtgagggtgaaatttttgtttagattaagttgtttcaatgtcaaattttaagtgataattgttcttgagttgaactaatgttggttcatggtaaattgaaaataaacctgtgggagtgcaaagtaattactagagtattagggttaagaaataaagtgaacaacccgcagcggtggaaagtggctgcgatgagcgtggaccattagctctggaattgaccaactgtgcaatagcagttgtatttgatggtggccgttctttagtaatgaaatcaactatatattacctggtatcggtttctttcttccggagttcctcccgtccatgctctagaacattacatacttcatccttgtgctgaaactcctctgtaatttcatcttgtctcagtggcgtacgatcaccatcctccgcactgaaacaggtgtaataatagtcgtatactaactggacgaagtagaacaaaaatttggatggttttttgtgatcgctagttatgaactgatacctgctgacaactaattggtcggatgtatcttcgcctaaaacctctgttggcgtccactgtgattcacccattaggatctcatacagtttagttagggtttcatgtgattttgatgccaagtcttttaaacacgccatatgcacgttaatgtcctggccttcctgactggagcggtaggaccaaaacttgttgcgataaccctccttgccacacatgcaaatgcaacatctgctgcaagccgacaccctgcgaagctccatgacatagccctttacgtttgcagtgcgaacaggcagcctcgcacagcgtgggtggaggtcgaggccacgctcaaagcagtggtagacgaagccgtgcatgaggtcaccacatgcatcacaggccctaccgcattcagaggccagaggctttcggaggaaccgaaaaacggagcctgggaacagagggtgtttcagggtgtgaggcgctgttgcgcagcacatatcatagtacaccttggagttgcattgctcgcacttgaacctgtggccggcaccaagctccttgcagccatcgcactgggtaggccaggacctgacactcttatccagcctcagattttcatgcatatgatccgtgtgaggggtggggacaatcggaagatctgtgccaaagcccgaagaattagcacaccagatgaccatataaagatctaatacagtatcttttctttataatggctaattgaaggttttttcttaaaatcccatataaacagttaacactaagaggtgaaaggtttctcatattaataggtcacaaaatatctaacaaaagctcccacttagtctgaaaatgaaggtgtcttaatgttcaagtttttcgatgcttgtgacctaaagctcagatttgcatatggtatgttcgcttttctcccattcttgcctttactaaataaatgctactccctttgtttcaggttataagacattttgactttggacaaagtcaaactgtttcaagtttgactaagtttgtagaaaaaaataacaacattttcaacccaagacaaatttattataaaaatatattcaattattgatttaatgaaactaatttggtattataaatattactatatttctgtataaacttagtcaaacttgaactagtttgactttgaccaaagtcaaaccatcttataacctggaacggagggagtaccagaataaaatattattttctccatcattcagaatatattgaacattatgtgtcatccaatgtgctaccaatgaagggcaaccaaaccgtttcacctatactcttaatcctcgagcttgtctaaaatgattagtatttagaatcaggtagaagaataactaggcaatcaaatctgtaagtataggataattctagaactgaatatccataaggccataaccatgatgggcaagcacgatattagaacatcatatcccacagccagaaggtgataaagtataagcttggaaggaattagtttctaagctcatgaatattaaactgacacatgaaatcgacacttttagatgaacttacatcagaaaaaggaattttctgttcattcaaatatcaagccttattttctggtgcttacaacgtgggtttgtatatagcacaggattagctttgctaagagaaattaacgacacagctagaaatgttttttaatgacaatgagactattcaacatttgttttttcattgccatacagcacactgtgtggcgtgaggtacatgcagcttttaatttggatccagccactagtattgtccaatttattcggaaattgattagttggtttggactaaaagttaaaataagccggtgtacgttggtgcggccaaccggttattatctattggattacgtcataaggatattgtttttagaaaaagaagtccattttactcccccccccccaaactatttcattggaccactaaacccctaaactatttttcggctcattttaccacctaaactattaaaaatggttcaccttactcctttataacatttctctttttttttcctttttatataagttgtattttaggctgaatttttttagagccatccctgataccattatcaaacttcaaaaaaaaaattaagttttttcttgactgttggcttgaactttaaaatctccacatttaaatcagtcttagctgtttccgacttatgtaaagagtggggaaaaatctaaaaaatgttgagacgtgtaacagcccgccctacaaaaccgtgtttataagttggttccaaccttgctacactaccgcagttgatactaaacatgcgcacacagctctcatgtaccacacaggcctaatcctgattggaccggaatgtcacaagacatatgttgtaatgcatctatcgttctaccaaaatttcaatgcaaaatatgacttatatagagagaaacgaaaaggaacaatgggcctcaacttttcgcttatgcttatacttatcagccaaaatttgaatttttaatcttaaatttggagctaattttgaggttttttcatcaaagtttatttttcagcctttgcttttagatcgcttagaacacgtatataaaagttttatttacaaataatttttcgtttgtaaatatgccgtttcacttattccgcgaataagcgaaacgatggctcctaatatcgttagggagtaaagtgaaccatttttaatatttccaggtgtaaaatgagccaaaacaaaattagggggttaaatggtccaatgaaatagttcggacagtaaaatgtacttatttttcttctataaaaggaattatcctaatcttacatctttatgggctccaactggctatggtttggtctcttcagcgtgaggagttgcatgatctggtatttgatgcaggcaacaccttggagcgtagtcacagaacttttcaaccatattggatggtggtttaataacagctagcctatgtatcttttttttttttagttaactagcctgtcgaatacttcttttatcattttaatgaactttcacacacgcttgtaataatgtggctgtgtacaccttctggttgctgcttccattatctttgcaacagtaccatctctacaatgtcactgatctgatcattgggcctcttttatataataaaatcagtatgatgtgtacaaaagaattacgtagtaggatatgggatatccactgctgttgatcgacctaactaaagacattatactacagcaggtagtaggatgttttgattggtaaacaaaaatgaaatggatgattgcaggtcaaatttgcatgtccaaatggcatactaaaatagatatgtggttcaaatgattaccctagttaaattctcaaataaaatattttgaatagcgaaaaaatcgaccatgtgcatctcgtccaaattccaatgttaaggcaaggagtgtatcttgcgcaaataaacacagaaaagagggcatgtttattgttacagtagggtatgtaaattcgtaccttttataaccctgttgatgaaccgtatgattacacttgatattcttgtattttgcctgatggcattgttcagtacagaggctatagccattctgttagcttcactagtaccggcaatgcaaatttttgcgctgaccttgacacctgacaagtgcttgaagcccacattttcaaggttgtattgctccactgtgctaccattgaattccatctttaacctttggaggttgggcatagctccttcatcaaatctcagacttgatacagtactacacttgaatttgaagtacttcaaaacatggaatcctgacttgtcaaatatgataggttctgcaggggttgtccggacatacagtgagaaaacagtgagggcattcagcattgagagagtctcaatgtctttcctcaggagttccatgactgctactttcaaaatacagagtttctcaatagttatgatccaactgggaagtctatggaagacgcaaacacgtggaaacaactcaagcctctgcagaaggctacaaggggggggaactttatctaagaaatccaagaaaatggcaatgcttgaattttcgttatcattagaatcttcagagaagcagacaggaacaactgttagagatttgaggctcttaagtatcccaataattgaacccaacagtttcatgttgtgcttaatatggtcagaagtggctatctgaggacatgcgagttgaagatcctgcaaattggtcagttcttcaatactctgtacactccctgcgtcaacaaagtaccctagattgggtggaagtctgaagtgcagcaacggcggaagatgaacaacttctgatctcaaaaaggtcaccattgcaccaatatgcagagtcctgagatacttcagtccttggagctctgatggtaagtctatgcaaacattaccttcaatctgcaaataagtcagtagaaacagttcacgaattctagtgaggtcaagaaattcgccatgtttaccatgaaggaatagaactcgaagaagatgaaactccgaaatggaaggcccgcacttccaaaatccagaaaacacaagtgatcgtagttgtgacaatctaatacatgctggtgcctttgcatcttttgaatatccgaaatggagagagagtcgtcgaactttgtctgctagtcttataccagactgagaatgatcaattgcagtgacaaaattctcttccattgccttgcgtttgataaagttaagaaccatgtcatgcactgtgcaagatacaacctcatcactacagctgatatgttcagtttcaagtattcccctatggacaagctcataaaaatgattccttgcagcttcatccaaacttttcccttccgtcgcacttacaaaatcttcagctacccattgcttaaccagatcgtccggattgattatgtgatcctctttatatatactcagatacagcatgcatgctttcaaatgatgaggaagattgttgaagctattgttcagtagttgtgccattccttcggaagtaggttgtatcctcaaatctggaatcaacgacttctgtacatagatccattcatctggtttgtctggccgactcaataaaagactggctgcagcgatagttgctagtggcaaaccgccacattttcgtgctatctcatatgaaacttcattgagttcttcaggacatttgtctttatcaccaaaaactctactaacaagtaaatctcttgagaaatcgtcattaagcggttccatcttcaaaatatgcttcttgatcacgtgagatgcattatgttgagacttgtaaaaactccatgcctgagccacatcgttaatttctgttgttactactattctactacagcaatcctcttgtaaagcatgtctaacaacattccatgttgatacagtccacacattatcaagtacaatgaggcacctgccaagtagcgcatggtgtttatgttatatgaattcaactagaagatattgacaggttctccctgagtagaaatatgattgtaacatatagagaagaaacgccgttggtgtagaaataaataattgtacttcaaactctcaatttttttcatctatcccattaggctcaattgcaaaggggcatttaactatttgccacttttagaaatgcaaatttctaccgtttcttcgctgaatttcggaaaattttacctttgattacaggaagccaaggcttgaccttgccgccgccaagggcccgacctcgacgtgctcctccagtaaccgccaccgggcgtgctcgttctcgtcgcactttcccagccacagcccgaccccgacgtcgcaggactcgatctcaccgccctccccacgccgccgccgccggggggtccaagctcgcgacgctacccagccgctgccgtccgtcccgccgagacgaagcccgcagccccgcaccaccggccgctgctgcctccgcgtgttgtgaagtgacagggagagagcaacatgattcgcggccgcgggcggggagatgtcggcggggaacacgccggttggggccccccactccccccatgcggccggctcggcttcttcgccaccggacttttccgggcggcggatggctcctcggatgacttcacttggcggaaggcctcgtcgcctcctccccctttggcgttagggatgcctaccgaggcctcctcctcctcaggctctttcccctcttctctcccttcctcctctctctaccaccgaacctagctgctccggccgccggcgacgatgactgcggcggtgtcgtaccagtcggcggggaggggaggggagggacgccttcgcggcgtcgggtccgccaccacgcggcgcgggtgggccgcggcggattgctccggcccatcgaagcacgccggtcgacgggtgcataccgctgtcggcccgtgcgggaggcggcggcgtggaggcttatgggaggcggagcgactgcgaggccggaggggagcatggtgcacggtggattggtggtgtgtgacgccccgcaataattacggaaaaaaacgaaatttcttccaatcggtcgcttgggggaaggtagccgaaatcaggcgctccctcgccccaagatgcacgcccctctaggcctcactcacgtgtcccctgctcccaatcatttgtccacacacaactccatgcaacaaatcacccatatattttagaaactatctgttaagaaaattcgttttatttttttttcgaaaaaaaaaagtttcacctagtttactcacaatgtttcactatgtatagatctaatgttgcaatgaactgaaacattattttgtaacagatcaccaacatattttcaaaaccctctattatgagaattcgtttcacttttttgttccaccaaaaataatccagtgtacttataatgttttactatgtatagatctaacattgcagtgaactgaaatattctttcgctatttgctgaaacattgtttttatataaggtgaaacaacgcccgatttaaacgattgaacattttcgatctacttagtgaaataattccgatatacttggtgtaacatcgtgcaacatttaaaatatattcaataataagctaaaaaatttcgtcggaatatatccatgtgtggtcttgttttgaagatttaattgcaacaaatttaatagtataatcagatcataatttcgataaataatttaagataaaaaatagtttaaaatggtttttcacacatgcgtggcgctaacatcatgctgacgtcagcccccgatttttggacgcctggatcgggcgcccgattctaagtctcctccgacaaaaaaagagagagaaaaagcacaagcaataagcatgttggtctagaaaaaactaagggacaattgctcatttgaccttgttttaaagccaaactactaatctgatactacattttttagtttgctaatttgaccccgctttttaaaatcgagcatgccgtttgaccctatttacactatgccattagggtttcaaaaaagaaaagaaaaagaatcattttactattcaaagtgaccaaaataccctcatacatttcacttcaagtcttcaaccaatctctcattcacatctcggcggcagcggcacgaggaaggaggaggcgacggcgctggcgccgacgtggggagcgagcaggaggcagcggcggtgcaaggaggaggcgcggtgacggcgacggcgccggcgtgcggagggaggcgatgggcagatcagacggcagcgcaaggaggaggcgcggtgacggcgacggcgccggcgtgcggagggaggcgatgggcagatcagacggcgacggcgacggtgcacggagggagcgacgacaatgaggacacatggagggagtgatggcggcgagatgtggagggagcggcggctgtggctggatgcgccggtgccagcgcttgtttgatttttgtgatcttgtttgaatgttattgttggatgatgttcttagcagggatttgtttgcatgttgatatggatttgaatcgatgctggcatgttgttccggaaccatttgttgtggtgatctaatttgcgttctcaattgtttttttttggctaaaattcaaatctaattcaaattcgcacaagacatatcaattccaagtgaaatttattagaaattgcatcatgtacaccaaagcgtataaaaaaattagggtcaaatgagtaaggatataaaggtatttcgacctcaaattaacactgtcaagttggtttcacgaaatggggtcatgtctgatgtcgatagttaaaaagcagggtcaaaaaagtaggttaaaaaaaagcaaagttaaaaaaataaggtcaaattggttggtagtttgctttcaaaatagggtcaaatatacgattgccccaaaaactaaatactcttgacaatgtatgtttggctatgtacttgtagagaccgagtttttaatacatcttctaaaaaaaatattagtcagataaaattctccacaacattttttttttttggaaacacaagaggaggttatgatctagctgtttgtgttgaaggttatgatctcattacccatcttactaaatgcactttccaatctttaactaatttctgaaaattttctacttgtccacattaaatcttctgcaaatttgatcactgccgttgcaaagaatgttgggttggaaaataccactacaagaagatcagctacaaaataccatcacagggaaatttgagttggaaaatgccggtaccattactgtttcatccaaaactgcaattaatacctttttaggagagagagttttgaaaattccaacactacccttttttttccactcagttgtaatactcaacattccaagtcgcgtttggatgcatttaacaaatctcgcatttaatttatggtggaaaatgtttagaaaatcagctaatgcaaaaattaagaaagagtaaattttacaaaattaatgtactttgatcaatatatcacaatactatatatttaagaaagtgtattacaaattaaactacagatttaaaaccatatttttttacaaaactatagattgaaagtatcattagaaaactacaattttataaatgagcatatataacatcagtttaacatcagatttaaatatatatatagtataacatcagttttatcagaaagctacaacttttgtaacatcaacagtgctatagatataaactctaaaatttgtagttatttgataatttcatttctaaatgcatagttttgtgatacaatgctttaaatatgtagttatgtgataaatttcatgttaaatctgtagttttatgatacacattttaaatttatagttttgtgatagtttagccaaaatatctgtagttttataaaatttagtctttaagaaataagcaataaaaacattttcaaggaaatagtacagttcataatttttaaataaatatattatttttttactgcatccctatcaacaataattgatgttcttgaatacatcaagtcaatgtgttttgtgtttaaacttttactatcaatttctattaaaatatttcgatttaattttaaaaattgatataggtatatttgtctttgaaaacaaaaaggagtttcaaaatattagaacgtccttgctatatttttataggttttatactagcaatcaatattgatcatttcggtaatcttgttgctttctaaaatgtcacttatttgttaccgaagggagtacgtataaggcaagcagtctgtataaaatattatgaaattgagagccataagtatagcaagcacaggaaacaaagaagaaaaaaaagcagggggcaaattagtcattttcttccctgggtggaaatgatcacggtaatggtatttttcaactcaaattctctttgtgatggactgatggtatatattcatcagcttaggttctatgtatatgtgatagtattttgcaacttgagtttttcctctaattctgttaattaattcttttactccaaattttcccatgataacacgtgggccgggtaaggtagcaagtagatactccagtaattattgtgctagcttgttagtctcaacattgatttttcatacacgtacaggtgctaattaggaagcatatataaggactatagcagtgtttagatcccttcaaacttctaaaaattctgtcacatcaaatatttagacacatgcataaagcattaaatgtagataaaaaaaatcaattgcacagtttgcatgtaaattgcgagacaaatcttttgaccctaattacgccatgatttgataatgtgatgctacagtaaacatttactaatgatggattaattaggcttaacaattaaatttgtttcacagtttaccgacagaatctgtaatttgttttgttattagtatacgtttaatgcacgggactctaattatgggtgttcctctgtaatcaacatagctagcaccccttgctgctatgagtccatggtctcgccgccattctctttctgcgtgcctatgttacattattgacatgattgttacattggtggtcactgcaggagaaacaatctttaatactagttaaaaccccctttcgtaccggctgtagcaaccgagaccagtaaatcgagactatctttagtaccggtagaaagaacgagtacaaaagatgcatactaagtcaaaaaaaaaaagtgtgggatgtgagattcgaactcaagatctatcaactcagtcctcacacacgttaccattccacctactactatacacatctgacttgaatgtagatgctttctttttgaactgatcccagagacatcgttagtaccggttggtattaccaaccgaccggtactaaaaatatctttagtatgagttggtattaccaactggtgctaaaattgcatcgttattaccggttggtaacaccaaccggaattaaacatagttttaggaacttcaacttttagaaccggtactaaagcatatttagtaccggttcttgatctagtcaggatatttgtgttttggggtttaggataaaaaatcgtttctctagtagtgggtgcccccatttttatttaaagggttaccgggttatggagtctgatgctaaccccaccctctagctaccatatattacaactttaagtttaactacaacctattaggacaagtatattcggcacctattttaacatgctccacctcactgaatgtaacgccacccacaagtagtagaattatcatgtggattcaccaatccactagacttggggttttcttcttgcagattcctcgtgagatggttgatgagcctatgccagaatcaccgctaccaaaagcaatagctatcccaattactgtttccttctggtctacacctgtaatagtacaccctcacaacttgtaaaggtacgacaacaccttctcttcaattatcacaatcctactatccccgtgaaagggtcaataacctagtggttacaagagtctcagtagcacataaggttctgggtttgactctccatgggagcaaattttccatgatttaacggcttgtgctttcagtggtaggcgacgtacccgtcgacagcgaggcgcctgtggtgacttcgtcaatctcaaggatttgcctgcgcagtcttcgaagatgctcataggggtagagtttacgtgcctccattgtgagtgtctgcgttgtactgtgtaatttttttaaaaaaatcctactgtccctcatggtctccgtggatccgaaaggtacggcatctaaaaatatctcagctataatcatacataagagattcggtttgacatggtattaaatacaagagattctgcgtgacatgggttagatatgtgtgattctgtgggacatggattatgtatcagagattcggtttgccaagcaaccaactatgtactgacccggtctaaggttctccactatttatacccttctggtcgatcgtctttctagcaccattcattcactaaaaaacactttcaacccccacttcaccacttcagaatctcagataccgagcaaaaaagatctagatcaagttagtaccaaaatttagtgttgtatcgatcgatgattgaggcagcagagaccatggagaaagcggtgataactgccttcgtgaacactgtcatgccgccgctgtttaaggtgctgtcaggcagttgtaagatggtcatgaacgtgatcgatgatagcgactcaatgagacgtaaactagttctgctcgcagcttccatggacgacgacctccggcggacgaagaaccccacggccgccgccaaggtgttcggcgaccagctgcgcgagctgacgcacgacatggaggactgcattgagcgcttcctccaccgcgtgtcctgcgccgagggagcgtcgcgggcgcgccggctggggcgcttcctgctcaccatctgcacacgctaccggttcggggacaagatcaaggcgcttaacaggcgcctcgaggagctgaccaatgaacgcctgtgccagttcgtctacgacaagcccccgccgccgccgccactggcgccggcggcggcacaacaacgcgaacatgttcaactcaaccccgtgggcgtcgagggagccaagggggacatcctcgcgatgctggaggaaagtccggaggagctgagggttatcgccatcgtgggttttggcggctccggcaagacgaccctcgctaaggcagtgttccgctcaactgatgatgatagaatccgggtgtttcgttcctgccgtgcatgggttgatcgagccaaggagaaaaatgcgggggagattttcagatcattactccagcaatttggctatcggggtcagggattattggtcgatgacgagcaatatctccaagcccagctcatggactacctcaggggtagaaggtgagagaatttctgtagctgtttcccagttgcacgcattacccatccacacctttacggtcattcagaatgtattggaactttacgtactacattgagtactttattgaggatcgtaaaaccactcattcgctgaaccttgcgcccggccgttggttagagcaagtttaataatatagtcaactactagctctaattcatctatagccaatctaatagctcattcatataatagttacatactacactatcaataactggtcccacctatcataaacacattgcgtcttggagtccgtaatacagctggctacaaatttgtagcccactgctcttctctctcctcgtttatctccttaaaatatatttgcagttggcttatagcctgctattgtacctgctcttacccgaaatttgtcagaaatttgtcagatacttgattgttattgatgacattgggaatgggcaatggaattctataaaatcagctttcgaagaaaatagtagaaacaacggaagcaggataatagttaccacaaccattaagtcggaagcgaatacctgctgtggcaatggcaaaggtttcatataccaaatgcaaaatcttgaagatcaatactgcaagacaatagctcttggggaggcaccttcacctgagttgcagatgggctcggaagaactacttaagaaatgtgatggccatccactttcccttgtttgtgtggccaattatttgggaggtttaaatgagcctactgggcagcgctgtcgcgaattgtgtcgctacctaggttcaaaaatacatgacaatggtaactttgaaagactcaaaggcgtgatcatggataattacacaagtctttcaaaccacgttgtcagggcctgcttgctatatttgagcatatttccaaacgatgttccgctcgagaagaaagtgataatcaggcgttggatagctgaaggattcgcaaggagcgaagatgtggacattgatgaccagactattgcacgttggaattttgagacgtttgtagactgggacatctttcatcctatcattgacacaagcaataatggcgatgtcaagatgtgcaagactcgcagtatcgtgcacgagtatatgttgtacaaggcgtcgagacttgagaggttcatcatgtcctttcctgactggcgaaggaaagttcgtcatctctgtatcgatcataggacacctcacaagcgcagaactacaacagatatggatttgtcatgcgtccggtctttgacgatcttcgggacggcaggtgacaccatttgcgagtttcacaggtacaaggttttgagagtcctggatctcgaagaatgcaatgatgtcaagaacaagcacctgaaaaatatacacaagttatggaatctgtgtgaaaccatgtgtggttatagttcttttgtgatgggaaattgacaagtaccggaagtgcaagaagtgtgtgcgtggactaacattggtcaggttgcgacatctgtgccaagacaacggttgtttggttcatgtgggtgcaggtgatcggagtcgatcttggtcaacggcggatcgggactagactcagggaggagttgaggtccaaagcgatcaaggatgccaggtgacaagattggacacaaggttgcacacggtggacgaataccgtgtgaggaggtctttgcaacgggcttcagaaggtcaagtgtgcaagcatcggattcgcgaagaaatcagaagggactgtgcaagtgcattgctgctacagtaaatggacttactgtaggtagcatacttgcatgtacacgtaatgtacttgtgcaaggaggagcttgcagaagctgtgcatgtgtgctgtgattggttggcagggaggccaagccaatccagccgttccacgtggcccaaggagatcattgggtcggttggcatcaagtccaatccggcctgtccagctcgggagctcggtcggcccaagcacgttgctgactcaagatggtgaaggccaggccgagcagaccctagacatgacgacggcccagctcggctcggcaaatgcacaggcgtgtgcatgcgcgcgcggaggcgggagatcgtacggcacctggaggcgtggcggccttctgttcgtcaaggaagcggagactcgtgggaccgggtcccccgcggtttttcacatggcgcgcgcgggaacgtggttttcgcgagcgcgcgcagaagcggctcggcgggaggaacggcgacatggcggcttctgacttgtggcgcgcaggtgcgagaggagcgggcgcgggctctctgggacgcgtggcgcggatgcattggcttggaggagcacgacgcggatcggtgtacactgattggcttggagtggaatcacgcggatcgcacgagggcacgcgacgtgaagagctcggatcaacaacgtggcgactatccaggaggtttccttcggatctaaggaacaatggacatccaggattttatcaaggctagggtttcgccccacgggtatttgagacaatgtcttaggggtcttaggctataaatagagggatggatgcaagggtggaggttgctccttttgtaatccttttgagatgctcggtgagagagtttccgtgtgagtttggagtgtgtttgcccgagaggcttttgtattaagattagtttggagtgtgtttgtccgagagattttaagtttgtgttattgttcctctgaaggtgtttgtttgctcctagttgagcggttattttgcatcacctatgaatgaaatgatttgaaggatttcgtttttgccttgtccatttaaattccgcaatttaaattccgcttgaaatttgaactttgcgatgatgagttttgctctctcctcctaacctctcttctagttttcgggaattccttttctcttcctcttctagtttcgggaattccttctctcttctttttctctcttcttttctagatccggcttctctaatagccgcggttctagtaaggattttgagaaatccggcttgatgagtattttcgggggaaagatttgaattgctatattcaccccccctctatagccgttcttggtctttcaattagtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatcaccttacactatgcccgatgatgctgacatcacgcctgcaaatgtggctcaagttgattttaattatcgtgcaagaaatgcaatcattggtggaatttcttctggtgaatttaatcgtgttcaacaccaccagtccgctcatgacatgtggactgctctgtgcaatttccatgagggaaacaatgatattcaattggttcgtcagaatcaatttcataaagaatatcaaagatttgagatgcacccaggagagtccattgattcttatttcaagcgttttgaagaaattgtttcgaagttgagatctgttggaaaagaattttctgataatgataatgctcgccatcttttgaattgtcttgattatggtgtttgggaaatgaaagttacttccatcacagagagtgcacctctgagtgaccttaccatggacaagctttactcaaagctaaaaacccatgagatggatgtcttccatcggaaaggcctcaaacactcgatggctttggtagctgatccctctggtagtacttcttctaatgacttagcttttgtgtgtggtggcttctctcttgccgctttacactcagtcactgaggagcaattagagaagatccctgaagatgatcttgctctttttactagaaaattctcaagagcttacaaaaatgtgagagatagaaaaggaggaaaaaccaatgaaccatttgtgtgttttgagtgtggagagcctaaccacataagagtgaattgtcccaagttgaagaagaagagtgacaagacaaccaagaagctcgagggacaagggcgaaaggggaagaaggatttgataaagaaggcgatccacaaggtcttggcggctcttgaggaggtgcagcttagcgacatcgactccgacgacgatgatcaagaaaagggggacaaggacttctccgggatgtactgtctcgccaacaacgaggacttcatcaacctgtgtctcatggcacttgaggataaggatgactcatcggagcatcatgaggtatgtcttgatgatatcccttccttggatggttctctttgtgatgattcttgctcagataatgactctgttgatgatgaactaagcaaagaaagaatgacacacttgatgattgaaattagtgacaagtataggtcttctaagtataaaattgagaaactaaaatatgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttctagtgctagtgctgcttgctctacttgctatgaaatgaaagttgatatgagtttgcttgagatggaattgaaagaactaaaagaaaattttgttcatgataggataagtagttgtgaaaattgtcccattctcactagtgacaatgatgaattaagacaacaagttgacatgcttaggaccaagaatgatttgctagaatcttatgctactaaggagcctgttcattcttcatgtgctaattgtgttatcctggaaactgaactaaagatactaaaattgtcattgattatgtcaaatctgttgattcatgttcatcatgcatttctctgacagttgatcttgagtccgctaagagagagaactcgtacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagtctgtagagttacctagacccaaaaatccaaaacaagttgagcacaagcaaaaccagaaacaaaccaagcctgtagagaaaaccaagtatgagtgcacctattgtgggaaagctggtcatttggtaggtttctgctttagaaaggctagaaaaaagcgacaagaacgtcttaggactagaagagctgctagagtccctgagaggttcgagtgtgcgtgtcattgtcattcaagtggtgtatctcgctttcctcgccgagatgtgcaccctcgatgtgacctagcagggttggggcaaaacagacatggtcatcttgcatataattatgctcataacactaaagatgcttgtactcctcgcatggttcagtactggattactaagtcatttctcactaaccccagtactgaatcatcgagatctgctgtgtctttcttgtaggattttggagtggggagaagtaattcttggcttgtagactccggttgctcacgccacatgaccggtgaagccaagtggtttacttctctcactcgtgcatccggtgatgagaccatcacttttggggatgcgagcagtggacgcgtgatggctaaaggaacaatcaaggtcaatgacaaattcatgctaaaggatgtcgcgcttgtaagtaagcttaagtacattttgctctctgttttacaactctgtgatgaaaatctggaagttcgtttcaaaaaggacaggtctcgagttcttgatgcttctgaatctcctgtttttgacatttctcgagttggtcgagttttctttgctaacttcgactcttctgctcctggtccttctcgttgtctcattgcctcagagaatagggatttgtttttctggcatcgacgtcttggtcatattggctttgaccacttgtctcgcattagtggtatggatttgattcggggtttgcctaagttgaaagctccgaaagatcttgtgtgtgcaccatgtcgtcatgggaaaatgacatcttcctcccacaagcctgttacaatggttatgacagatggaccgggacaactgcttcacatggatacggttggtcctgctcaggtccagtcagttggggggaagtggtatgtcttggttgtagtggatgatttctctcgctactcttgggtctattttcttgaaacaaaggaggaaacatgtggcttctttcagtctcttgctcgtagtttggctttgcagtttcctggtgctcttcgagccattcgcagtgataatggctctgaattcaaaaattctgcatttgaatctttctgtgattcttctggagtcgaacatcagttttcttcaccatatgtcccacaacagaatggggtggttgagaggaagaaccgcacccttgtggagatggcacgaactatgcttgatgagtttacgactccaagaaagttctggactgaagctatttctactgcttgttttatctccaatcgtgtgtttttgagaactatcttgcacaagacgccatatgagctcagatttggtcgtcgaccaaaagtttcacatctcagggtcttcggttgcaaatgctttgttcttaaatctggaaatttggacaagtttgaatctcgatcattggatggcattttccttggctatgctactcattctcgggcttatcgagtttatgttctttcaactaacaaaattgtggagacttgtgaagtcacttttcatgaggctagcccaggagctagaccagaaatttcaggtgttccagatgaaagcatctttgtggataaggattcagatgatgatgacgatgattccattcctccacctctagacagtacaccaccagtgcaagaaacaggttctccttcaactacatcgccttcaggagatgcaccaactacatcatcttcagcagctgaggagattaatggtggcacatcaggaccgacagctccccgacacatctagaaccgacatccgcctgggtgaaagggtaactagaaatcggtcttatgatcttgtcaattcagcatttgttgcctcttttgagcccaaaaatgtttgtcatgctttatctgatgagaattgggttaatgccatgcatgaagagttagaaaattttgaaagaaacaaagtttggtctttggtagaacctcccttgggttttaatgtgattggaacaaaatgggttttcaaaaacaaactaggtgaagatggttcaattgttcgaaacaaagccagactggttgcacagggtttcacccaagtcgagggcttggattttgaagaaacctttgcaccagttgctagattagaagctattcgaattcttttggcttttgctgcttcaaaaggtttcaagctttttcaaatggatgtgaaaaatgcttttctgaatggtgttattgaggaagaggtctatgtcaaacaacctcctggttttgaaaatccaaaatttccaaatcatgtgttcaaacttgataaagctctttatggtttaaaacaagctcccagagcctggtatgaaagattgaaaacctttttgcttcaaaatggttttgaaatgggggcagttgataaaactctctttactcttcatagtggcattgattttcttcttgtccagatatatgttgatgacatcatatttggtggctcttctcatgcacttgttgcccagttttctgatgtgatgagcagggaattcgaaatgatcatgatgggagagctgactttcttccttggacttcaaatcaagcaaaccaaggaaggaatctttgtacatcagaccaagtactccaaagagctcttgaagaagttcgacatggccgactgcaagccaatcgccactcccatggcaactacttcatcgcttggtcctgatgaggacggtgaagaagttgaccagcgcgagtacagaagcatgatcggctccctcctctacttgactgcgtcaaggccggacatccacttctccgtgtgcctgtgcgcaaggtttcaggcttctccaagaacatcacatcgccaagcagtcaagcgcatcttccgctacatcaagtctacacttaagtacggtatttggtactcctgctcttctgccctttcagttcgagctttttcagatgctaattttgctgggtgtaagattgatcgcaaaagtacttctggcacttgtcattttcttggcacttctttggtctcttggtcctctcgtaagcagtcttctattgctcaatcaacagctgaggctgagtacgtagctgctgctagtacatgtagtcaagttctttggatgatttcaactctaaaagattatggtctgtctttctctggtgttcctttgctttgtgataatataagtgcaatcaatattgcaaaaaatccagttcaacactccaggaccaagcacattgagatacggtaccactttctccgagacaatgttgagaaaggtaccattgtgctagagtttgttgaatctgaaaaacaattggcagacatttttacaaaaccacttgatcgctctcgttttgagttcttgcggagtgagttaggggtgatccacccctatggcttgatttgagggggagttgtttttcttttgcatgcatttgtaacatattgcatcatgtttagtttatgcattgtattatacattcttcaattgagctttgcttgttatctcttggtcatcactatgctatgcatgtgtcactcttatgctagtttgatctcttgtctagctttcatttgcttaagtagcttatgtgatcatgttatgctgttcaagcttgttgaaacctgcttaaattgactattcatttgaacttaatcaatgtgcaatgattgctctagaagtttgtttaaattgaagtatccatctcatactcatgccatgtttatattctttttgcaataactgtcagtacatgcttatgaatgctcatgcttatgcgtccatactttgtatcaatcatgctttacaagctttatctctgtttttgtccgggctactgagtgcgtttacgcatgagtagtgccgaagatagcactgagacagcctgtaatgggaactttagctggaaaacttgattgaggtcagacggcagtgtttggcacaaccatcacttgctgactgataagatcaggtggaccgtcgtgattgtgctattgtctttaaagaaattaaaaaaaatcataaaaataaaagtcatgagaaaagattaaaatctcatgttctatgctttgttatcatgttgatactctttatgaactgggcattagcacattagcatggattcattgctttgattatgtaaatcttgcatgattatgagctggtttgcttccttttaagcttcttctagaaatagctttgcacactaaatcactaattcacttgaaagctttttgcttgctggggatactaacttgatatccatgacatgtttcatacttcttatgcacatgcttagctaggcttgagcacatgcttgtatctgtgtgatccatgtctaccttttgatgcctttagataactctcaaagctctcaaaacactaaaatttgcaagtttcatctcatttttatcttgcatttttgtctcttttgatcttgatggcatcattgacaaagggggagagaaatttgcacttattgaaaattaaaacttgctttagatctcggtgaaagggggagtttggcacatagggggagcattcttgcatttgcatttgcatcccttttcttcttgtcacttggtcttgatttttcaagaattcaaaatgaccaaagttcgacttttgcaaaatggtttgctttgtgaatcaaaaatcaaattttcaaaattttgcttgagattgtcaatgttcccatcaagagagagattgtgaaaccatgtgtggttatagttcttttgtgatgggaaattgacaagtaccggaagtgcaagaagtgtgtgcgtggactaacattggtcaggttgcgacatctgtgccaagacaacggttgtttggttcatgtgggtgcaggtgatcggagtcgatcttggtcaacggcggatcgggactagactcagggaggagttgaggtccaaagtgatcaaggatgccaggtgacaagattggacacaaggttgcacacagtggacgaacaccgtgtgaggaggtctttgcaacgggcttcagatggtcaagtgtgcaagcatcggattcgcgaagaaatcagaagggactgtgcaagtgcattgctgctacagtaaatggacttactgtaggtagcatacttgcatgtacacgtaatgtacttgtgcaaggaggagcttgcagaagctgtgcatgtgtgctgtgattggttgcaaggaaggccaagccaatccagccgttccacgtggcccaaggagatcattggctcggttggcatgaaggccaatccggcctgtccagctcgggagctcggtcggcccaagcacgttgctgactcaagatggtgaaggccaggccgagcagaccctagacatgacgacggcccagctcggctcggcaaatgcacaggcgtgtgcatgcgcgcgcggaggcgggagatcgtacggcacctggaggcgtggcggccttctgttcgtcaaggaagcggagacgcgcgggaacgtggttttcgcgagcgcgcgcagaagcggctcggcgggaggaacggcgacatggcggcttctgacttgtggcgcgcaggtgcgagaggagcgggcgcgggctctctgggacgcgtggcgcggatgcattggcttggaggagcacgacgcgatcggtgtacactgattggcttggagtggaatcacgcggatcgcacgagggcacgcgacgtgaagagctcggatccacaac

SEQ ID NO: 13796 - DNA, 2984 bp, Oryza sativa
gtgtgagtttggagtgtgtttgcccgagaggcttttgtattaagattagtttggagtgtgtttgtccgagagattttaagtttgtgttattgttcctctgaaggtgtttgtttgctcctagttgagcggttattttgcatcacctatgaatgaaatgatttgaaggatttcgtttttgccttgtccatttaaattccgcaatttaaattccgcttgaaatttgaactttgcgatgatgagttttgctctctcctcctaacctctcttctagttttcgggaattccttttctcttcctcttctagtttcgggaattccttctctcttctttttctctcttcttttctagatccggcttctctaatagccgcggttctagtaaggattttgagaaatccagcttgatgagtattttcgggggaaagttttgaattgctatattcaccccccctctatagccgttcttggtctttcaatctgaggtatctcagccttggggcagaaattacaagtattcctaaagatatagcaaaactgaaacttttggaaacgctctgtctaagtaagacgagtgtagaggagctacctgtgcaagttattagtttgcccttcttactccatctgattggaaagtttaggattcaatatcatggctatagcaagagtacgctcaaaaagttatctgaaaatagtaaattggagaccttatcgggatttatcgccgacttcaagagccaaggatttcttgagatattgggccatatgagcaatttgaaaaaggttaagatatggtgctagtcatcagctgcaggagatcatgatagtatcttggctcgtaagctttcagaggccatccaggagtacatcaatcctcccttgtatattggcgataaccgtaaactatcaatctgcctgcaaacattctccgcagcctcctcaattctctcgatactccctgtgagctcacttcgctgaaactacatggcgagcttcgttcgttgccccgttttgtcaaatggcatacaggtctcgttgagctgtgcctttcatcaattaccgtgacacgggatgttctctctgatctgtataacctaaagtgtctgttatacctcaaactgatcagcgattgccttgacgaatttgtgataccacaaggggcgttccgtagtctgcgacgcctgtgcttcaaggtgcaagtctctgtcttcccgaggattgaagcaggagcactgcgggacctggtgtcactccagctgctctgcagacacctagtaggtttggctggtattgaaatcgaagatcttcgagaacttaaagaagtaactctggactctgaggtctcgagatacacaaaggaaagttgggaaacacgagcaaggcagcatcctaacaggccaaggattttgtatacttacaaggctgcataattgatattatcttatgtgcttcctgagcagtaaattagtaattcatgttcattcggaactaaataaattatgtgagagatttcctttgtgtgtgtttccctatttgtaataatacgtactaatatatgcaataataagcgttaattattcattgtatggtatcagagtatgggtagagatttgtttgttttttgtgtatgcacgaaaactcattagaatttttctacggaatcgctagtttactgtcaaaagttttttttgggtagaactttcaatttctagaccgttaggtattctctatagaaacagtgtaataaaaaccgtgcaagacttgaactcagcacctccacttcgcatcacgaacacttaactactatgtgtcagcacacatttgtgattgttatattccagttacatataagttattatggttataatataattacactccacaattgtaatatagttatatttgcaactttttgactcaaaaaagtcttcaatgttatatagctactctctttttctatacttaagaaaaaaaattcaaaagtatatgccaatatagggcatgttaaatagttcaagtatgtctacaacaccatacacaaattggtgaaaatattataataatgtgtactgtataagaatgactttggtagttaattttgggtatatttttttgagatcgctacctgtttttttgtgtgtaactttaacatgatctatatacaatataggtatacgcaccgtaaccaggctttcacgttatcgcgcggtaatcacggttatcgtgcttaccgcggggaaggggatcggttaccggcggttagggtttgagaaattttgagcaaattcaatttatggaaaaaataaaaaaaattatggatgtagttcttgttttttaatggtagatggtgaagaaatttttttaaaaagagtaaggaaaaaaattaaatttgagggcaaaaccgataattgtttgggaaatagaaaaaatgtattgagcttcatttttgtattttacatcaacaagctaggtttgcaagtgtcctatatattcttccccaatttctacacatatttaagtgattttccatttttttagcttctttttatttttcatgttttatgcaaatatcgcggttacagcaactagctgaaatttcttctcgtcaaagcaataattacttagggtagggtttgctcaatgctaccttcaaccctctctccacagcaatgtcacttttcatcactgcaattaaatcagtagcaaagactgacagaaaaggcatggctatatatatatatatatatatatatatatatatatatatatatatatatatatatatatatatatatatatatatatatatatatatataaaaacagcttttgtttgttcacctatgtgtgtacaaggtgaaaatcaaggataaggtattataattgagtaatagtgccttaattaattagtatcttgagtgcaatgtaattcgaacagaattcataatatgtttgaacaatattagcatctttcactacttaaaaacga

SEQ ID NO: 13797 - DNA, 10672 bp, Oryza sativa
gtggtaggggaggcggatctggcgatggtgggcgggaattgcggcggcgacggtggggaggcttggcggcggcggatccagcggtagggagccttggcggtggtggatccggtggtggggagtcttgacagtgccggatccggcggtggggaggcttggcggcagtggtttttctaagtctgatatgtaccatgtaatctgctcaatcctcttgttgtaaattcattttccttttctttttctttgtaaccctgtaatattcctgttatacttatacctgatatagcatattaggagtctctcctgttgtttactgtcaaaaagaaaaaacaaatctgctcaatcctcatctcgttctatagaccgcttatctgtgttggcttgactactaaagaagatttgaatcgatatttataaacaggttcgttgttggcctttggatttttatcaagtggaccatcgtttgcaggtgctgttttcctatacaatccatgtaaaatctgacttaggaggttccggagcgccatctcttttccatggcatggaagaaatttccgccgcccaaaggatccaccggttcttcctttttcttctcttctagcatgaggagcgacattatgttcctactcatctccttaggaaccctaaagagtggatcacgcttttgtgatgatgttaatttcctcgatcatggtcgaagtactgccactctccctctttttgttggttggaaacgacggagggggcggtggggtcggactcttcttccgtggtttaggtgatttctcttctagtgatatgtacccaagatgtatcaaagaagatataactcctcatcattggaacgatattagctctttccgtctttcgccatgccacatgataatatgtatggcctgtctcagagttgtgataatatgtatgataatatgtattccttagttgggatatctagttaattgctcattcatgtgcttgggccttgggcttcacaagctcaacatcaacccttgcatacacattaatattgttcccgggtttccttggcccttggataatgtcatcccatgataaatttatcccaaattaaaagtcactttctacaaggaattatagaaaattattgaaagcctacaaaatatctcaaataataaaatacctgcaagaaaattcaaatgggacttggagtattttgcttaaaccagtggtggcttgggttgacgctggtgtcgtgcccagagcagaagaatttgggtgggggaaacttttaaataattgattgccataaaaatttagtactattttagtgataagggaaaatgctattaaatttccttgacagcagacaagaaagtttggttacgcggcgttgtagtttacgcataaaacacacgatcatgacgaaaaccatgtacatatgtatgcacctacagatgtttaatttaaaactactaaaggtacgaaaccatgagttaagaatggtaaaaaacatgagtttagagagtgatgctgtgacccagtcaaattaacgaaggtggtttcgcgcaaaaaaaaaagagtgagagagagagagagagagaagaggaagaagatgggaacgaaattaggcgtacatcatttgacagttctatgcatatgtgtgtggaccgtgatagaatttacattctaattttcttttattagaaaagtaagggccgtttctcaatttacattaccgcgcacgcactccataggaaaaatacatgcatgcatgcatgttctctccaagagagtaaactaatgtgacatcaattgggtttatatttcattacacctgtaattgcaagtggaagaacgattaaatactgaaatagaattgtacccagaaacactataataaaaatttgatgacgattagtttgcttctggtgttggagtttgttgagtggatccccatgcattgagaaacaggagtaatagtgatgctgatcgagagcggtgtcaatggcgtgatgccctatctcaagacaaaacgaattcacaaaaataaacctgtgtttccaccaaattatgcatcaccaaatttttttttgcataaccgtacatatgcttgcattgcagaatagtactccacttctaacagatttacgattatcagtttgaaatttcgtttcccatttacgttaactgaatgaaaaatcaacatgttaattgttttcatgttcctagttaagacatattttacatatattagttcgagaaatattatttcgtttatccctgataaaaattaaaatattgaaagcacaatcatgcatggtaccatgtatatttgtagttttgcaaatatgtatatctattatggctgaaattaaaaataataatttgaagtttcaaatcttccttttaaactttctgaacttttcattgctagctagccgtagaagcttgttgttggtaactcctatctacttgttttgttggaagaagggaacaagtattagataggaggacaatacttactcccttgcatccaacaaaacaagatatgagttgcttaaggatagttcgatacataacaatgggccaaccctaacagttaattgtttgatatatacatgccactgtagatatttggctgtattttctaaagttaaaacagtgcattgatcacttgtcaagtagtttgatagtttgacacttaacaatgggccaaacctaacagctagttaattaacttgaatttttagagaagtctggattattggtgcagccggtcacacttacctctatttttatttgttttgtttcttacatcacgttttataagttttccctaaatgttactccctctgtattttaatgtataacgtcattgacttttcaaccaacgtttgatcattcgtcttattaaaaagtttatgtaattattatttattttattgtgacttgatttatcataaaatgttttttaagcatgacataaaaaattttatatttgaacaaaaattttgataagataaatggtcaaatattggtcgaaaagtcaacagcgtcatacattaaaatacggattggtcgaaaagtcaacggcgtcatatattaaaatacggagggattaatagatttgttcctgctcttagatggattgaaatggaccttacatcaaaggatgaaatttaaattatgcatgtccggtcagaatattattgcttacgctttaacgacaaaacccatattaccctcctaactttaattattatgtctatgacgcatgatcttttatttttaattctaattacggtaatcattctacaaacaattgtgtcgattgaactacaattcaaatgtaattgaagtagactaatggaattatatatatataactaggtgaaaccccacgcgttgctatggaagtttagtatagtaaccataagtaaaaaaggaaattgctatgcatacaacccaacccaactgtctgactcacgtacgactgaatttgatcaacgattataaactactgtagtgcatatgaatatgctctcctttgattgatctatggttacatgtctctagttgtacctgagttggacaactgtgtcatacatatagcaatactcaagtaaaaataatatgtaacatagctagacaacaacttacataagttgatgtggtttataataatttaaatttgaactacgattcgtatgtaaaaataaggtgatgtcgctttatgaaaaaagaaagtgagggagatagtttggaccatagattaattatctaaaattaaaaaaattgatatgatatgacttcccgagaaaaagagacaaataccactaactaagtaaggatgaactatatacgtacatatcctattataacaaataatgaacagatatattaaaaaatatgtgaataatatggatgatgatttaatatgtttgcattttgaaactctaaaatttaataaattataaaattatagataatatagcatacttacacgatatttaattgtaataaatgttagtggatgatgatgtggcatcttgttacagcatgatgatgtgacatcttaacatgttaactttagaatttaatggaattacgtgggatgatgatttaatatggttgcattttaaaactctaaaatttaataaattataaaattatagataatatagcatgcttgcatgatgtttaaatgtaataattgatagtggatgatgatgtgccatagtgtatgatgatgttttgtgcattataactttatagtaagatagatctagcacgtacattgataatcccatcgaaataataattctatgtaattatatacccacttactgtaaaaattaaagctgcaaaagaaacatgtaagacctcatatatactggaatgcatatttagaaatcttttttttaataatggtatgcatatttagaaatctatactccgtacagaaaagattagtatcggtggtggttccgccactgcctccactgcaactcccaacgaaaaaatggcatgtgaggctagatggcccacatatcaactactctcaccaactctttattttttgtgggaagaaaaaaattagtgtagaactaaaaagagattaaaaaatatatacgacaaatgagagatgttaataacatgttaaagataattttcttaaattgcaattctgttgcaccgcacggcaatatgctagtatatatccaataaatttcaacaggaatgcatggttttagactatatatgctcgctctttgctgtactattgaacactagctaaatgctcgggcgtttcaagaaggttattgaaagtgtacaaattaagtacttgttgaaaaatgtatttttaattgatttaaataaaatctttcattaaaaaacagaaagaaaaaaaggcatatttacaaaattaaagatctgaaacctagctagagagtaaaaactacaaagaaacaagtaagcaaagtatgcatggacatataggtgatatggtggtgtcggaccgtcttcttaattttagtagcatagatataagagttaaaaattttgtatttagaaaagctgaattatgaagcctaatcacggttgcataacacgtacaggctcgtttttgcgttcctactgcgggcccatgagccagaacgggaagccgcgcgcgttttggcctcccctactaaccctagcgtttagtaccgtgtgaaaaaacggcgtgcgtttttttttcatgttcgcaccttcttttttttttttgtctctgagcgtgtttttttcttccgtttctttccgattttttttaatcttttgcacacctctttacaaatgtataattgaaaagttttttattttgacttgaaagtttttaaattttgtattgaaagttttaaatatgagttgaaagttttaaattttgagttaaaagttttcaaaattgacttgaaagtttttaaattttgtattgaaagtttttaaatttgagttgaaagtttttaaatttgagttgaaagtttttatatttgagttaaaagttttcaaatctggcttgaaagttttcaaatctaggatgaaaagttttaaatttgggatgaaaagttaaaagtttttaaaatttaacttcaaaaagttttcaaatctaggttgaaagtttttaaatttaggttgaatgttttcaaatctggattgaaagttttcagaatttgacttcacgtatagatttcttttcaatctattacttaaaataatcttcggaaaaaagacaaatcttatcttaaccgaatcagttttgaatcagttttatagagaaaaaattccgaaaaaaataaacgcgcgtctcgccagcgcatacgctgagaatggctgaggatgggacgtgtgggccggtacatgtgggccggcgcgtgcacgccgagggcgtacacaccaattaggatttgcggttgtttgtatttttgagaactctgattctttcatgtactatatatatacatgtagacctgatcacctgaaagaatgacttgtagctaaagataccctggcaaagggtactactagaaaaagctttttttcaaacgtaggagtctttttccacatgcggacataagcctaggagtcaaatgaccgcttacaaaaatataaatcggggtgaagttcgctgtctacctgtgaaaatctattttcgcaggcggaccacctaagaggcacctgcgaaaatagattttcacaggcgcaccttatatggtcctcctgcaaaaattgtacctaccaaaaaaaaaaactttgatccttatctactactccaacccccctccccactactcatttctatcttctcaactctctctctcccttcaccaccggcttcttatcagctccccatcccctcccctcccctccctcccaccaccggcggcggagtgcgcggcagcggtgcgcggacgcgcagcggaggcacacgcggacgcgtcggcgacccggtgcagcggcggcggctccccggcctcctctcccagatccggccggagggaggccgggggagggcggcggcggctgcggcgacgtggttccccagccttccctcccagatccggccagagggaggccgggggagggcggcggcggcgagcacggacgcggcggcgcgcagacgcggcggcgacctagtgcgacggcggcggctccctggcctcccctcccagatccggccggagggaggccgggggagggcagcggcggcgacgtgggctgctcccctccggcggcggctccccggcctcccctcccagatctggccggagggaggccgggggagggcagcggcggcggctcctaatgctacagcggtggcgaggcgattttttttgttttttattggattttcgtagacgggccatttgtccgcttgcgaaaatggatgattttcaccgttgtctgtttgcaggcagtcctcccctccgcctgcaaaaattgcttttggccgcctataaaaatgctttttccagcagtgggggaaactaaaaggtcactatcatgaactacacatactacatattaatttggttcaatttaggagtgatcgatttgatgttgtcacctaaagattaatttcatccgggaacgttaccctactttctgctaatctgtgtagtaacacgacactactacgaaaagcatttttccgtgcgattaaaatgattttttcgtgtggaggatttgtccgtctacaccaaaacgtctggaaatattgcgacccaaccacacgagataatcatttttctatgcggtcggattaagtggaccgcacgggataatcgattatcccgtaaggtgaaattataccacccgcacggaacaaaaataaccaaaaataattaaaaaaaagcgaaaatcaccgcgggcgccgcacgcacccgggtgccaccgccgcgaccagccacggcctgctggcgcacgtgcatgcggagccggccgcgccgcctcgtcgtcgtcgtcgtcgtcgtggcgcccgccgccgtccgcgtgaccaagtcattttggtagtagaaaccaaaaacaagcagcctgcagtagtactagttacagccagagaaaccctctctaggaaaaacagccgagtgagatcaaagcaagaagagagcaagaactcaagcaccgtttatatcggcatggagaaattaggggacccacaatggttatctataggctctctacaagagatccatgtcagcatatttttctacttttaagatattaaatgaagagagagagcaaagctatctattaatttagagatagtttatagagaaaaacgaggcaatgcatgagagagctatagatatcaatgtagacaatctattaaggtggtttattattaatcaagtttattgctgagatatacatgttttatagagaacaccttactttactactgtggatgctcttagtagcacagcagtctcaactaccagaacattagcaatagcagccaccactagcggtttggctggggattcaactcaagcttgagagcaattgtcaagagactggaagcctgtagttcaacatcacaaccacaccactttgctatcgtagcagccatagagaagaaagagagtaggagatgcttgagatccagagcatgcatgcggagtcggtggtgccgcttcgtcgtcgtcatcgtcgtcgcgcccgccgccgagagccgtgcggggccccaccgccgtccgcgcccgccgcgcgtgcacgcggagccggcggcgccgcctgattgtcatcattgttacatgcgccaaccgctgagctgctggccccgccgtcgtctgcacccgccacgtgtgcacgcagaaccgatctgggagccagtatgtcacgacttgtaagaattagggtttagcgaggaggaattttgtgattgagatgataacgagagctgcataggaagatgaatatggggaggactagcgggaccatggagagattcgagagtcctttcaaacaagtgtgggtacactgtctgcttcaatctgttccctgccggtctcttatagcactgcgctaatgggcctctctcactccccgtggcccagcccaacatcactgggtccacacactcgagttatacaatctattaggctgtctctcccgcgcagacttccttctctacccattgtgtgagattggttcgtcgccttgatcatccgtgcctttgggtggatcagatgaagtagtcgtcatgacattctcccccccttgaaatgaagcttgtccccaagcttcggcctgtggaaagcgttgacgtagttcctgaagattctcccaggtgacggcggcgggatcttggcgggaccaacagacctgaacttgtttcaccagtttagctcctttgcgaacaagcctgtgattcaacacctgacaaggcgaaatgtctgcagcttcatcagcaggcaaaacgggtaaatgagactgtacccgttctacgggagccaaagccttcttgagttgggagacgtgaaccaccggatgaattaaactggaatctggcagtgccagacggtaagccacagttcccaccttggccaaaacctgaaagggcccataaaaacgaaaagaaagtttgcgattagtgcgagtgatgaccgactgttgcacaaacggttgaagcttcatatagacccaatcgccaacagagaaggagcgctccgatctctttaaatcagcctgatgtttcattctcatttgagctcgcagcacatgttctcgaatgagagtttgcatcttatccctttcatgcagccaatcaaccaactctggtgctgtacaagcagctgcagctgtcagaccaaaataacgaggtttgtgcccatacaatacctcaaatggtgtggctcccaaagaagaatgaaatgaagtattataccaatactcagccaaggcaagccatttgctccattgagagggacaggagtgcacaaaacaacgtaaaaaggtttcaagacactgattaactcgctctgtttgcccatcggattgagggtgataagaagaactcattcgcaattgagtgccagccaatttgaatagtgtcgtccaaagagtgctagtaaaaattctatcacgatctgaaataagagcctctggtaatccatgtaagcgatgaatgtgctgcatgtatgcctcagcaatgtccaaggctgtgaaaggatgagccaatgccacaaaatgcgcatatttggaaaacttatccaccaccactaaaatgcaattgaaagtggatgagcgaggcagaccctcaatgaagtccaaagaaacaatttgccaagactgttccggaaccggcaacggttgtaatgcacctggatacttgacatgttccaccttagccttctgacagatatcacactgttgaacaaattttgcaacatctgcacgaagacctgtccaagcaaaaagttgtctgattcggtgataagtcactgtaattccggaatgtccaccaatagcagctgtatgcaaattggctaaaatcttttgttgcacaggcacattatgtcctatccacattctgcccttgaagtatagcagaccatttttaagtgtgaagtcaggaatggcagaactattgatgcacagcgtttgaactttactggcagaatcaggatcctgatgataaccttcaattacttcttgtgtccattcgggaacacaaacagaaagagctgatagagcaacagattcaggtacaggacagcgagacaaagcatcagcagcattgttatcagcaccctttttataaatgatcttgtactgaagtcccaacaattttgtaagagccttatgctgccaaggcgtggtcagccgttgttcagccaaaaatgagagactgcgatgatctgtcctgataaagaattcatcatgttgtaaatatgatctccagtgatccactgccatcatgatagccaaactctccttgtcataggtagaaagaccccaatgccgaggtcccaaagctttactgaggaaggctatagggtgatcattctgcatcaacacagcgccaatccctttatctgatgcatcggtttcaaccacaaatggtaaggagaaatccggcattgcaagaacaggagctgacatcagtgcttgcttgagggtttgaaaagctgcatctgtcacagtattccaa

SEQ ID NO: 13798 - DNA, 6272 bp, Oryza sativa
  unsure (1)..(6272): unsure at all n locations
tgtatgatgccattctgtaacatttcagtcacttgagcttcgatctcatctttttgggcgggtgtataacgatagggtctgacatnnnnnnnnnnnnnnnnnnnnnnnngaggaattgtgtgatcgaattgtcttgtgggaggcaacccctttggttcagcaaaaacagttgcatactcctgaagtaataactgaatttcatttggtatttcttcagattcctcatcttgagagagagaacaaagctgaaccatatgggctactgcctgtttctgttgcaattgctgcatctccttagctgataacaattcacacctagacagttcagactgaacccctgttagagtcaccattgctcccagcaaattaattctgatagttttctgagaccaattaactaacattggactgtgctccttcagcaaatccattcccaaaatcatgtcatagctgttaagaggcaaaattctcaaagtggttctaaatctgtgaccctgcacttgccattcacactgaggaatcatagcatcacaacagagtgtaccaccattagcaactctgactgacaattgtcgaggaagagattgtatcccttttagaccagctgctatctgtgaactgataaaactcactgagctgcctgaatccactagaattaacacttgttttccttgaacttgtcctaaaatgcgcatagttccatctggctcagaaccttgtactgcctgcactgaaattgccattagttcacccgtttcagcatctgatataattgaggtttcccgactttcctgagctccctcctccataaagagactgaacagctcctgaaccacattgagttgaactgaggctgaacacttatgagtaggggaccatttctctgcacaaatataacacaatccctgggctcggcgataagccttgagagtagtcactttatctgtcgaatttgttggactgcgaacagtatcagtgcttctcttctctttaggacgattcatcaaagagaaacttccactcttccctggtggttgcggcaacggccacggtcccttgcctgccgatcgaaaaccagagttgccttccattctcttgacttccttaacactggaaacttgaggattctccaacacctcttcccgtaacaaagcaacagacagagcagtttcgagggtctttggtctctgtaaaagtacaggattacgaatctctcttcgcagcccttcaatgaatcgatgagtcaaatattttgcactcaccccagggtcataaactaatagttgattcattagctcagcaaatctctcataaaactcccaaaccgttcccgactgcttaatactatccatttgcctaatcaaattttcatgctggtcgcgatcaaatttttccgacacagcagcacaaaaatccccccatataggaaaacgcaaatgagctctagaagatcttaaccaagatgcagcccttcccacaaagtagatggttgctaccctcacccacaaaccaggaaacgtgttattcacatcgaaataatgctcacacttcatgcgccagtcctggggatctaacccatcgaatttagggaaatccaactttggaacacggtgattatattgtctctccccaaattcgaagtcaatttctccaccttcaacccccgaactctcaaattttggaaactggaaggagtgtgagtcatacgtacccttgaccggggttggacctagggtcatgtttcctcctgaagtctttccccggtgattctgaagctgatgatggctttgagccgatttgcttccgccctccaccgaggccataagagaatttggcggtggcgtgggcagcagtggcgccttcctttccccgtctgtcgacggaacccaaggggaagacgccgatgcggaagcttgctgtgatttgccaatgagatccaattgctgcttgatctcttcgacctccccacgcagctcttgaaccgcggcttccacttgaggtttccaactgctggctccttgttccaacttgacgaccgccgcttgagtctcggcttgtgcatgattcagcgccaccaacgactcctggatctccaagagcaccttgccgaaatccacgttctgcttctccatagcttcgacttggagttgcaatcgagatgtgtagcgtggcttctccagggtagcggctctgataccaaattgtcacgacttctaagaattagggtttagcgaggaggaattttgggattgagatgagaacgagagcagcagaggaagaggaatttggggaagaatagcaagaacagggagagatttgaagtagtttcagaaaagtgtttctacaatgttcgcttcaatctgttccctgccggcctcttatagcactgcgctaatgggcctctctcactccccgtggcccagcccaacatcactgggtccacacactcgagttatacaatctattaggctgtctctcccgcgcagacttccttctctgcccattgtgtgagattggttcgtcgccttgatcatccgtgcctttgggtggatcaggtgaagtagtcgtcatgacacggtagcgcgcagagagagagagtagagagagaggggtggggaggagaaaaagaggccgagagaggggatgggaggagatcgaggagagtaaagggggagagagaataaaaacgaaaaaggaagagagagagagagtgtggaaaatttgaagtgggtgagagggaaaagagagatattttttttacggtccacttaaaaagtctgcacatgaaaatcgattttttccgtacagccctcttaagtcgaccacacgggataataaagattatcctgtgcggtcgggttaagacgcccgcatgggaaaatgcattttcccgtgcgggcgacagtccagcgccggtcccccccccccaatttttcgtgcggttctagttatgggccgcatggaaacaaaaggggtggcgtccaggtaaaactatcatgtagtagtgggggtgctaggaaaaactaaatatgttgtagtaattccctacttaattcattatgggactgtttggttgggactaaattttttagtccctgttatatcggatgtttgaacattaattagaagtattaaacgtaaattattgacaaaatccatttcataattctggacttatttgcgagactaatttattgagcctaattaatccatgattagcctatgtgatgctaaacatgtgctaattatggattaattaggcttaaaaattaaaatttatcacgtgaattagcatttatttatataattaatttttgtaagtagtttatgtttaatactcaaaattaatgtccaaaacatctgatgtgatagggattaaagttagagttatagttagatatataattgccaattcgatctcaaaattgtctcgagttttaagctaggttgctggattggtgcagagctctatgcctctatctcgtttgtccattttggctgttacatcttccgctcaatgtttatctgcatatgttgatggaattattcctgtagtcgacacgataaatggacatgggatggaggaatgcatggtcttcagtcggactatcattgcgtgcaattcgaggtaaaaccctaattattagttctgtatatgatgcttggtttttattattactaactgtgttacgtgatcaatttacatacaattaattatcggataaattgcacttgacatgaataattccatggcaattaccatgaactgaactaaaggctagtagaattctccctgtgggtagtcaggcacatggataattccattagagtgatgaaattaatatacgagggaatttcttatatgccactgaaaatttatcggtggccttatattccacttgaaattagctctttcatgctatgaaattagctctttttcttatatgccatcgacttataccgtgcgttgacgttatacatccatagttaaaaaaacacatttactcttaaaaaaaacacatttacccctctaagatttatcaactagttataatatgacaactattcaattgaaaattggccaaaaaaatatttattctataattgattcttgcatgtctgcatggaaattttaaatgtccttctttttacagacgtactagtacaaaaatttagtgctattttgacattttaaccaaaatgttttctcgttaaaagagtttgtactttgtactaaatcttttttgtttggtcaatatatactacaatcctcaattaatgaagtatatactattttgactagtaatatgtccgtgctaatgctacgacaataattgatgttgtaaatgaaatgactaaaagacatctgaaaaatatatgttttgacaagggaacatatatagcattaaaaaagttgcaaggtttatggaaaagaacgttcttttaatctaatcttggccttcatcaaataatcaataaaaatagcagtacaatgcataggttgactactaattaatatcttgacaatatattccccataacaagaattacacatggtttaattaaactcttggacaattagcatatcatttcccatttaagaagaaaagaaacacattaacgacacaaggtttgcaattgtttccaaatcattaacgatattgctgtttactgtggaatgacaatatagatggccctgcaagcatatactccttccgtcccacaacattttgtctagattcgttgtactaggagaggtcacatctcctcctaggttgtttttttttggatggaggtaatataaccaaagctcttgggagtaaaggataaatagtgaacgtaggggggagaaaggaatttttttttaattcaacctaaccctttaatcagctggcctttccaatgctagaagctaaatattaccgtttgaagctacatattttatccttgcttgaccacaacacaaacattaaataccacttcctggcaacagatcatattaaagaaagtcaattgtataagaaaaccgttcaggttttagttgattttgaacttcagaaaactataatatcatctaatagcaacattctaactttaacaacattgttcttacttctgcaaagtgtagtatcaacaagcaatggaaatcattattcatctctctattacatgacatgacacttatataacctgactatatattcataaaatttctatatacaattccaggtgtgtgaaatttataatgaaacattcatcacctattgcttagaaacttgatttccagcaactgaacgaaacttgataccaaatgcttaacatccttcatggttctaggttaataatcttcactattattcacctatgcgtcactataggatgacatatgcttagcataatccacacagactgaatcaggattcattttacagtagattgacatgcacagtaaactacagcattagataatattactaaagttgtaaccatgcacatgaaaccctcgttgtgaagttccattttatataaatttgtgtggaagtcaagataatgtacatattccattttttatcttcaaaattgattatgctgctgctctgtttttcccaaattggaacaccttgactattattcctgaaatgaaggaaaaatgaacatttaatataacaaaaaataagaatcgtgtccaagacccatgcggtaaactacaacgaaaaattaagggttaattggatcaatgccattagaaatttgccgttttaaaaaagtaccagtattatttgtgaaatctgttatgtgtcactatatatatattttttaaaattcgaaccatgccatctccgtcatcttttctgttagcatcctcttccgtcttcgatggatccatgcactcgtcaggtgtcttcaatcttcagccgccacctcgagccgcggtatgctcgtgtgaagggactgactccgcgatgcctcggcgaaccagcagcaacgtctctgccaaagccatctcccgtgcctgggcaaagcgaaagcaccaactatgtagtttctactcatgaattgctactccagtttttgctcctgaattcactaaagcgtcatctcgatggattccgatttctcctcgtggattgctcaaagcctcaaccatagcatcgatcaaatccaaacacacatgggtaaaaaaaatccatgaaaagaaatccaagaacatggactaaaagaaatccatcatataccaggtcaattccaacaccggaccacagtttcccatg

SEQ ID NO: 13799 - DNA, 3035 bp, Oryza sativa
  unsure (1)..(3035): unsure at all n locations
ctttttttcgacacaatatagcttcacgtaggtatgtgcacaaatcaaatgccacttcgagttttttttttcgccaattaggacatctgtatctatgttattctcaaatcatgacaaaagttcaacgagacttgttctgaagcattgtgtgtgagatcaacacaggcactatccacgatcgagccgatgtatcgaaatggtcatgacaaagaacagtatgcttgtcttctctctaatgatgcccattccgatcctaggcaaacaacacaatgcttccacagccagcactagctaagtacaacagttaaagccaactcatatttgctatgtttgtaacaaataagttatgtcaatagagaaacaggctgcagaaagccattggggaggtaaggaatgatataaacaacagagaggaaccgacagcccaagacatatatggccaccctccgccactacctgaattcgcacgtcgatgtcaactaaaagggtagacatgttgtacttttttttttgactgtaaacagtaggagaggctcctactgtggtaattatattaaatataaataggagttacaacaaaattacaaaaaatatttacaaagggggaaagattaaaaaatgttgtcaatccatgattgatatctaggtctgtcctcctccttcactctatgcaaaagaagagtgaaatcctccttgaaatcagctttccaaatagtaagtgatggttggacattgtcaaaaatgagggcatttcttttcaaccaaatttgccagcatgcagtccccaccacttccatgaagaagctttgaccaaaatttccaaacgcagattggatcatgtcaaaaagatcaagattcacatcccaatagattgcaagggaattccaacagttttgagcaaatgggcatgtgaagaaaagatgagacatatcctccaaaatatctaagttgcagattcggcaagaaggtccatcctgaatagaaaggtgtcttctttgtagcatgtctcgtgtgtttaatcgatccataagaaggagccagaagaatgccttccctttcatgctgcatttgcttttccaaatagatgtcaaaacagggtgaggggtaatgtgagcaaagaagaggtcatacatttttcttgtcttgtagattggtccccatgagtaagtccaaatatcattttgatcaatgagaagaatattctccaggaggtctgataattcattgaattgaagaatagcttgaggagatagaggcaggaggaagttttgagccaaattattttgaagaaaagctctgacagatagatcttcattaatagcaaaagagaatacagcgggcaaggagttttgaaataatttatctgaccagagatctttccagaagagaactgtgtctccagagttgacttgaatagagctgatacctctaaagagaggtattagtcgagtgatatctttccaccaaaaggatccaaagtcttgtaatgcatgcggtggcatagatctattggtatagaatgaagtccagagaagttttacccatcggagatttttcttgttaaagaatttgtcgagatgcttcatcaagagggtacagttttgaaattctaaattgatgacacccacccccccctcttttttttggtctgcagaccttgtcccatgctgccagtgagtgagttcttgcatcaatttcatgagactttctccaaagacaatgccttcttgctctgtcgatgtgcagcagaacctttttagggattttaagagtgcacatgtaaaatgttggcagggatgacaggactgagttgaccatggttagtctctgtccctgattcaaaaacatcgttatagccgggagtcttctttccactctatcaatgagaggtgcaaattcacagatttttggtattgttgttccaaccggaagacctaagtatgtaaacggaagtgctccaattgtacatccaaaagtccttgccaggagttcaattttatcctgattaacaatgactgggatcatagaagatttgtggaagttgatttttaatccagtggatatggcataagattgcaggatgcctttaagacagaaaacttctctttgacatgccttcataatgataagcgtgtcatcagcgtattggattatagggaattttatgtcaatttgaggaataggaagggagaggactcccaggttgagagctttgttgattatagattgaagaagatcggcagtaaggacaagcagaaggggagagatagggtctccctgctttacacctctgaggcaattgaattttttttcctaggacaccattgagtaaaattgaggaggaggctggtatcaagtagtgttggtggccagtattagtgggttttgcacgtctctggaatatttgtactatcactgttttttaatatatgatgcgcaattaaaattcttttcaagcattgactgaaatggttattctatttacttagttaagtaagctgaaaagagcatcactagatttgtcatcaaaagtactttaagcatgtatagtatgtttgtcgtttgtacaaatatttttagagaaggagaataatccaaataaaaaagtcaagtgtgtcatgcattagaaaaatagagacaatagttccactgctagatagaaggtggtatggcatatatagttttgagcttttgactgtacaccaataaaacaacacggattcatgtgccggttgctcgttacaattttgtcatgaatgctcactttatgaatgaacaatgcagctgatcgtgcatgatgcagaaaagatcatgtattcctggatccgttcatggttgtaatatttttccatgtgcattattttgttttatggcttctctttgttattaacctccaatattagtgccctcgataccttcagtggtatattaaaaacccaacttaaattttgaaaaatatttttaaaataaagaatttgcnnnnnnnnnnnnnnnnnnnnnnnnnnnnnnnnnnnnnnnnnnnnnnnnnnnnnnnn

SEQ ID NO: 13800 - DNA, 561 bp, Oryza sativa
agacggcggccacgcagtcgtgctgatgcggcccggcgaagcagtggcgccccggcgaggccatgcgacggcgggggtgcggctcgcgcccatgtggcagctatgctttgctagacggcggaggagctcgtcctggcggcggcgtggctcagccgggcggcggcggcgcgcccgtgcggtggtgaggtggccacgtaatggcgcggtggagcgcggcgcggcgaggccgacggccggcgggggtggacggccatgcagtggctgcacgctcccccctttttttttgttctttttttaatggttttctgttgggttagtcccacattgttaattgatgatgggggagcacgaattaaaaggttgttacagttctcatccatcagactgtcttttggattgtgtaggcccaggacctaaacttgtgcctccggttgggtctgtggaccagacgcctacggttggtggaacaggctgcgcactctaacattttcttcctcttctgttgactatcccgggatggtgtgaagccttcctatcatttttcttctttttttcttcttc

SEQ ID NO: 13801 - DNA, 489 bp, Oryza sativa
atatcccgctcgcaaatccaactttgtaaaccactgagcacctgacaattcgtcaagtaactcgtcaataattggcaagggatacttattcttaactgtaatcgcgttgagatggcgataatcaacacagaatcgccatgatccatctttcttcttaaccaacagtacaggagatgcaaaaggactagaactgtgttgtatgatgccattctgtaacatttcagtcacttgagcttcgatctcatctttttgggcgggtgtataacgatagggtctgacattcaccggttgtgccactgggattagaggaattgtgtgatcgaattgtcttgtgggaggcaacccctttggttcagcaaaaacagttgcatactcctgaagtaataactgaatttcatttggtatttcttcagattcctcatcttgagagagagaacaaagctgaaccatatgggctactgcctgtttctgttgcaattgctgcatctc

SEQ ID NO: 13802 - DNA, 777 bp, Oryza sativa
taggtagtagggggatgcggtgagagtggatgggagttgccacagttgcaggaaaggtggaggaagtgggaagagaggatgatgggcggtgcagtggtgaaggttgtgaggattgggacggcggcgacgatgcacgcagaagtgagctggagtggatgggaggtagcgacaggccgagagaggaggggatgggggcgatgggagagtgcgagagacgataaggttggtggggttaaaaggagtatcacccgtgacagctcagctcagtttcataaagttgtcaatcttttaaagaatcggcacctataatataaatactaggtgaaaccctgcgcattgctgtgggaatttagtatgaagatatacattgaaacattatgtgaattatgttggataataatttaacatgtctgtgtttgaaaagctcttaaattataaaaaactataaagatatagcatgtttgcatgatgtttaaatgtgatgattgttagtggatgatgatgtggcatcttgttaattagtggatgatgatgtggcatctttgcatgaagatacacattgaaacattatgtgaattatgttggatgataatttaacatgtttgtatttgaaaagctcttaaattataaaaactataaagatatagcatgtttgcatgatgtttaaatgtgatgattgttagtggatgatgatgtggtatcttgttagtgaataatgatgtgacatttttgcatgttaagcttaaggagttagtagggggatgcggtgagagtgga

SEQ ID NO: 13803 - DNA, 9946 bp, Oryza sativa
tgacagctcagctcagtttcataaagttgtcaatcttttaaagaatcggcacctatatataaatactaggtgaaaccctgcgcattgctgcgggaatttagtatgaagatatacattgaaacattatgtgaattatgttggataataatttaacatgtctgtgtttgaaaagctcttaaattataaaaaactataaagatatagcatgtttgcatgatgtttaaatgtgatgattgttagtggatgatgatgtgacatcttgttaattagtggatgatgatgtggcatcttgttagtgaataatgatgtgacatctttgcatgttaagcttaagtagttagtagggggatgcggtgagagtggatgggagttgccacagttgcaggaaaggtggaggaagtgggaagagaggatgatgggcggtgcagtggtgaaggttgtgaggattgggacggcggcgacgatgcacgcagaagtgagctggagtggatgggcggcagcgacaggccgagagaggaggggatgggggcgatgggagagtgcgagagacgataaggttggtggggttaaaaggagtctcacccgtgacagctcagcttagtttcataaagttgtcaatcttttaaagaatcggcacctataatataaatataggtaccggttttctaaaaagtgtcacctatattattaatgccatatcatataaatataggtaccggttttctaaaaagtgtcacctatattattaatgccatatcggcacctatagctgcttaaatgtgctggttttatatattttttatccaatgtggaaacggttaaatgagctagtacctactagtgttttgtagtagtgacacggaggattcacatttccttattgttagattaggcatcaatatgcatcatattcataccatgcacactttgttgtacggtaacacactttttggtggcaggaatacaccaaatatttaggataaatccaaggtaattaaataacatggaaccattctatttataccagattgcttttacataaatatatgtgtttttagtgtatttgggtgctcttttgtgtaacatgtcactgttgaatttttgctttcactgaccatacctattttcactagtggggaacccatctttagttctgattggtaacccctttagttttgggtatgcaacccagacatccaattcaggactaaagctgggtatccttagtctcggttgaaatatctttagtttcggttgataacactaaccgggattaaagatggtagcaccaaccacttggtactattatctttaatttcggttggtgttaacaatacttttttttctttttttattcttatttgctgcttgcatcccacgtcaagttgctcctgacattcctaaatcaaattaaatccccacatcaaattgacatatcacagatcaaatgaacataatcatcaacaaaatcatccacaaatttacaaatcgaacatcgtacatcgaatgatggcagcaacacccatgccatggcagcagtactcggacaagagagacaaggaatagaatgaagaaaaaaagaagaaaaatgataggaaggcttcacaccatcccgggatagtcaacagaagaggaagaaaatgttagagtgcgcagcctgttccaccaaccgtaggcgtctggtccacagacccaaccggaggcacaagtttaggtcctgggcctacacaatccaaaagacagtctgatggatgagaactgtacaaccttttaattcgtgctcccccatcatcaattaacaatgtgggactaacccaacagaaaaccattaaaaaaagaacaaaaaaaaaggggggagcgtgcagccactgcatggccgtccacccccgccggccgtcggcctcgccgcgccgcgctccaccgcgccattacgtggccacctcaccaccgcacgggcgcgccgccgccgcccgggtgagccacgccgccgccaggacgagctgctccgccgtgtagcaaagcatagctgccacatgggcgcgagccgcacccccgccgtcgcatggcctcgccggggcgccactgcttcgccgggccgcatcagcacgactgcgtggccgccgtctgccgcctccccctcgtgcgccgctgcgtgccgccttccctcccagcggacgggagggcgccgccgcccgccgtcgttttcatcgcagctgtcatcggcttcgcagagagggaggggaggagggggatcaagaggagagggaggacgacggcgaagaagatatggagaggtagagaaaaagagatcgcgtcagagttaagtacgcaaaaatagcgatttttgtagacacttgggtgcatgcggttggcccacccatacgcaaaaatagcaatttttgtagacacttgggtgcgtgcagttggcccacccgcacgtgaaaaccatttttgatctcacggaaaattcctttttaagtagtgtcctttctatttttgggatcaaattgttgtgtaaatgttatgtcaatatcacgtgggacgaagaccaagtcataggagacacgtaattagctaaaactggagataatactgctaagcgatcttgtttacaccggtttgtaagttggaggacgggttatatctggttttttggttcaagcatgaaatggctggaagacaaattgaggacctaatgtgaacttagtccgacctgtcgaagtatatcgctcacagtcacagcccagtcttcactaggaaaacggaaagaaaacgaatgtgtgaaacaacggcccaaattaactaaggcaagtttccagtagaccggtctttctcttttttcttcctctttttttttttcttaaactcagtagtttgtcatagcagagaggctagttacattttgtgccgcgttaattattccagtgggtataacacatcaatatatttcatctgcttgagttatccatgtgctagaatacccaccggccggaacaattccattagcctataattcaattaatttgcatgcatggtaattatcatgtaattattccgtgtcaactgcaattgaactgacaatactcacaatagtatatgtacattgaacacttaacagttcttttagataattgaccacgtaaaaggttaataataaaaaccatacatcatagaaagaattattaaagctatatatagagggaatctacaagggttttgcctcgaagtgcacgcaatgacgatatcccgatagattcctgcatccaatgtccatttattcatgacgactgcaaaatcaatattattccattaacatttgcggacaaactttgagcataatatgggatatataactaattaaagggccaaaatagataaacgacctagagtcgttattatgtataacaacttacaaggtgtggaattttgaagtggtcagtaaatttgagttgacaaatgaaattacttcaaaaactaaagaaataatatgtgtagacagtgactttttttttctctttgccagggtacgatgatagtgatctactgtaggttgtagatattggttcttttttctggtcttatatacattgtatggttcgacaagtcaagaaagaatcagagttctcaaaaggaaaaagagaaaaatatcgtagaacgaggtttgcacttgtttttttttggtaaaaattaatggagatttattccactacatataatcttgcttacaatcattatcaaggaaaggtaaaataaagcctgcaggaacatataaacacaggttgtaaagcaacacgagaagaaatactctccttcgctacacaccttcgctaatggctagcatgtgtgctgtaccgtgttcgccgttcgacgtacccaacaaaacttcatctcttggaaattaaccaactaatttgaacttcaaatcttgattcaatgtagtatggattgacctatcaaattgtttgctaaccaccacaagggaatctgtttcaaatataattcttgtagcttcctaatcataagcaatcaattatgtgcttgcaaaagggtatgtagccaagtggttttaaagggctaagtttccaatttaaaaggctgcatatattcgattggcgatatagaggctgggtaaaaaaatacccttctctgatacaaaaagttcttatgtaagtttgctagtaggtaactgaagacatattaggcttggtattttagtttatctcaatataattacttttctctgttgttcgataattgtagagctaggaaacattattctacataaaaagtttctatataccagttgatgtttcttgatatttttataaaatttgtgtatagttgtgctgcgttaattattccactcggttacatctggcacatcaatagttacatatttttccagtgaaattatcattatgtgccagaatatgtaattctattactccatcaatgtaaagtgcatttcatcattatgtatgaatataataagagccagtgcaagtccattaacattcacggaatttattttttagtatacgatatttataagagccaaaattacaaataaacaaaaaccaatataattgacgggctgcacagtaatccattcatttctctaaaagttcaagtgaactgcatgagtttgtccatgcattgttatatatatcaaattaacaagagatgaaagttcaagctcagtaaatatgagatgacaataatattcatttacattaaaaaacatgtaaatatctgcaggatgaccacatatttatctaaaagcactggtggagaaaccatctttcgtcggtcggccgaattccacaatagtcccggatacaataaaaaccagggctaaagatgatctttagtcccggttgatcaaatatgccgggtctaaagatcaaatatgcccgttaccctttttaaccgggactaaaacttgatctttagtcccggttcaaatgctgtcagggcctgtcaggccccccgggatctttagtcccggttagtaacaccaaccgagactaaagatcgtaacttaccaaccgggactaaagagctcggggatctttagccccggttggtaacaccaaccgggactaaagtcccacccctatatatatgtcttctttctcctccagctgcccgagcaagtttcaaaatttcttcaaaaaagaggggaggtcacgccaaaatttctagtgaatttattttggtgattacatacaaatcggaggtgcctaaaaggtttgcaacttcatcctccagtgttttttttttgtcatattacatttgcagctatgttttgcacacttttttgtctccaaaatttagttgtaagttgatgagagagaaaatttgtgtggggaagaaagaatatatagaaatttagttgatttgctaaagaaggttttataaaatagttgagaaagaaaatatagtgaaagttaatcttaaataatagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgtggaaagagtttgtaattatcttataattattgtatgactgtcattattgtaagaataattatttgtgtatgattttttttgactcatgtagatggatcggcaatggatgtacactcggcaatggatgtacgctgaccggcggtccaaagagttcattgacggcgtgcactattttttgagagtggccgaagctaacgggcaaaggggttttattcgttgtccatgcaataagtctaagaatcagaagaagtattctgcatccaggactattcatttccacttgtttgagtcggggttcatgccaagctataattgttggacatcccacagagagcaaggtgttgaaatggaagaagatgaagtggaagacgacaatattccggactttgctcagtacgttggatttgaaggaaatcaaacaggcgaggaggaaagggatgctgatggtaacgacgttgcggatgatctcggtcagatgttgcaggacgccaaggaggactgcgaaagtgaaaagggggcccataaatggacaagatgttagaggaccacagaacgtcgttgtacccaggttgcgagtaggggcacaaaaagttggataccactctggagttcttgcaatggaaggcaaaaaatggggttagtgacaagacatttggcgatttattgaaactcgtcaagaacattcttccagagggaaacaaattgctcgagacaatgtacgaggctaagaagatagtctgcccgctaggactggaagttcagaagattcacatatgtccgaatgattgtatcctatatcgcggtgaggagtatgagaacctagaagcatgccctgtttgcaaagcactacgatacaagattagacgagacgatccaggagaagttgacgggcagctaacaaagaagagaattcctactaaggtgatgtggtatttccctataataccacggctaaggcgtttgttcaggaacaaggggaatgctagaatgatgcgatggcatgttgaagagcgtcaataggacaggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatatacaacctcccccctggctatgcatgaataggaagtacataatgatgccgattattattcaaggccccaagcaacctggtaacgacatcgatgtgtacctaagaccactggtcgaagatcttaaactgttgtggaaaaaggaaggtgtccccgtgtgggacgaggacaaacaggaggtgtttaacctacgagcgctgctgttcgtaaccatcaacgattggcctgcacttagcaaactatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaagacaagcacttcgaacataaggctgaccaccgtacgaagcctaaacatcgcagcgggaaaacagtgtttgctatggttaaagatcttaaagtagtgttcggaaaggggcctggaagccagcctatagagagcgaagatggtcacgcggcgatgtggaaaaagaactctatattttgggagttaccctattgggaattcttggacgtccgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtgccgtctggatactccacgaaggaaaagatgttcacaaacctaaagtctcatgactgtcacgtgttgatgatacaactgctaccagttgtaataaggggtatccttccagacaatgtccgggcaacaataacaaagctatgtgcattcatgaacgcaatttcgtagaaggtcattgatccggatagattagaagccctttagaatgatgtggtgcaatgtctcgtcagttttgagttgatatttctaccttcatttttcaatataatgacgcatttgctttgtcaccttgtcaaagagatcagtattctcgggcctgtgtacctacacaacatgtttcctttcgagaggtacatgggcgttctgaagaagtatgttcgtaaccgtgctcgtccagaggcaagcatcgccaagggttatgaaacagaggaggtcatcgaattttgcgtagaatttatcgaagaccttcgcccaatcggggtacctgaatcacgccatgaagggagactacagggaaagggaactctcggaaggaaagcaataatgacggtagacaacaatttattccgtaaagcccatttcacggttctgcaacaatcttcattggtagctccttacatcgaggagcacttggctctagttcgcgccaggaacatcggtaagtccgatgcatggattacacggcatcacattgatactttccccgcgtggctactacaacatctcgtgggtaacgagtcgatcaaccaacaacttaccttcctggcgaggggaccgtcctggtcgatcgcgacattccagggatatgagatcaatgggtacacattctacacgagagcccaagacatgaagagcacgaatcaaagcagcgctgttcgtgtcgatgccatgggacacgatggaacaactggcacgtattacggtgccatcgaggacatatgggaacttgactatggtcctctcaaggtccctctgttccggtgccaatcggttaggttgactggtggaggcgtaatgattgatgacagtgggatgacaacggttgaccttgacaaagttggatactcggacgaaccttttgtccttgccaatgatgtaacgcaagtcttttacgtgaaggatatgtctagcaaaggaaagaagggcagagggcctgacgagcctaagcgtcatgtggttctcctagtcaaaagaaaaatcgtcggagctgaggacaagactgacgaggattacgatcagttggatgggcaaccccctttcacggtgatgattgaccctagcatcctcctatcaaatgaagacaccccttactcacgcagcgatcacaaggagggaacaatagtgaggaaaaagtacgtgcggtcaactgtcaccgccgatgtattgccgtaattattgtgtacacgatgtaaactattttggatgtattgattatccatataaatcaattgatgtatggcatatgttaattatgcacgattattagaggttttaatcatgtatatgctagttatatgcgatacttacaatttttaaaagttttaaatcatgcatgtggcatttacatatgttaattagagtttttaacaattaatttactatcattcatatgctaattatatatgactattcgaatttttaaaagttttaaatcatgcatgtagcatttacatatgttaattagagtttttaacaattaatttactatcattcatatgctaattatatatgactattcgaattttcaaaatttttacatcatgcatgtggcatttacatatgttaattagagtttttaacaattaatttaatatcattcatatgctaagtatatatgattattacaatttttattaattttaaatcatgccgtatgtatatacatatgttaattagagtttttaccaatttaatatcattcatatgctaagtatatatgattattagaatttttattaattttaaatcatatatttgcttattacgttttatccacttaattcattacagacaacaataatttttcgaagtaattgtcattaataattttaaagcattattttctattttaggagcacatatgtaatggaaaataatattcagtgcgcttatcagtagtcccggttcttaatcctaaccgggtttaaaaagaatttggaaatagcgggaaaatatctttagtcccggttgatgagaacaaccgggagtaaagattgttctcatcaaccgggactaaagatctatgggtatatatattcctgatgcgcgccctcgtcttctccaccaacacttagaagtttttgcccgatcgatc

SEQ ID NO: 13804 - DNA, 2291 bp, Oryza sativa
agattgtgtagggttctaatatacgacagttacacttagcacacatgactatgtgagttttagtctaagattatcggagttttaatataagattattatatttgtaattagacttagtatataattattgactagctagcgtcctataatatacgtcacctagatttagcatttatcactatttgagttttagtataagattattagatttgtaattagacttagcatataagattgtgtagggttctaatatacgacagttacacttagcatacatgactatttgagttttagtctaagattatttgagttttaatataagattattatatttgtaattagacttagtatataattattgactagctagcgtcctataatatacgtcacctagacttagcatttatcactatttgagttttagtataagattatttgagttttaatataagattattagatttgtaattagacttactatataatttattgactagctagggtcctataatatacgtcacctagacttagcatatgattgttagcatataagattgttaaaacataaatgtctcatgacttagcagatgtttcctgtatgaacagatggctgatcgcaatgaggaacagatattgtacgatacaatcgcggagggaagcagccagaactggaacgaagaagaggggaacaaggatccaaaccagtatttgaacgaggaagggagcgttgagagggatgcggaggggaaccaggaggggcacgtggaaagggatgtggaggggaaccaggaggaggaggctagtggaagtcaaccctccgttggacagaagaggggacgcgggcaacgaggtgccacgaagaagcttgagggtcggcacatcataacggaagtggacgaagacggccgacctagtgccccggcagaagccgccaagaactatgtacgtcacagcggttgggttgcgcgggataacgtgcctgttagtacggtctactggcgcagaacaagggcacgcggagatcatgagagctttgtcccagattcggagaaagagatgctgtggaccacaatgctcgagacattcacccttcccgcgggtacagaggacaaagtgaaaaggtggactctgaagaaaatggcagaacagtttcggagcttcaagggagatctgtaccagaaatatatcctgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggcggctatagcgtcgcgatgccgaagtgggaggagatggaggctagcttgcttgagaggggtatcgaaccggccaccgctaattggccggaacgatcgaagttctggtactatgctcacggtggaatgctcaacccagctgatggctccctggtcttcggcgatcagatacgcgaggctgcgcgtcgactaacagacacagtggaagcctcttcttagggcacgttccgaccgaacagagagaaggacgagctgtcactcaccctgcagactccagagcatccaggacgaacacgagggaaaggggtgattccttggaagattgggttcaaggaggacatccacacgtacaggagtcggatgaggagcaagagagataccgaggcgaagattgcagatctagagttcagggtatcgagctacgagctcagcatgcaagaggaggtggcaaggaaggttgatgaatgcatggccgcacatcggtcccatgatccccagccgaccattcctcctgcaatggtgagcccgtcaggaaaccgtagcagctgcgcctcaaaggggcaggtaggatcatagagcatggacgccatgcaaacgcaggacgaatccacctgccccgttgatgacatcactcagcggacaccatgtgagctgcatattcctttcaagaacttatcaataaaggtaagcccatagtttatagattttagatttggccattccgctagttgtcgcttatatatgttgattactaatccataaccactcaccacatgaaggtggcgtcgggcatggccatcccaacggacccttcaggtacttaccactgtaggccgattgcagcaggatactccaaggtcgaagttgagttggtcgaagacgcgtacgaggacctcgagctggattccctggaggagatggtgagacgcatctacgagacacaagcc

SEQ ID NO: 13805 - DNA, 37159 bp, Oryza sativa
aggctcctcttccggcaccttccaagtcaagggcaacccaagctccaccgcctgcccccacaagggcaataaagaaggcgaaagttgacaccgccaagaacaaggacccggggtacgattgcacgcaagaggagcttgaagcttacgtggcatcagaagtcaacagacaattcaagcctcgaagtccagaaaagaagattcctatagacccgagtgttaggaacttcttcaggggtatgtctgcacctgccaaggaggccataaagctatcggactatgagcgaacgctcaagaaagcatcttctggaaagtccaaaccagtccctcagcttggagagcaaccaaaccaggagatcgagccgttggtgactggtgaagattttggaatacaagaatttattaatgacaccgggctaactacggatcaattgctaggagacgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgattggagcaaggatcagggacacggacttcttgcaaggagatgacattctctggatcaatttcaagggaatctacgaactataccagctggacgccctcgacgtctctattatgagttgctggattttgtaagtatatcattcagttagatttcttactacgtctcctttaagtaattaggtccttgtatataagtagactatatataatatatactcccttttatcgttgtagaatggagattcaaagggcctaacggcggggggttttcgatactggattcatcgaccctcggaaagtaaacgtcgcaatgctcgaccaatatccgcaagccacagaggacaatctcgtccatctcctgaaggcgcagcattacaagacgttcatactgttgccgtacaacacagagttagtttaattttactgtcttcctataccaaatttcattcccgtatgaacttgctaagtgtttcatatgtaatgcatcccacgcacattgcagattccactgggtgcttttactcttcgacctggaagcctgtaacgtcaacgtatatgactcaatggataaaaaagagtctacgtttgacaaggttttcgaacttatagacaggtactgtcataagttcctatgttaattaagaatcttgttatagttaattgctactacgaatcatagctttaaactccatgtagggcttggtatcggttctatcatttggtccgcggcaaatggagagaaagacttaggcggaagttcaaatttcctgtgagtacatatgctctacatttatatttctctgattcaaatacatacaagtgtacattaattagatctctcgtcgtttgtcatttatttatagtgcgcaaagcaaaagcagggaactaacttgtgcggctactacgtgtgcgagtattgccactgccttgcagaccaaatcatcaccacaagagagctcgatgtacgtacaaataaatttaaaatttcattatgtatcgatttgttgtttaattactaataaatttcatacattcatatagtttattcgtatgagggataacctgatcacacacaaggaatttatcgcggcggttcaagaacaactcatgggattcatcaataaacaaatccttgatcccaagggtgaattctactacgacggaaacacaattcataggtccttagcttctgagctagcgactactactacgtcgaaatcgtagctagctaggacatataatggattgtaattaatacatgactatgtttctatatgcatgtgtacacattttctataatgtaaatatatattttggtcatatatatatatatatatatatacatatgcatttgcatatgtacatatgtattgaaacatatataaatataatataatatatatatatgcatatattatatgtgcatatatatgtattgaaacatatatatgcatatatataaaccatgcagcaacagggacatgaaaaaaaaaaggtcagctcgatctttagtcccggttgtttactcccggttggtgttaccaaccgggacgccggtgttaccaatcgggactaaagatcgatttttagtcccagttatttcacccgggactaaagatagcgatctttagtctcggattggtagtcccggtttggaaacagggattaaaggggggttacgaaccggaactacaaacgctttctctaccagtgaaggcaatgctattcataatcaacagttcgtcactactttttttgccggtaaaaaaaaaaagctgtgacaatatagcaaacatatatactctaattttttttctcgaagtaactttgttcactggtttttattgagacttgacagcaaataattaaacggatctgatgtacctgcagttccttggcatcgtaattagttctctgcagtttattaccagcaactaatatttccaaattccctatatatatagaaacaaatggaaacttcaaattggttatttgttaatatatatcaggttagaaagggttagagaaacacgatccacgtccagaagaaggttattatacgtaatgggttgcttggcgaagtgaatatctggtagatatatatagtaatccatgtcccacagaatctctgatatttaacgtacccatgtgaaacagattctattgtatataatccatgtcaaacggaatctgctgtatataatttctgcgattcactaaacctataactagctagctagagtgccaagtcattcaagtatctcactaacagatacgtgttatttttatttatttatttattggggaacatatatattgcattgcaatcataggcacctagggtctcattcacactcaactatataaacgtccacaggtatacgttttttcctatgagtacttctgacttctgagatgagagataaggtcagcatatattgagattggcgaactcactatatatatgtgcctcatggttaactgttatatcgcatgttaccgaaagaatattagtcataaatataagaacctgtacatgttcttagtcgcggactcaacctgagtcgacaaaagtttccaccaccataaacctaatccgctcaactatgctaactttgcgcatgtcgttttaactaaattagtcaaagaaaattatctaggtagtgctggcgtaatatttcgggaaaatatgtggtgggaatcacatatgaaatgaaaacttagaaagtaccattgattgaaaaatagacatacaagattcgtacgtttcatcacaagtaaaaatttactcacggatttgctcatgagtaaaaattttacagtgagtaaattttttactcatagtgacgtggatgaatttccagcgtctatttttcgatccagtggcagttttcaaatttccactacataagtggtttccaccacatattttccctaatatttcagttatgtgactagctcggaattgattctatatataatttagaaggaaaaacactatgtaattattaatttagaattttataactataacaaatacaactttagaattattaatttagacaaagtagatttatttataactgaatataatttccatatgtaaaaacaatcatttaataattagaaaatgcaactgccattttaataaaaaaatatgggaagtaaaaatattaactagttgcatataattggaaaaacttaaatagatatgtattttgttatacaaatgacaacatcagtagcctttgcgaatggatgggctaattaacaattaacttgctaattgtttatctagggcaaatatatggtgaaaactcaaaacaattacacacataggtgatatttaaataataaacaaccgaacaaagttatacgaacaaactcatgttcgttaatgagatataaaattaataaataccattgctcgtgtttatatctttttatcttatatttctcaattttatatctcacaaactcaagtaggttgtatggttgtctaatattaccttagctatttgtgagaggtttttcaattttttggaaaacttccatatatcattgtttgagataaaaaattgagaaacagcgatataatagtttttatataaataattagagaatttttttgttgatttgttttgcaaagaggtgcgcgctattacagatatgggcaggctgaatattctgaaagttaaatttctttctagtgtgtcttttttagataatagaatagaatctcagcttttgctcaaagagttatagccaattcttttctagtgtgcgtgtgagtattgatcgacatgtcgtttaattttatgaaatccaggacactttgttgtaaattttgtttttcaatgaagtgaaagggaagactaattccgttataagtttgaatgaataaaaacgagtaataatttataagcataattagctgtccagaattttttttccggaagaagtagagcaagctgttcaggacgtagatgtgtagataaatataaatatctaccagttattgttaagagagacttctcggactaggacactgcacgtatacgtatatatttgcatatatacaattagtgaaagattctgagtgcgcatatagtttagtttgaaacaggaatcatgccggctggtgaattggtgtataaatagaagatccagtctcagtctatctctctcatattccttcgatctgcagcttgtacgttggccttcttgtggtacgggcaggagtaggatataaaccttcacgccgatcttctccgaggctgactcggtcgatccagaggtatccatcgatccttaatttgaacataactacttttaagaatcctcacttactatatacatcctcctttctaaattgatcatcatataatacaatccaaaattttttgaattggtcatcatataaccgcatggacataaattttattggaatataattaattcaacatgggacaatagtttacattaatttttaggattaaattagttttctagaactttgacaactgataatatataatacttttggagtcaaatatgctcataccatatttatactttttagttttaagtaagagatttgctctggtcaaacaaaaagtatctcgaggtactcatactaaatcgtttgcgatcgttggatctaacaacgcccatcctgcccagctagatccaacgatcgaaaacgatttagtaccgtaaaataccggtaactcgagttactttttattgaaccggagcaaatctcttcaagtaaatatttataaattcattaacggtcgaagttttaaatgtttttatcaaatcttgtcctaaactttcaaatgttcagaattgaagcgagtatatatgtgtatcactaacgagatcgagtgcagggttggaaattccggaacgatattatttcggccgaaatttttaaattttaaatttttccgtgaattttggtattatttgttcaaattcaactatactttattcaaaatttcggaaatttcggtgagcaccgatcaaatcggctataccgataggttttctagtgactcaaatttgcatggcttgctcaataatgaattaatgatcttgaatttgctgatttcaacagaaaacgacaaccacatgttacgcacgccggatttgggtgatcctccggtggcggagatcactcacccgtttcaccctcacaagctgaggctggccgacaacgtcaccgacggtcactggcctttccggtgcggcggctgcaaggagctcgccgccggccgccgcaggtacaggtgcgagccctgcgacctcaccctctacacgtgctgcgccaccgcgccgctcaccctagagcacccgctgctcccgggccggcacttccgcctcctcgagcggcctccgccgccgccgccatggctcgccgccgacgaccgtggcggcggcggctggaggccggcgtgcgacgcgtgcggcgacctcctgcgcggcgacggcttcgcctaccactgcgccgatgggcacggcctcgtcggcctgaacctccacccgcgctgcgcgaggctgaggctgccagtggcggcagctcgcggcgccgccgccgtcaagctctgccgcagggcggctccccgccgacggtgcggcgtctgcatgtccggcgaggatgggtaccgtcacgggttctggacctgccgcttccgccgcagcggcggcgacgagctcgtcgacgtgcacctgtcgtgcttgaaggagttgatgtcacactcacacgagactctgactaatttgtatgagattctaatggaggacgggacgccgacaaatgattgtggtgaaggtgcatctgcacaagataatagcaggtgtgtatatatgaatttattccctcctgataaataagtttcgttttagaatcattgcagtgattttcgaccataatcattgttcagaacatatgtttgaggcacatggaaatcatatagctaaatttgttgctacagcgagaacttccatagtattacatttatgcagttatttcaataaaaaagccacgtgcaaataattcagttatttcttttttaaaaaaatataaaacgatatgtattacgctgaaaaaagtgttaaatgatagaaattattaatttatgattggaaagtacaacgccgtacatgaaaaactaccagcaattattatgtcataaggaaattatcataacgagctaggggattcccctagataattcacgtatagagtgagatttagtatacaattctgaaattttatattctattggtaacattgtatgtagaaatatatttagattttatatatacaatgcttagcttctatttctataaggtttgaatgtcatataccactcttaacttctatttcaataggcttagatttcatatataactcttgaattatatttctgtagatataattgtatttttatacaactatatgtaccgttatctaactgttaagatttttttctttttctagaaatttctagcttctagaatgaatgcggtagaagagcgtcctaataatataacggatagatgtcaaaaacttattattttataaattagttgctccgaaacgataatacttatcgttttggataaaactaaagtcaaaatttaaaatatttgactatgaaatatttctcatacagatatggagaccatatgtatagattaatcttgaaaagtacttcaataaacttatatatttgttcatatttatacgaatattactcccttcgttctattttaaatgtagttgttgatttctgtgtccaacgtttgctcgtccgtcttatttgaaaaattatgaaaaaattgaaaaaaaataagacacgcttaaagtactagtgatgctttattatctaatagcaataaaaatactaatcataaaaaatatcaaataagatggatggttaaacattggaaaaaaaaaaccacaactgcacttaaaaatgggcggagaaagtatagtagaaaagtgttattaaggttatttcttgagtgttgtttcttggagactttgtgtccttgtacaaaactataaatactatcaagtagttctaacaaaaaagaaatggttgtcaggatatttaaagtttgatcgagttttgtcccaaataataaaaaaaatttactgatcgggatcattgaatgcgctagttacagtggggaaagtaacggtgatgcggaggagttcgagaaccagaatggaacaaacaacggtatggtgccggagatgaagacgatcacccaccccagccacccggagcacaagcttagaatggtgaccaccaccggcgaagcgccgttcaagtgcgacgcctgcaaggagcccggagacgggccgaggtaccactgcctcacctgcgaggacctcaacatgcacaagttctgtgcccatgcgccgagcacgctctaccaccatctcttcggccgcacgttcgagcttctcgccaagccaccgcaaggacgaccggagaaaccgcaccccgccgccaccggtggtggcagaggcgaaagcggcggcaggtggtgcgacacctgcggcgaccatgtgttcggtctcgtctaccactgctcaggcgccaacctcgacctccacccatgctgtgcgagcctgcaggaactcccggtccaaaaccgggagacgttggaccaaccgaaagaaagtcttgctacgcctcaaaagctagttaaagaggtgagagattccctcacttttaagttggctcaaccccataaataagtaacgtgggactattctcaacagggactagccaagatcactatcgacggggtcgccttcgacatcgcggcgttcagcaagtgcagcctatgcagcagacaggaggaggagggcccggatcactgctgccgccgcctccgccgccaggagcaatggtgctactacaactccgacgtcgtcgacggcggcggcgaggccgtgtccctgcacgtgtcctgcatcaagcagatcgcacggaggagatggcaggcagctcgggacatgaaatgtggagggcagatcatgctggcgatcagcgaggagatgatcggtgaaggtggtcctctccatggcattccgtcggagcgagatcggaacatcgtcggcgcggtggtgcgcgtcatcatcgcggtgatatttggagataggacagccatggagggagacatcagctcttgggtagctttaggtctcccatggctgacaaatttatttaccgttcaaagataaatcgattggtgtgtgtttctctcgctcatctattcataggatgctacataaataaataactgcaggtaagtaaataaacaaacagataattaatcgatcgaggtgtctgttggcttgttttttttccacctacttttgcttatatattttctgggatttggaataaatggacttgtatttccttcagtgtaaaatattgtgtgtaatatgcatatactccctccgtcccataaaaattgcatttctagctccaaggctttgttccacaaaattatatttctagccatgtggggcctaaccaattgattcatctatataagtttcattccatctcacataatttgagctgctaatgcttgtaattttattaagtatgctaattatatgggttaattctctcaaacttccttttaatcatttgtatatatggaatgtgtgcatacagtgggttcattaaataaggttattgtggtaattttccaatcctactattttgtcctaaattagctagaaatgcaatttttatgggacggaggtagtatttgcataatgcttgttcgacaatgttgacgatatatatatattgcacgcattaatccatctgacagaaatggttgtttattagttttcattttttttcactaattattattgaatcaactttttttatggattagtgactgaaaattaagttttgagttttccaaatgaccttatatagagacatgttctatgtcaaaagtgtataactcaacgcgatctacaagtttacatctgatgacatttccatttgaagttattcaacgtgcaaaatgtatattccaagtttagaatggtgaagtgagaaacaaatagcatatccttccaacaatcatgaaaagctcataggtaaaatcatgtgacttgtgatttatgtttcgctgccatgtatagatgcctaaaatatgtttttggtaccttttgtgcctacgaaagtcaaaatctggtaattcatttttaccggccattcatgaaaattgatttttacgggtggtcatggaatctgcttgagaaaaatcctgatttctacatgcccttacttttagacgacggttcaaaaaatacgtgtgaacacgagttattgaccaccctgaactaatgttttcttttatataccaatgccttataattgcattggtagttgtttcatgtaatatctgcggtccccaaagtgtcgctcttttaaagaagagggtgaatgttataaccaaatcccatgtaaacccttttatctaatgcaaatcccgtatagtaaatatgcacctcctcttcacgatttggtgatgatgttgatataaaatatgttgctacttattgctctcccctacctatgctttgtagttgtacatatatctttgatcgactaaaaaatttatataaccaaacatatatctcttggacatcatggaacactcggtgtacttgtccttttttgtgttctcaaaaacaatttatattgatattcatttgttatgaataggaggcagcaggaaaactgagtgtagatctgataggactggacgtctcatgacggtgagaagtggaaagctacagtggggagtcaagcctcccagatcttcaaaacctgcaagcatcgatggataactcaagaacgaagagactagtacaacgatctgaaattgaagattatgctgaacaaattgatttgataccttcttttcttgagcagcttctgtttttatgcaaataattgcaatacccagaattacatattactagacgtcaacccgtgcgttgcacgggtataattatatattgttacaataatatgaacagttttatgctacagatgtgttgtttatttttaaaatatagtagattagaattaaaataacttgttagttttgaattaaataattaaattaataagtgctaaattgacagttgagcatggtcataaatcgatatatagttattaagtttgaatttattttcacattgtagtgggattagataaaatcaatccctacctgttacaatctgctattttttattttgaatttcataaattattaatagcaatgctaaatagtacgtagtccaaggtttaattggtacagctccatattattaatttcattttttttagaaaatctataaatgtaaagagcatatggcctgttttatttaatataaaaccaacataatcaatgggtacgattttatgatgattaaactaataaatgctacattgatattgatagtcgaagatgtttagaactctgtcataattagaatagggagttatagtggattagataaaaagagtcctagttaaagtttgctaatcaaaattattaaatttaaaattgttctcgtcttggactgtcaagcaaaaatatttttatggctgctgcttgtcaaacttgaagttacaattttaattgtctaattattaatataaaattgtacttgtcttgaactctcaagaaaatatttgtatcatccctgtttgtgagaaagaatatatatttatatcatgtcgagagacaaataagttgtgttatttgtctttggaaattatatatatatatatggcatcaacttaaataacaatgagcggatacaacgaagcagcacgcatggattaattagtttgaatgtgcagaaagctatagaacaacaaagttcgaatatatatacatataagagaccatacaaatcaaccatgcatgaattatcttcatgcatggtttacagatgcaacgcctacgatggatgtttcctaggtgcaagcaaaacttggcatagaatatccaaattgacaaattacgtaccttcataaagagcagatgagacgaccacggatcgatctctttgggtgcaatcgaacttgtttgtttgggtgaattataacatctcaatgcacctgaaatttattaggtcatatgttggcatagccagatgaagagcatgcagatgaacagctagaattggagaaagttcgaacaaaatcttacttgtgtacgtaaatcagcaatcgtagctgtaggatcagtttagatcaattcttaatagatgagctgagaccccgcaaggacaaatgcattcggtcgacatcgatatggagctttgcctgcatgcaattgcggccaaacctcgggtgcacgatgaaggaggtcgaagttgccgccgtcttgtcgggagcgatgtccgccaataccgtggcagccatcgatgtaggtgaataccctaatgtggtggctgagattaatacgtgcacatatatgggttttgggcctttaaagcagttaaagagattggatggtggaccaatttctaacgctagattgcttggactttaaaagtccatgtttacagtttaaatctacggtcctgatattaccgtcaatctaatctaatggttagatctttatagttaacgtgagagttcgtagaaagtgcccaattagtatagggatagatttatgttgcttccttgctagttttttgagttgggaacttgggatggcaacacaaagttctagcaataatttgttacctcacctacctctcaacttcagggaagattaatccacaacttattacacgacgtcaccacccgtctctcacttacttcagattgtctggcttttcactcgctgaatcgctgtttgcatcggatagttgttttcttcagtccaaagtatacccataaggatgaagtagcctttaacttctctctatgctgtttgttggcgataacctctgatcgaacacattgcgtgcaaactgcagatgtccggcacggcaacagactaaaacagtaacgaagaacaaaggaaattcagagcagaggaaaaaactgagaaatttcagaattctccgcgagaacgatcaaatgtggggcaattttctggtggtttttcattcaactaaataaagaacttacaaatgaaaaaactgagctaagactcctacttatactcgatacaaataaacgaatccgaggcaaaatcgtgccatcccacgatccgcaaatctctgaattcagctacacacacctgcgctaaactcacgcacacggacgctactgatgcggtcattcagatcctgatcgccgcatctcccgcatctgctaacaaactccagcagacttattctccaagccattgcaatcgctacacacataaacttctaacttttccgtcacatcgttccaattttaactaaactttcaattttagtgtgaactaaacacaaccattactagttgagaatttagattttccttgacgacaaagtccactacaattctccaaaaaaattattaaaaacaagtcagtctccaccagaaccatctaccaccacatgtccatttgtgtcaagaacagagttattcagaaaattgatcagtactctaccactgaacccccgcagcacatgacctacttagagtttctctagaaaagtcaatgggggcaggaggccagcgtgggggcagacagcgtgcaggtgggtgacgtgtgtgcgggcagccttggagggcacgcgacggccggcgtgtggccaggcagatggcgggagatcggcggccgggcatgcgcatggaccgccgccgaaggccttgagatcgacgggcaagaaaggtatggaaaagtcttacctttcgggggcagtcttgacggaggtgctgggaattcgtcggtgctcgccggagaagatccgtcgtcgcagccgtgcaggaataacaagaaaatgcgcgaagcaaaattattatccgcgccaaaaaaaatgacgatgggggcgtgctccggagcccccaggactggggccttgggggaggattcgagggcctcctcacttttggggctctagtagggtccctgctggatctagttttttgatcttaactctcaaaaattgaataggggctgaatttgaggtccctgctggagatgctctaacaattgaaacactttggggggccacagctgaaattacacattcaacactgcttaatgtgtattggtacgaatatacaaactagagagagcaaacaattctcgatctgttgggttcatatatactccctccgttttcaaaatgtttgacacttgactttttagtacatgtttgatcattcgtcttattcaaaaaatttaagtaattatttattatttttatatcatttgattcattgttaaatatactttcatgtacacatatagttttacatttttcacaaatttttttaaataagacgaatggtcaaatatgtgctaaaaagtcaacggtgtcaacattttgaaacggagggagtatactcctaccccttcagattagaatactctatctctgcttgttaatttgggcaccactgcaagcatttgtttcttccttaggaatgagagaggaaccaggaagagggccgagacaagtaggttatcgcagtggtcactttgtagtgattggtctggtggtacacacacagctatgcattcgtctaggccatgtgagattcacaaactgtgattggagtactagctgctgataatatcgatttgcttatgataaccaaaaagcttaacaaattaatagaggagagtcaagggacgacacagagggggacgcatgcaccaggtggaggaccgtcaattagagatgcaatcgatgatggtgagtcgaagaagatgaaggaatagaagatttaagtctcagtgtactttactatatggagcagattataccatttctcataacatcagttagggagcaagttgaagaataatgtatcacccataatatagcaaccaacctaattcagctggagcaaagcgttaatctgaatgccataacaggaaccaagatggaaaaattatcatgctaaaacagactgagcatggtgacctaaatagggtagagatccccaggagactacggatgaaacatattctgtatttctgtggtcaactggtgctactgctcctggaactccgtaaagtcttctagtgcgagcagcctgcagccctgcctttatctgacggattgggccactgcctcctcgcgcgcatcataaaactccctaagtcccatggggttccgttttccctgcttttttctagaattttttccctctcctcttgatttactgacgtaccgttctaccagtggtagtttctgtttattttatggtcgtccgaacgaaggatgttggcaaatcgatgcctgcttgttgctgcgttctctgttggtgtcgtctaatgccgctgccaataatctcatcgtctgattcctttattaattgttcgtcttttcttgctcgtttttgtgttacttccttctgtttggtgtctttgatagctatctgcttgcgttgctggccggtgtttacagcgacacgcgttgtttgcatggattgactcatccaatttctttgcatatatacgtgccttatttccctacaatttgcttgttccttccaggctccaaaggctcatcattcagcgtctgttattattcctcttctttacacaccaggcaacattttcactgtggcctgcagaggccaccctcctcagcattttcgctttgtcaattgtactacttcaccttcgccatcaccatgatgctgcccaccacgtcaactgggcgcgctcaactcgccgtctcatcccgttcatgctcgtgcagggcccgtcctgcaaagttgaatcctcagttaaaccgacggctgctgaggtcgtcgtgggttggaagtgccggcacgcagatgatccatggtgttgtacacttcaacctgatggtgtggatcttggtgtatgactgggcaagaaggaggcatatgcatctcagcctgctctagcgcaccagggggttgggatggagctgtgtgtgtggtgatgatgctggtatccggtgttggatcggactagcaccgtcgccggctgccgggcatgaaggtggtgaggatatgttgtagtgcttctggctggtgactggtaaacttattattatttggcagtgttaaaaaactaagcctaattgtggcttcaatggaggccaatcatggttgaatggtgttagagtttgtgtcgaatatgtcggttacagtttaggacatagagttgtactaggtgttaggaatagagtaagcgtcggactctattctagcctatctcttaaataaaggggtagatatgttgcaaccgcatcgtgacttaccataggcgagagggagtggctgccgacgttcggctgaggctcgttgtaactctaatacattgtaataatgttggatgcctgaatcgatggagcacccataatcagtgccacaaggatataggcttcggttgaactttgttaacaaatatcattcatcggtgtcatcatcaaatttggctcttctatggcgtttctttcatgtttagtttccaattgtgatttgggggccggctttagaacaagttgtatgagagcttatgggaaatccatggtagaggtacgtgggaggtgctccacgctacaacgattacacaggatgtgaagggacgaatgtgcacgcaaggtggagcatggtggtgataaacgaaatttgatcggtggatataacatttcaggcggtggtttgaaccgttcgatggatgttttcaacaaggagatgaccagatgcagtgctcgggttgatggtggcagaagcaaattgcgatccaatagatggattcagacactttgggctggtgactcgaactttctagaaagctactttcaacaaggtgacatgaggccaaacactcgggcttggttgaagctggaggtgattgccattctcggtcggtggaatcaaacacaccggcgggggtgggtcgggccttttggcgagttgcattcaataaagagatggccaaacgtggcgctctggtcattcagcaactatgaaggcaacatggtgattcgtcggctttggctaacgactagattgataggtggtcaatctaagataggttggaacagatttgttgggtgacgaagtccgggcagcaggagcacgtcttggtgtggtcgacatgtaggtgtcagtgaagtttgacacgggtgggctccgacgaggaggcggtgggttccgacgacaaggttgacggtgggggccatcctcgatagagatggtggcagttcctaaaatatataggattcctagtcaaatttgcttattctcttgtatatttggattggatatcttccatatcctttctgttagttgaccgttaaattcttgtgtaaaagtccaatttgccctatggtatgaaaaccaaataaacttatagagtatggaaatttgttgtatgatacttttatatttatcattttataacgcaagatattatttgtgacaaagtttatttttagataggacataaaaataatatttatttttaatttttaaaatacatatatgtagcttattttgtgcatagtactaaaacatgttttctatataatataaatatatttatacgctacataaatattttttattaattaataaacctaaaatttactacctctattttttaatagatgacgccgttgactttttctcacatgtttgaccattcgtcttattcaaaaaatttacgtaattataatttattttgttatgagttgttttatcactcatagtactttaagtgtgatttatatcttatacatttgcataaaatttttgaataagatgaatggtcaaatatgtgagaaaaaatcaacggcgccatctattaaaaaaggaggtagtacaaaattccaagtcaaatttctttaggtttgaccaagtttaaaaatttagcaatatctaaaacaccaaattagtttcattaaatctaacattaatataatttgataatatgattgttttgtattgaaaatgttgctatagtttttataaatttggtcaaatttgaaaaggtttgaccgagaaaaaacttaaagctacttgtaatctgaaacggatggagtatgtaacaactgtgttcctagtcatctatcgcatacttagtgtatttatacactaactgacgcccttttaaataagatggtgaatgttatatccaaatcccatctaaacccttttatctcatgtaaataccatatttaagtaaatgtgcacctcctcttcacaatttggtgtgtgttcatataaaacacgtggaaaacttattcctttcccctacttatgctttgtagtagtatatatctttaaccgacttccaaatttatataaccagacacatgtacaaagctttgtagtagtatatatctttaactgacttccaaatttatataaccagacacatgtacaaatttctatatcttcgacatcatggaacactcggtttttttttgtcctttcctgtgttgtaaaaaatgatttacatttacatggatacaatttgttatgaataagaggcaccaggaaaattgtgtgtagatctggtgggacttggcgtgtcatgatggtatgaagtggaatgcttcagtggggagtcaagcctcccaaatcttcaaaacgtgcaagcttcgttggatatctcaagaagagactactacaacgatcagaaaatgaagattaagttgaacaaaatcatttgataccttcttttgttcggcagattcctattttgatcaaattattgcaatacccagaattatgtttcagctaggttgcttccttgcttgttcttgagctgggaactggtatcacaaagtcctactccattcgtataataatctaagatttttctagcattgctaatattcgtatagatgttaatgaattagacacattatgaaacggagggagtagcattgatttcttacctcacctacctgcctctcacttccttcagattgtctggcttttcactcgcgatttgtataggatcagtttgggatgtacacattaaaatcgagtagccttgaacgcttgtactaacttaatgcaaattggtacagactagagagataaaacaattctctcttaggttcatgtatatgctctatctccttccggcgggccgctataccagagtagtctacctttgcttgtttgtgcaccactggaactccttgaagcatatttgttttcttaggaatgaaaggaaccaggaagaatgccaagacaagatctctcagcagtgttctgattgtagtctttgatctggtggtacacacaactctgcattcgtctaggccatgtgagattcacaaacttgtgagttttgcgggtactagccactaaagctgaattgctgatgataccaaaacacatatatagcacagacacacaggtcttgggtgtacgtacttcactatatggagcagattataccattaatttctcatatcatatcatcagttagggagcaagttgaagataatgtatcgcacattatatagcagcggaccaaattaatacagccccaccaaagagttgatccgaattcgacaacaggaaccatttgagatctagagcatacacgctacttgctcgtgattgtgtctcgatgaatagaaattgactggagtatgcattgcaaaactcttttttcttaagataggcaggaggatttttactcaatactgttgaacaaaagcatattaatattggaaaggaacaaccatactagatatgattgaaaacaaataagctgatcactcttttggccgtatgaagaatcctgattgttttttcaatgtcggccaaatgttgaaagatggtatgaccgtatgagattaaaaaaaaaagccagttcaactagggcttcaattaagatggtatgagataaaaaaaggccaaatgtttacttcttccttacatgcttcgtcctaaaaaagtcagttcctagctatgaacatgtatatgggcatgtccaggtttaaagctagagattgtttttcttaggacggagggagtaagtgactaatataagagttatgttaccgtaggccaataactgaagcaagcaaaggctcacatctcgcccgaaatttcggtgttttgcaaatttttgtgaatttggtcaaattttattcaaattcattcaaaataagtcaaaatttcaaataatttcagccacaaaatttccgaaattttggtcctcccaggcaaaaatacaatttcaaaattgaaaaccctgctcacacatcacaaattctggcgcaacataatttatgttaacatgtttgggtttgtttcctcatgctacctcctttagcctatataaggactaatgtctaagcatacacttcatgtctgataggaatgtgaagtcactctattctcagttgttatattagtatagtgcatttctttacttggaataggtggtgtcgtggaaagaatatcatgatatggagtcgtatatgctgagcatgctgaccaaaataaggaagagatacctgtaagaatacggatggaacctgtactgtggtcgactggtgttgccgttcacatagctcttaaaagtctccctatgctatgtgctagcagcctacctccatctccatctcattgggctgctgcctcctcgcggatatgttgcaccgccattgcattactactttgtctatcgtacctacctctaacgtaagttcaaaggagataaatttacaactaactccatcaccacatatgcctctcacttccctctgatgacctatgttatagctctcgcagcaaagttcatttgagatgtcacactaggaataggatctagagcatgttgtcaatctcgccgtctgtggcgttgtctttttaggcattttctatttttcactgttcctcatcgggtagtttgtcgttcttttctttgttttgcttgtgggccagctggctagcagctacgtcgtgtgtaagactttaggtgtgtgagttcacgtcaaaatcgtggagtctgttgtggagtccgagtctcgcacggcacgatctgacgtgtgggatggcgcacgtcggtgcggatcgtgtcgcgtgcatgatggccactacggccgatttactagcgttgtttccaaataaaaggggatgaatataacccagaaaaactgctgaaggtgttgcagcgccaatgcacttgtcttcaagttcagaggcattgttgagtttttcagtttgggagttgaagagagattgaggacgccgggattctgttcgccggctaagagagcatacacattgctttgagaaaattctctgcgtacgtaccctttaaactttctctacgtaattcctaccatgtctctgaattttgctcattctcttgtatatctatgaattttagtttggatccttttcatacacttttcgttagctaatcgtgggtcgactgttgtattcctataaaaaaaaagtctattttgccctttggtacgaagaaacatataaaattatgaagtatagtattggaagatagaaatgtattatttgagactattatatctgtgagtttattatgcgaggtattatttatcataaaatttatttgtatatatgacataaaaattaatattagttatttagttatgaaaaatcatttgtgtagcgtatatctatatatagaaaacatgttgttctactaaccaataaataagctacgaacaaaatttttaataattagaagataaatattaatttttatttcatatttaaaaatattttttttcataaatactacctcgcattttacaaactcaataaagtctcatacaacaaatttctatactctataaatttatttattttccataccataggggtaaattagacttcttcataagagtttaataatggtcaactaatagaaaggttaggaagatatccaaactaaaatttgcggtttaaaagggaataagcaaaattcagaaatataaaaagattgggaaaatttttaggggtacacggggattttctccattggattctagtgattgtcttgttcaattgactagagtgtatacgtaaaactcttgactagatgttggaccggaatacggtccatggggatggcaaaactggtaacctttcttatttttttttggcagtgttatgccaattgtgatacactttcgttctaatggaaaaccaacataagatttgctccaaatcaccccaattgttgcttcagtcatgaagaggtaatctacactggaattgttagaaagaaaaaggaaagagatatcatccaatatcaaactagcatgatctacttaggtaggtaggtaaaaatgagttgttgtttgaagagaacatcatatttcaccttttcttttttttttgtgggggtatatttcaccttttcaacaatatttggataaaacgagggatttagaggatacacatgggaaagaaagaacaatatgggacgaaataggattccacctggtaatttgcgtcaaatgtgctagcgcgagcatgctatgcaccaactcatatgtggaatcacctttcgattggtcctagctaatttgcaattttgcatggcccaaccagaataattactgcatcctctgtcccagttctgtcatacgtcaaacactgaatcatattaaactatattaattttagaaattaatgattaatgaaacaaacctttgatttaggacaaaactgaataaccaataatttaaaacgaaggaagtaatatcttgaatgtgttgaccgggtgggtctaataagtgacctttctgttcttgttggattgtgtggtgcatctcattagttgggaatgggtggtgtcatgaagagaatatctttacgacaccgatcagcttgagcaccgactcttatcaaaagatggccgactcaaggtagagatggctgcaaaacccctctgctaactcttctatgccaatgtgcgattgttcgtctgttcggcatcaagatgaggacaacgcaagggtaacttaatttagttctctccctgaccgcattggtggctcaattgattataaacgctggaattgttggtgacccacataatttcccccctttccaatacattaattggagcctggttggtatatcaagtcacctaaaaaatgagttttcttatggtgatccatgtgttctaatcgtagtcgtacgtacatgatgatctcatcttgttttcacaacacactggtttaagatgttaccgaagccgctaatttgaagacaaagaaaacagaagcaatacaatgaacgaaattctttgccatgtaataaggggacggtgagaaatccccaccatgaatggaaaattcagtcatcaaagaattcagccatgaacgcaaaacaaaatgaaattcagcatatcctagttctcctctggtagcatatatcatatataaatactccatattgtctcccgagcctctatcctaggagtacattactccttgcctctccctctagctttcttcaccctgtttctccgttaatttgcacacttctgcattctaacaacacacaagctaagagaaacgagcaggtcgatcctaactgatgttacatagcagtaaccaaaacagtacttgccgtgacagcatcgtgtgtgttcttcacttaggaatgggtgtcatcacggaaatgacaagtatgggatagatggatatgaccatttcgatcatgttggttggacattgcacggttcgtgaacggtatcattctctgcgatttgtgccagtcaccaaaggtccagcattttcgcttataagcattggtagataattaagtcattactcttcggatgcttgtgtgtgtggctcgtgattagctttcaccgccgtcgaacggttggtcaccttggtgcggcgcgtgtgcgcggtaggtggttgcggctgcgatcctagagtgcggtcgtgtgcaggagcaagcctcgggcggggcgccatggccggctcggctgtgcagggacagtgtggttcggaggagaagggaggatgctgatcattctattttatgggaaacctatttttattaagttaaaggaaccagcaatatccctggacaccaacaattttacaacccaacacagttaactcgtgcgccaccctgttacattcgggacagaagctgacagagcacgacaagaaacaattggaagtgctcatcttggcggcacagttgtgaagggtgaaaaatttaaatgggctgaaagggaaaaaagctggtctggccaagagaggaaaaaaataggaataagtccacttttaatcccttaactttagaaaccgacacctatgacatctcctgtagtagtgcaccaatgtcattggcgccgatagcctatttgtaaatattttttgaaaaaaagacttatttgtaaaataatatttataaataggtcatcggtgccaatgttatttattgtgaggacctacatataaatatttcttattaaaaatagatcctttttttaaatggttcacttccccttcatataagtgatttagcttttatatagaggataggccggggaacgccaccaacgtctttgttggaccacggtgacggcgtcaatgtcgttggcgcgaaaaggatccattccaagaataaatttttgtaggggtctatttataaaatattttttaaaaaagatctaaaatgaaaaatccaggcatccttggcttatataagggccaatatcaatgcatacacacagtttctttcagataggaacatataatgaccgttttgttctcgttggtttaatttgtgtggtgcatcccattagttgggaatgggtggtgtcgtgaaaagaatatcgtcatgacactgatcagcttgagctccaatacagataaatagataaccgactcaagttagagatggctgcaaaactgcggctgaaaccaatgttttgtaactgactggtccagtttgactaccctgtatcgttaagtcaagattgaagcattggacgtttttaggaacctgtatccaggcatcacttgatccgtggaggaatcagcaatttgtgattaggttgttccagctaaatttgagtgaaacatcaaacatacatggattggttcttcagttgagcgcactatttgcaatttttgtttcaaatatcggaactatgagcaatttgcaatttacaatttgagggcagtttggcaattttggtatcccctcccccgcacttgaaactatttagcccgaaattttcaaggctttcagttttttatgaatttggtcaaaagtttattcaaattcggctaaaatttgttcaaataataaaaattttcagctaaccccaacacaaaagttcaaaacaaattaatttgcaaaccctggttgagggcaccacgacaagaaccaaaaaacgccatatactgaagacagtttgttccaaggtacaaccatgtaattaatgtgaacggctcacaatctctatattaagtttgtgaatggtatagcataacatttagatttatcagaggggtaaaactgcacaatctaaaaataattcttggagcccaggaaccttttgataccgcagagcataaaattctaatttaatttccatatcaattattgctagatactttttttagagaataggtattacacccaacaggatatatgcgctcatatgacttcgcgcccaatttaaaattcgttcttatggggatttgaactcaaaaacttaggttgctactaaggtcactgtaaccactttcaccgctagatagtagtggatagatagctaatatttttcatcggacctaacgacttgtcgtcaacccataataaaatatttcaaaagaaaatttttgaaatattggattcactggtatgtcccgatattcagttgctctggtcaaatattttttgtcaaactagttcaaaacggtaaaaaaaattccccaatctcatctcgatctcccctgttaactctagtatgccaatgtgctaccgtagttcttctcttccgcatcaaaatgaggacaacgcaggggatcattagctctctcccaatccacagtggccggactatccggcgatcccgagatagctccttcccaaaccagaaacctctagtgtcgatgtggttttggtggttcaattgattaactaaacgccggaatttcacaaattgttttgatgaccgcaaatgagttttcttcccatggtgatccaagtgttctaatcgtagtcgtacgtacatgatgatcttgctttcactacacagtggtttaagatcttaccaaaggcgctcatttgaagacaaagaaaagagaagcaaaacaatgaacgaaaaataatctttgccatgtaataacgggccggtgagaaatccccaccatgagtggaaaatccagtagttatcaaagaattcagccatgaatgcgaaccaaatgaaattcagctgatcctagcgcagttgtcctttggtagaattcaaggccctatatgcacgaactcacatcatatatactccatattgattcccgagcctccgatccgttcttgtattctacttgcagtagattactttgcctctccctctagctttcttcatcctgtctccccgttaatttgcatacttaattagcagtaatcaaaacagtacttgatgtgacagcatcgtgtgttcttcgctgaggaatgggtgtcatcacggaaagggcaagtacgagattgttgattttgaccactttgatcatgttggctggacattgcatgtgaacagtatggttctctgcgatttgtgccagtgacgaaaggtcccagcgccttcgcttagcattggtagatgtcattagtcttcggatagatgcatgtgtgtgtggcttgtgattacactggtagagaaactgtctttactcccggtttgtaattccctatagtcccgggtttttaaccgagactatgaattcgggactaaacatcgttatctttagtcccgggtgaaataatcgggagtaaagatctatctttagtcccggttggtgttggtacccttttcttttttttgttacttttttattttctcccgaatcggatggcatgcacatcccaaatcaaaccccaaatccccaaataaagtaacatcccaaatctgcatcacaaatcttaaagttacttatacacacaaatctaaaatatcgcaaatcctaaaaaatttacacacaaatcaaatacatcacagattatacatctcaaatccatacaatgaatcacaaaattacatcttagtgaatcaaaaaatataaaaaaaaagagacaacaagtaactttaggggagggaggacgtttgcgcgcatgtgctcaccctgcaacgcacgtctgcgccgcacgccgcgtgtccgtccgtccaccgcgtccgcgcggcgcggcctcatccgtctccagggagggaggaggaagggaaggggctgggaaggaaggaggagcggcctcatccgtctccaggggagggaggaggaagggaagggggaaggaaggaggaaggggaggatctgtgtaagataggagagggaaggagggggagaagagaggatgatcgatctgtgtgtgtgagaaagtggttgtgattgtggagtagaggataaggactagggattatatactatgttgaattttagtcccagttggtaataaaccgaaactaaaatggtaatctttagtcccgttggtagtatcaaccgggactaaagattctcggctccctcacatgcctctgacaggggatgaaccgggactaaaaatcatctttagtcccggttggtgtgtaaagattaaattttttttaaccagatcccggtttttaatggaaccgggactattgtggaatttgatcgactgaccaaagatggtttctctacctgtgttagctttcaccactgtggatcgtggtagctaggtagttgcagctgcgagcgtagcatgcggtcgtgtgcagcatggcaagcctcggcggccggggcgccatggtgatcggcccggctgtgctggaacggtgtggttcggaggaggagatcagggaggtggctgatcatatttttctggggaatcttttttttttaatttaaggaaccagcaatatcactggacaccaactatttcacagcaggcggcgtgctgttccaactactctcttccattaaaaaatgaatctaggattacgtgtgacatattctattactattaatctaaacctgaaagatatatgtctaaattcgtaatactaaaatattttgcatttgatagtaagttggtattttatagtacggagggagtagaaccgatctagagcttacaaaccaacgcagttaactcgtgcgccacccgttacatttgggacaaaagctgacagagatcgacaagaaacaattggaggtgctgaacttggctgcacagtagtgaagggtgaaaagttgaaatgggccgagagagagaaaggctggtccggcgtgttcgtttcaggaggatgggaactaatccctcccatatgaaaaacagagtggtccattagctatttttttataaacatggattaatatgatttttaagaaactttcgtatagaaactttttacaaaagacgtaccgtttagccgtttgaaaaacatgcacatggagaacgagagggggagttggtaaccactgaaaacgaacgtagcctaagagaggaaaaaaaaaggaaaaagtacacccaaggtatcttaacttgtcatcgatttaaaaaatcgttcccaaactgcagaagcatatatatgatatccttctacttataaaacttttcactttaggttcttcggttattttaaccccgttttatccgatgtggtgactgagttagcttaggacccacatataccccacatgccaggatgccatgtcatcaccctctcccttcctcttcctttcccttcctcctctccctctcacttctttgcgcaggctggccagcgggtggggaggaggtcggtggccatcaggaagatgaaatagaaagagcaaatcaaagaaacgagaaaaaggaagagcagcccgcaggctgtcctggccgccgacaagcagcacgccacgccatctcaggcgccgcgctgcgctgccattgcacacggtcgctgccgggtagcccatgccgtaaccgccaccctagacttgcatggccatgctgatgccgccctcctccgtcggaaaatgccgtacgttgcacagccactccaccccgcgccagggtcgccgcaccggctgcaagcgctgatctggcaactccgttggagggaaagaacaaaaaaagaataggagaggaagaagaaaaagaaaaaaaaaaggagcagcaccggatggccgcgccgctggacgagccgccgtcttccaccatgccgttgtgcacccacggcaccgggttcccctccttgctgtgacaaccgtgggccgctcgtcctgcgcctcgcatgcgctggagaagctgcgcctgtcccttgtccaacattgccgccaccatcgccgccgcatcgcccgtcgtcggccgctgacttcctcctcctctccggcctcaccacgccggcttcctccccacctgtcgaccagcctgcgcagagaagtgagagagagagaaagaggaggaggaagggaaaggagggcaaagagagagggtgatgatgtggcatgctgacatgtggggccatgctgactcagccgccatgtcggataaaactgggttcaaaaccaccgaaggatctaaaatgaacggttttgtaagttgagggatgtcatatatctgattttgctgatggggacgattttgtaactcgatgactagtagagagaccttgggattatttttccaaaaacaaaaaaataaataaggagtggtttcgggcggagaaaagcttggaccaattgaacattgccatatcatagtttttaaggatttatgttaggaaaaggtgttcgaagggaaagggaacgggtctgaatttgatacatctgatttttggatggagctttgcatgcaatgtatggatgagttaatatttttgttggcaccagaatcaaaatgtatgttcaatatccaaaatctgaatttgaagtctcattcaactgtgcttttagcaacggtgtttgatagcaataattcagccatcattgaccctgtgacattaatttgatactgcgcaaagcatgtgcatcccctggtcatgcagtaagttcatgtaacaacaggtggttgtggacaccttccagttttgaactatactgccaagtgcatcacccttcaatttataaaggggtaaatgtaggtacctaaaacctatgtggacgatttattcgtacgtggatgatttgttgtgaacgatgaaccatcatatggtggatgcacacctcttatttagaacctggtgtgttgtcctacaaaatttgttgatacagtaatcttacaattgagggcattacatattttagctcgcatcttattctagtctagtttattataatctagcttacagtaatttggcacaataatctagattatgataatcttaattataagctgaaacaagcatgcctaacactccgagttttctcattgcaagctaccaaggtaatagggatatgaacgtttggtgtagtttcctcatcctgcctatataagaacaaatatcgttggcatatatatgctttgctgtgaaatagaatatgcagccactctattctcccttatttttgtggtgcatcgatctctttgcagcttgggattgggtggtttcatggaaagaatatggtggagatattgtactaactgagcaaggatgattttatacttgcctcgttcaagtagagatgggtgtcaaacttcggctggaacctctactgcgcagtataccggtgttgctccctgatgagttctggaaaatcaccttgttctgcctccttgatctcacttagtacccgcgtgcacacgcactcgctgcatcaccattatgttgtcttccgtatcgtagtatgcgttcatctgatcatcaagctaccactgccaagacatcgtgttgaacagtagatccttttacgaatatgtggcagccttgtcgccatggatcacataattcatggatggaagaacaattacttatgtttatatttgagccaaattaatttggatgtgtacatggatcatacttcgtttagggattgagggtagaaatacagccaaatattgtgtatgaggatgttttgcatagaagtgccatactaaggctgtgttcgcatgttcttgatgggaactcattccctccgcacgcaaaaacggagcgatccattagttcatgattaattaagtattagctaatttatttttcaaaaataaattattttgattctttaagcaactttcgtatagaaactttttgcaaaaacataccgtttagcagtttgaaaagtgtgcaagcggaaaacaaggagacgagttgggaacaaggggtgccgaagcaacttggcaaggcactacagtatgtgtgcagggaagttgcaagcacaatacaaagattacacactaaggttgtgttcggtacacccttttcccaatccctctccctcgttttccacgtacatatttttcaaactgttaaacggcgcattttttgtaaaaagtttctatacaaaagttgcttaaaaaattcaaattgatccatttttgaaaaaaaaaagctaatacttaattaatcacgtgctaatagatcgctctgttttctgtgcgtactattcccggttgaacggagcctaagtcagtaagagcaggtaatttgtactgaactccatcagcaagctctggtattaacatgctctgaacatatattaatgacggaggtcagtggcatatccctaatctaaataaaataaataaaaaaagcatatttccacatcactatgccgtatcaggtcatctcagatggacactaaccctcaccttcgatggatttcccccggtcaaggattaggggtcactggtgactctagtcacttttgacgggccagtattttaatttcccgtcacaggtgagcgtctccacatgcccatgtttggttgcaacccgtcacagtgagatacctaagacgggtgcaaagtttgtacctgtcggatgactcacctttgatggattgaagtaacaaggccgtcacagatgagctcacatgtgacggtctttgtttacgacccttcagttatgaggtattttcgaaaaacaacaatttctaaatattgactagactcatgatttgctagccacactctctgaaaaaagaaacatcacatatatcctagccatacccaatatcacatattctccattttagcacagatgcatcccaaaattaacatcatgcacacatgcattccaaatttttacataaattacatagacagtcacatattcccacctcacatttcttttgaacctgtgaagacacaaacttgcccaatttcttgccgcaaacttacccaagttacttatagcctttgccttttgaaaaataacgacaaccaaccatttcaaaaaagttagaaaacaattgaacaatacaatgtagtaaataataagtacatgtaagacgtagtaatcaattttgatggtaagttgttcaaagtttaatgacaattgaacctaagtcatttctaaacaacctacgtctacaaatctctaaacaacctaaatcaaaatatttctaaacttcctaaatcaaaataattctaaacaacctaaataatttataataaacaacttaagtcacaaactttctaaacaacctaagtcataaaacttctaaacaacctaaatcaaactatttctaaacatttgtgactcaaaatcattctaaacaatgcaaattatttatagacaacctaaatcacaaaaaatgggaacaatctaaatttaaaagaaagagaaacatgcgaggggtgggggagctgaggaggtggcgactggtgtgggggaggcggcagccgttgtggaaacagaggaggcagtggttggctgtcttccaggtgggcgtgaaggcagccggtgtcgagggcagcgtgaaggcggcggctgttgtggaggcagaggaggtggaggcaggtggtcttcgaggagagtgggaggccggaggcggttgatgatcgacgtcagggaggcatcacttggcggtgtaggaagacagtgcggtggaggctgtcaatggaagccggcagtcaagggcggggaggtggagcccggtgtcatggatatggagaggtcgagggcagggaggtgctgctcggtggaatttgatgatggcgggaggacaacggttgacgtcgagaaagcaagggaggtgcttggcatggagtaggtggctattgacgagtgttgagtgagtgagtgagtgagagatctggatctgagagggatgggaaacggtccaaccctacttatcccggtcaaagtcacctgtgacggacgggagtgttggcgccatcacaagtgacatcacctatgatgggccctgctcaccggcctgtcataggtattgtcatatgtgatcagccggaaagtagggcatgtcacaggtgaggtcacctgtgacggcgccattactctcacccgtcacaggtaactttgaccagtcttattttcaagttattttgatttttgtttacctatttcaacataattgctctaacattttttttaactatttatttatttatttatttattgtaaccagtaatataatatttttttatttatttcaaaggcaatatttcatttctcttaagtatttcaaaaattttcaaacttatctcaaaatattatagctctccagtccatttccaagataacacatatactacacaaaattaggcatatgatcaaattgggcctatgtttcaaaaatagtccttcctcatggtcgacacatgcatgttagaccgcatcttcttcctactcctcttgtagaggtatttctagacccacactgtggatatgctagttatagctccagtatttgctccatttggccgtagtacttatcgcgacacccacgtacgtcgctacttgcgtctatgcgtactgcactgttctacactgtgcatttgctgtcttgcttgaccgtataataggtgtaccattgccaggtgggagcatcccatcctagatcatgtgacaaccacttgagtggagtactttaggtgcactttgtaaatacatattgataaaataaagttgatgtactttcaagagttttgtcgatacgcgtttttagggatcccaacggtttgaccggagttcattgggcggtctaaccagcgacagctagaaggcagtacagggaggcagtggttcaaccatccagacaccggtcgggcaggcggtgaagttgcggtcaggctggtgtgtacacgacagtcagaccagctacgccaagggcttcattaggttggagggtaaatttttagctctgtaaaaagtttttgtttttcgtgttgctactattcaccccctcttgtacgtttggttattgtattcgattctacaacctattaattggttgacaatattttctatttaattatattttgaggtatgagagcacatatgcttgagttgtaaggacggaactccacataccaatgttaacattaattaatacacactggaggtatatagttgtattcgaaggcgcaataaagtggaatgaattgcattacaccataggagaagagaaaattcagtcataataaagaaacactcctgccctctgccacaattcaacaccccatgcgtgctttctcttggaatacgacttctcttatcacagtccaattccacgcacatcccttaatggaagcatacaccctaagttgggattgggtggtgtcatggaaagaatatcatggggatattgcactaagtgagcagggatgcttgaaacctctactgggtggtataccggtgttatttcctaattaaatctggaaaatcaccttgtgctgcctctgtgatctcacttagtagccgcctccacgcgctatcgctgcactacaactgcattgatttcttgatggagtagcaaacattcatttgatcatcaagctagattgctagaagcaattaaccactgccgagacacctgtctgtccgtgttgaacagtactggatttattttattttttacaaactataaaaataaccgtgtgttgcaatgggtgaatgttattttaatcttattattgttattatacgatttagctaaggtgaaattcattgtgggaattcacttggatatatatattttttagaaaatcatgaacttcaattagaagtccgatagtgtcaagttagcatgcgagtttttttaaagggatttcttgtacaactccttttgtatatccgaaagcgaacaaacttaaaaatcgattcatacatggataacgtatcaaagtaatcggtaaaaacatcttcaatttttataatagtagagatatgtggcagccttgtcggcatggatcacatgattcatggataaaagaacaatttcttatgcttttctttgtgccaacgaggaggagaggcggcggctcgactcctccctctcccggcgatgcgtgacgacgacagctccacctgtgggaagccagcggatggaggaggagaggcggcgacgcgcgacgacggcgccgacacgatgatgacgacgcctgcggggaagccggcggacggagcagaggcggcgatgcgcgatgatgataccagcggctgtggcagtggccagcggatgaaggtggagagccgtcgaccggaggggaggccggcggcggcaccctttttttttattcgctgtgattttttcacaggcgagtgaatctaccagctgtgaaaatggagatgtcgcctgcaaaaattattttcgcaagcaggccggcggtccttacacccgcctggaaaaactatttttgactgtgcaaaaacattttttctattagtgtctaacgtgcttcctgtgcaagcactgtgtagcaattatagaatagtacgaattgcgcgtaaagggcctttcacatctcaaaagctaaccaattaggtgaagaggtctcccacttacatataatattccttacccttccacaaccaatgtggggctatttaatagaaatgggtgccatcaaggacaagataagcacaggcttcactggttcaccccagagcgtccatttccattttgttggctggatttagtacatatacatgttttctcaaaggtattattctctgggatttgtgcctgggaataacaaaatgagaatataagtttaccattgaacgatgccatcaatcttcagacttgtgccttggaattagatttcataatgatcttttctagaatcggtatttgaatatatttgtttgttccataagaaaaaaatacaaatcatagtgtacaggtccaaatttggaatggccaattcaggaaacaaaggcagtacctgtcttccgtactatttttgttgttaatattgacatcgcttagacgctacccacattaatgtgatttaatatatacgagatttaccagcttcttcacatttccaactaataaaaatttgattcggttgatatcgacacactactggagaaattctgagaccccgaatctgggactaaagatggtagcgccacgtgactgacgctaccatatttaattccggttagtattatcaaccgggactaaagggttttttttttgttttttttgctggcttgcatattgatttccccaaataaaatattcacatataaaatcatggattcacatcacaaattctcaaaaaacaaatacattacagatcacagattcacataccatcatcaattcatccaatccaagaacatattaatcataaacatcacccatgagatctcatgaacgcaatcatgaaaaaaaaaatcaaaatccatgaacacaattgcctcgtgaacacaatcgcctcatgaatacaatcacaaatccatgagcagcagcatctgctccgccaccactacagccggccgccccctttgcctcatcctctccacgctctccgccactcctcctcttcttcttcttcttcttcttcttctccccaccgcgagccaccatctgcttgatgtggctgctagtacctgccgtggcccggatccagccggatccacctgcgaccgccaccggagacgctgtcaccgccgccaaatccaccgcaagagggaggtgagtcggacaggagggggcgagcgccgtcagcaagggaggcgga

SEQ ID NO: 13806 - DNA, 16564 bp, Oryza sativa
agtcacttgcgagggaggtggagggagcacacagggagaggagataaggaggtagggggagggcgggagcgagagagagggagggagtttcgcttgtgcgtgcaaggagataaggacgagggagggggtggcgtgcggctgtcagttttcttttcaatcttttgtcccatttggtacaaacaaccgggactaaagtattgatctttagttttcttttcaatctttcttctcggttggtataaacaactgggactaaagtgttgactaaccaggactaaaaataatgggacctgacacggcctgacaaattttcaaaccgagactaaaaatgatgtttagttccggttgttaacaccaactaagactaaagatcaaaaagtttcgttggctttttaaccagagctaaaaatgatgtttagtctatttttctattcgaaccgggactatttgcaccacccagcaaagatcagtagtgatatgagaacagatagcacagtacgaagttctacttcagtggttgatacgagcagagtgatttaatctggtgtaataaaccaatacgaacaagattatagcgtcctaaaagttacagccaatcatgaaccaatctaacttacgcgcgccctgttaagatcccacccaaaaatttttcaccatgtcatatcgaacgtttaaacacatgcataaagtattaaatataggctaacacaataactaattacacagattacaactaatttgcgagacgaatcttttaagcctaattgctctatgatttgacaatatggtgctacagtaaacatttgctaatgacggattaattagacttaataattcgtctcgcggtttactaacggattctgtaattaagttttttattagtatccaaacaccccatatgacaccctatataatacccgatgtgacacgctaaaactttagaccctgatttaaacatccccttaattgtcttgaacaatagatacacatagctgtccccactgacagccagcttgcttatcaccctgctattagcttttcactctgctattaagtctctgtaactatttataacacaatgtatctatatgttttgtcattgttacatatatagagagagagatttgacacgcacagttcaaaggggaagatcagctgagtaatacaaacagtgatcgttgtacactcttctcatgcctgaccttgttaaacctaggtttgtcttgcgagtttagttttacatggaaatgggtggtgtcatgggaagaacgtacaacgcttgcaccatttgcagtggggttgttattcacttattccctcaagcaaaaggttgaagcgatgatggttaagggtaaccgggactaatgcttttgctgccaattacttgggttagcagcaagtttgacagatctatatatattaatggcgttatctgggcatgtatgctgaggtgagactatgcgaattgctgcactaaagagtatcacggtgatcatcaggcatgggagtatactgtatgctcaactagctagtagctggcaagctggttgcataggcacgttcagcaaaactaataacatatttatgtcctgctaatgatgtatcaaattcgattacttatgttttctattgaaatatttatattgtgttatgactcttttttttacatgggtatgttgttggttcttattctgaacagtagatcaaattgtatggaacacaaacagttttagtaaatcttgttactctgtacactaaatgaggaaacaatatgggaagttcactttgtaaatctagagaaaaaaagtagtagcatggattataatgtcattcccctctacggacatgcatttctcaattcaatccatagatctcagaattaaaatacattatgggctcttttaatttagtgccaaatcttacactaccaaattgttggtagtctaaatactacttatgtgttgtttggattgattccagaacttcctaaatcaatagaaatatctaccaaagtgttggtagtaccaaattttcattaaatgtgttatccatatttttctatagggtatattatcaccttcatttagatttcactgttttttaatatgataaaattgaagggctaacctgcaaaatttaccattaggtaggtagtggaattggagattcactgcaaccatcgtaaccttctctcttcgaggctgtgtttagttcagtgtaaagtttggattttggttaaaattagagatgatgtgactgaaaaattgtgtgtgtatgacaggttgatgtgatggaaaatgactgaagtttggatccaaattttggatctaaacacagcccaacttttgtcattattttccatagttttatataattatttcattgtattgagcaacgagaggtacacaagagcacatacttattttgttattgttttttcagagtttttagaattgaactccacttactatatatatattattggtcttaattaatacatactggagatcgatattattgaagtcaccaataatgttaacaaatacaataaaatgaaatgaattgcattaccacgtggcagaaggaaaaattcagtcgtcttaataaagaatcactcctgccctctgcttgcttttctgtagaaataatacgacttctcttaccacggccgaattgcatgcattttgcatcaattaatgggcttattatacatcacaaggtatgtaactggcacatagatgtaggagtatatatgttaatagaaccaagacccccattgtgtagtgattgtcaaactctagaacaaaagcatattgatattggaatgtatatctccatagggaattaatggtcaaatcagataacctgatcattctttcggaaatgtgaagaacaaaaaacttaattgtagcttcaatggagtccaattgtggtaggattgtttggaaattaattaaaaagtcacaaccattttcagactagttcaatatttagtgctacagaaaaatggtcgtaatatttgctacaaataattccaattggagtacttttacatgggtatctgccggtagttatcgttctacccatattatcactactatggtaaccgttcatttgtgagttatattaccagtagaagaaatattctactacgagtagttcatcacttttaggaaacgaataattacttatttgaccctatttcgaaggctaactaccaatcggatcttatttttttctaggttgctgatttaaccctgcttttcacaattgaacctaccgtttgactatatttgcaatatactgatagggtttcatttaggaaaaagaaaataaatctatttattattcaaactaaccaaaataccctccttcaatcttatccatctcgtaccaccctgcctgacccttatcgctctctcgtctctctcggcatgaacggtagagccagcgccggtgcgtagagggagggggtggcgttggctccgacatgctgagggaggagggggcggtggtgctagcgcaggcgggtggatggatggaggcagcggctccgcaggcacacagagggagagagcggcggtggcacggagggacgagtaggacgagcgtggggagaagattatggtggtgttgttctcggcttcctcttctaatttgttggctatgctttctcaccaccacaagagcaaaatcagtgtaccaaacttgtgtcaaaattggtgcactccgccaaatttttcaatatgattcaaatttatcaaattgaagccaaatctatcaaacttgtgtcaaatgtgaaagatatgtcaaattcgttacaattatgtcaaaaggttggaatatatggatgtttttatataatatggttaaataagcaagggcaaaaggactacttgccccttggttaacaatgttaactcgttttaacggaataaggtcagctttcatctttaatttcaaaaagtggagtcaaataagtaaattaaaaaaagtagggtcagattgatacttagcatacgaaacaaggtcaaatgagtcatcaacaccttttacgaaattattgataagaatgtgcttgaaaaatcatctaatttcgggacttacatgcacaaggtaatctgcttaagatttaggaaggcataaatcagaggatttgatcaaggactggttattgcacattgtttgtgactttgtgtctgtggatgactcgaagatttggagtagagaggggaaactacttgggagtaaaaaccaatatgaaaggaaatagaactacatttatattccaccaatccattgtactctgttttagttattccttgacatgacaaaataaagaactctctctaatccgactgaagccaataagtctcagacaccatgcattattgtcctctatactttcagttaaacatgttttgggtggttttcctgtcccaccctcttcagtctatataaggacaaataacgatatatagcatacacttgttggttgactggagtacataaccactcttctcccactagtttgtatggtacagattttaaatttatgtatgggaatcggtggtgtcatggaaggtactcctatataccgatgatattactcggatcaagcttagacgcttgatggtagagatggctctcaagccgcggctgcaacaagacatgagtaccaaagtctctgggggagaagagttagacaaatctagtaattcgtgttgacttgtgctgctacgaatagatatccggagaacaaccccgtgttacctccacctcttattgagctgcaatgcttggtacgaccatcccatcgcctctcataccacgcatccatctgataatcaatattatgtcactgtcgagacgacaatctgtagcagcccgctaccttgcatctcatgatttaatgagaaaaaatcaacagatttgctatatttatatcgccatcaaatccagcctctatattcatggagaatatacagagccaaaacacacacgaattgttaggccctgaacccccctgcacagaagaggaaaaaaaaaagaaaagctaccggaagactgagcttcagtgtcatcaaagatgacataatctttcacggaagacttggttggacgtatccaacatatagggtagatggcctacagatgtcgataactacacggctgctttcgttactgggagatttgagagagaaaacaccttgttttccgcatgtatgtttcctgaactacttaaaaaaatcatattaatctgttttaaaatttaaagtagttaatactcaattaatcatacgctaattgcatatctcgttttacgtatcttctcaattccctcttttcctctcctctaactcagccttagcataagacatggaaagaaaaaataaacatgagatcgatggcattgtttttcatgcctcgatgaataatgttttctttttaagtagtactacttgttagtttttataaaaaaatcaatttcactcactgaaacttatggatgtgtacagctcaactcatacaatttgtaacataaacctgcaaatactctttaatgaagctttctttcaactttggtcgttccacctttatccattcagtttttttgtgcgttgaatttgactagttgaattgatattaaagcatgcgcagcttcggctggattgacctttggctggtcgagtaatgtgtggtgtaaccaaatcaatccaattcttgcacaagctgcttgtagtcatcaaaattcacaaagtaagatatcatgagcaacaattgtttaagcaccccatgtagcctagtgatttcagtgatttgtatagcacctcaaggtcataagtttaaatctccatatgagcgaatttcaaattaggttgtttgagagactaagttcctaacttaaatggctgcaaatatccggttcgataaagaggccgtgtaaaaaatatacttatctaaaaaacaattgtttaaggccctgttcagatcccctgtaaaattttacgccctgtcacatcgaatatttcgacacatgtatggagtattaaatatagacgaaaaaataactgactgcacagattacgtttaaattgtgagatgaatcttttaagcctaattgtgcaatgatttgacaacgtgatgctacagtaaatatttgctaatgatagatttttaggcttattaataaattcatctcatggtttacagacggattctgtaatttgtgttgttatagactatatttaatacttcaaatgtgtgtccatatatccgatgtgatgcatcaaaactttacaccccccagatctaaacacagccttagcaaacaactagtagggtatccctgtctacatagttgtccttgaactcaggaaattggacacttctcagtctccatgtcatccactcatgcccatgcatgttcaggattctacttgcttgaatttactacatccatccctcctaaattagatgtcgttttaacttgttgcttataatgtttaaccattcgtctaatttaaaaaattagtgcaaatataaaaaaagataagtcatgcttaaaatacttttgataataaagcaagtgaaaaaaaaataaataataatttcataatcttttgaatgagtcgaatggtcaaacattgcaataaaaacttaatacgatgagtattttcggacggcgatagtatgtctcgttgggtcaaccactctcttaagacgtcaactcaggccacgacgtgatactctgtgttgtagtaacttatggctcgctatcctgatcactttcaactagcctattctcaatagcttcttttccaataccttccattctcaacataaaatcttcttgcttacaatatccattaatgttacagaactcgaaaagaatgccaaagaaatagcttgaatgtgttgcttcatttgcatcttgttcagggataaacaagaaaaagaagaggggaaggcagcccgaggtatcaaataggattggccccggccgcctcgctccaccacaaccacagctcaagggatggccgtctctgctcgttggctataggttcggctcagctcttatcaggggcggacgttaccattgggtggcatggggcgacccgtgtatgatcgaataacaagaactaagccaaccaaaggggggtgaatggttggtatacccaaaaaccaaaaacttttagcggaaataaaagttaccctcgaaatcgatggatcgcggtatgaccgaagtagttgtaccggtctaagcgcctggaacacgccggtctgaccgagatcgaactccagtcgaaccgccgagatcacctgccgctgcctgcctgcgccgccggtctgaccgccctagcgccgccggtctgaccgccagtatatcgccggttagaccgccaaaaccctgtgaaacacaaatcgaagaacaatcaaagtagatgacaactttattgcttctctctgtgtttacaaagtgcaccaacagcactccttacaaaaatcttgactaaactcgaaaccctaactaaactagctctcaaaagctatacaaaagcgataccgggaagcctcacgctccccctctatttatacatgaggtaggcagcctaaagccacgaaccaaactcatactaagagtcctaaacaccttagaaaaccctctagtacaagaaagaaactttatataaccaatcgtaccaaatttagactccttccaaatttaactccgcatcccatacgcactcaatacctccatcgtatgtcatatggaatcttcaccaaccacgtgcatcaactctagccttagtatcccgcatgatatctgaccaccacggacatcgtcttaccaccaagccgactcccggtccatcaccgtaaatactctcccgaggcatcgagtcacctacacataaaacaaacaaagaaaccatattccgagaccaagctatctccaacttgactcattgttagcaaataacagtattacatacgtatcgtatccatctagaagccataaccatgaaacaatcatggatatccaaagtaacaacccgaaactgaaactgacacagcgacgggcggtcagaccgcagactggccggtctgaccgctcacatagctccggtctgagcggcaaccaccgtccggtcggaccggaccacataaaataatagcacctgtaaatccaatcatccaaaaccacttcgacgataatctccaaataacaaaaccaataatcacatatgccaattgttcatcacagaataagaatcaaaacacacgttgatcttacaaccggcacagctacggcccacgtcaccctacctcccttgggacgtctaccaccgcataagaggaaagcccaagtgtccaatctagaattttgaggaaatcacggaatcaccggttcgccttctcttcttgctaccccatactcgcaagcacgacgcttcgtctccgtctcttatctctctcactatgatgctcactctttgttgagtggctgatcaactaggagtggattttaactctcgaggggatatcccctcgttgtttgtaagttattcaaatagttataaaaaattgagaagatgtattaacatgtgatatatcacttcgtaaagatacaagttaaaattcaacttttacacgtcacaacgaaaaaaacaaatttgaccgtgaatataagttacactactacagtaatgattattctgaataagacattctttaggttacatacaaatcatgactggttacctctgcaaaaatcaacttccgtttttgcatacggctccttaaaagcaccacacgcaaaaatcgattttcacaagtgggcctctgatggttccacatgtaggatcgaatcacaagaactaggccaaccagaggggggtgaatggttgatatacccaaaaaccaaaaacttttagcggaaataaaagttatcctcgaattcgacggatcacggtctgaccgaagttacactgccggtctgaccgcctggttgtcgtcggtctgaccgagattcaatctccggtctaaccaccgagatcaactgccacttgctgtcgccaccgccggtctgaccgcccgtatgccgccggtctgaccgccgcttgtcgccggtcggacggccgttgagtcgccggttagaccgccgaaacccggtgaaacacaaatcgaagaactcttaaagtagatgacaactttattgcttccttaaaagaaagaaattcccaattgaaccaaaaacaaagaaagaaattcccaattgaaccaaaaacatgcacttcttagaaactcttctcttctcccaaaacacatctcttctccccaaaactcatctcttctcccccttttgccaatgatttcatcaagcatagaaattatgtttattaaagtataagagcttaacatacatatagcatatcatgtcatgtgttgcaataaaaagaagatgaatccatctataatataacaagcatttattaaagtataaccatgaaccaaagattttacaattaagcttgaatcaacaatcaaaaatcatgatttcatacgatttataatgcaacatcttaacaagcacataggttgaagaataaacactaacacatatacctattgcatttatcattctttctcaaataacctttagcacaaaataacaaagagaatttgactttttctttttcttgagcctttttctcatatttttctcttttattccgggtacgtcgctgtcgtcaagactgtttgcagagattcagcacccattattttgctcacatcgaatacgtccttgtcgtcaagactgtttcgaaggattcggtattcatttttttttcatatttctattctctttttcacaatgaacaattaaagctatttgaggaataacaagtcaataaagcatatatataaagcatttatgaatcaaaccatatgctagcatcaacattgcatatttacttaattcaaatagaatttaagtgtcatgtatcatctcccttaaaagcaaaatctaaatatcatgaaaagactagaatacatacaagctatgctagagacaaataaaccttcaaaatattgctagcatgcacaggaaaataccatatgcataaacaaagctctcttttatcaattttttccattgtcatatttttgcttgataaaaccatgaggtacaaactccccctaaaatcatgctaaaagaaagtcataaaaagcactaactccccctcaaaataacctccaattctccccgaacaaagaatcaagaagaaatcaaagattttgaaaaagacatccaattgccaacgatatcaccaaaattctcaagaattgacatatatccaatagtataaaccaaaactacaacctcaaatagtagcatataaaaaagctaataaacaagagagtagaccaaaattatgtcaatccaaaagtaagtgatgttaccttgctatacaattgtcatctcaaagttaaacgcacatggggagtatgccgccaaaatacctacgaacgagaagatgtcgaggcctccgtgttagggttagaaataagaaattttggaatccaacactgagtcacacgaccagtagaaccagtaggtacatatgcactaataaaattagaatcagacttaccaaaaaaacttacctttttgcttcacaaaagtccgatttgaatttcgcgcaaaattaccctgaggccggtctgaccgccactgtccctgtggtctgaccgggcctggcaaccggtctgaccgccggtcggtctgaccgctggccgatctgaccgactggtcagtgtcggtctaaccgtgttcctcgaattaaaacccgatttttgccaacgtcattttgcaacagcaatttctctttcctttttctttttatggccaagtctaaaacaaaaaccaaccaaaacaatttttgcaagcatccaaaagacctttttgttttctacaagttgagcaagaaaacacctcatcttgtttaacaatttcttccatgggtttaacatgccctaaagcatctttcaacttcatctcattcaaaacacactttgagcaatcttgagaaatcaaaacaccattgttttgttttgccttatttgcacatgaagcattgaccaaagaacttgcacaaaaagcaactttgtattttttcaacacattctttgtcaaaatcaactcatcaacaacacgagcatgtaaagcaaatccaagagcaaaagaagattccaactttttagatttttcaatctcaaattccaattttttgcaattaacagaattgacatctcgcaaagcattaatttcagaaaataaaacttcacaagattgacaattatcatcatcaggaatcaaagattttaatctagcaatttcatcatttaaaatctcaacagtgtgatccttctcatcaagctcaatagaacatgtttgaagttttttagcaaatttttaagtagcaagttctaatttatcataactaagcttttcttcattatcatcatcagatttatcaacatcagaactagcattacgagaaataaaacctagatcaacaacttgcttacctttgccctcatcttcatcttcagatccatcaaaaacttttatgagttcttgaattaaccactgcatgcaatgcttcttcttctccttctccttcatgttcttcttcttgttcacgtcatcatctttgactctcccatcatcttccttcttgcctctcccaagcttaggacaatgcgagcgaatatgatcaagtgctccatactcaaaacaacgattcggttctcctcttttcctgttcctaacatttttcatagctcgagaaaatttgttagatagcaaaaccaagtcctcctcctcgaactgttcaagttgatcatcggacatggcattaaataaattgatgaagaagcaccaagatccaaagaagttgaagacgaaaccaaagcactagacttagaatcacctttacgagaaggaatattcatctcatgagttttcagtttagtgtaaagcgaatccaaagtcaaagtagacatgttaacagactcctgaatagatgtaactttcatctcccaaatagacatgtcaagaccattcaaaaagtgacgagaaatctcagattgtggataattagcaccataagaagaatcaacagatctaagatcactcaaaattttattaaacctagaaagatagtcatccaaagcttctccaggtttcatctcaaatttaatgtattcctttttgaaaagatcacgacaaagttctttaatgttatttgtaccgtgatgaaaattactcaaagcaatccaaatctcatgagcagtttgaagatgagcaacacgatcataatctgaacgagaaatatcactcaaaagaatgttgcgagctttgcaattttgttcaaaagcaattttttcagcagcagtattaatagcttcaggaatcacataaggatgagaaacttttctccaaagatcataattctcagccataatgtaagattgcatcctactacaccaatgagaaaaatccgttccatcgaaaatatgaggcttagttgtaaatttattagaagtaaccatggcaaaaactcaagatcggcaaagatcaaaaagagcaaacgtggctctgataccacttgtaggattgaatcacaagaactaagccaaccaaagggggggtgaatggttgagatacccaaaaaccaaaaacttttagcggaaataaaagttaccttcgaaatcgatggatcgcggtctgaccgaagtagttgcaccggtctaaccgcctggaacacgccggtctgaccgagatcgaactccggtcgaaccgccgagatcgcctaccgtgcctgctgctatcgccggtctgaccgcctcgcttccgccggtctgaccgccgccttgccgccggtccgaccgccgatgagtcgtcggttagaccaccgaaacctggtgaaacacaaatcgaagaactcttaaagtggatgacgactttattacttctctctgtgtttacaaagtgcaccaacagcactccttacaaaaattttgactaaactcgaaaccctaacttaaaactcaactcaattgctctcaaaagcgaatccgggaagcctcacgctccccctctatttatacatgaggtaggcagcctaaagccatgaaccaaactcatactaagagtcctaaacaccttaggaaaccctctagtacaagaaagaaactttacataaccaatcgtaccaaatttggactcctttcaaattcgactccgcatcccatacgtacacaatacctccatcgtatgccatatggaatcttcaccaaccacgtgtatcaactctagccttagtatcccgcttgatatctgaccaccacggacatcgtcttaccaccaagccgactcccggtccatcaccgcaaatactctcccgaggcatcgagtcacctagacatgaaacaaacaaagaaaccatattctgagaccaagctatctccaacttgactcattgttagcaaacaacagtattacatacgtgtagtatccatctagaagccataaccatgaaacaatcacgaatatccaaacaaacaacccgaaaccgaaactgacacagcgccggccggtctgaccgcttactcaaaattttattaaacctagaaagatagtcatccaaagcttctccaggtttcatctcaaatttaatgtattcctttctgaaaagatcacgacgaagttttttaatgttatttgtaccttgatgaaaattactcaaagcaatccaaatcttatgagcagtttgaagataagcaacacgatcataatccgaacgagaaataccactcaaaagaatgttgcgagctttgcaattttgttcaaaaacaattttttagcagcagtattaatagcttcaggaatcacataaggatgagaaacttttctccaaagatcataattctcagccataatgtaagattgcatcctactacaccaatgagaaaaatccgttccatcgaaaatatgaggcttagttgtaaacttattagaaatagccatggcaaaaactcaagatcggtaaagatcaaaaagagcaaacgtggctctgataccacttgtaggatcgaatcacaagaactaagccaaccagaggggggtgaatgattggtatacccaaaaaccaaaaacttttagcggcaataaaagttaccctcgaaatcgatggctcgcggtctgaccaaagtagttgtaccagtctaaccacctggaacacgccggtctgaccgagatcaaagtccattcgaaccgccgagatcacctgtcgctgaccgccctagcgccgccggtctgaccgccctagcgccgccggtctgaccaccagtatatcgccggttagaccgccgaaacccagtgaaacacaaatcgaagaactctcaaagtagatgacaactttattgcttctctctgtgtttacaaagtgcaccaacagcactccttacaaaaatctcgactaaactcgaaaccctaactaaactagatctcaaaagctatacaaaagtgataccgggaagcctcacgctccccctctatttatacatgaggtaggtagcctaaagccacgaatcaaactcatacaaagagtcctaaacaccatagaaaaccctctagtacaagaaagaaactttacataaccattcgtaccaaatttggactccttccaaattcgactcagcatcccatacgcacacaatacctccatcgtatgccatatggaatcttcaccaaccacgtgcatcaactctagccttagtatcccgcatgatatctgaccaccacggacatcgtcttaccaccaagccgactcccggtccatcaccgcaaatattctcccgatgcattgtaagacagcagcctaaagccacgaaccaaacccatactaagagtcctaatccccataggaaacctcctagtacaagaaacaaactctacataaccaatcataccaaatttggactacttccaaattcgactccgcatcccatacgcacacaatacctccatcgtatgccatatggaatctccatcaaccacgtgcatcaactctagccttagtatcccgcatgatatctgactaccacggacattgtcttaacaccaagccgactcccggaccatcaccgcaaatactctctcgaggcattgagtcacctacacatgaaacaaacaaagaaaccatattccgagaccaagctatctcccacttgactcattgttagcaaacaaacagtattacatacgtatagtatctatctagaagccataaccatgaaacaatcacagatatccaaagaaacaacccgaaaccgaaaccgacacagcgtcggccggtcagaccgcgggccggccggtccgaccgctcgatctccgccggtctgaccggcaacaccttcccggtctgaccggtcacatgaaataacagcgatttcctgtagattcacctgtgaactccaatcatctccaaaaccacttcgtgaataaactccagtatcaaaaccaataatcacagatgccaattgttcatcacagaataaaaatcaaaacacacgttgatcttacaatttcccccttgatgaacacattggcaaacccattaaaaatgttttggagtttggaacattaaaaacaaaagcggtaaaaagcacacttcgtacaaacgtacacatcgtgctcaaaaatccaaaagaaaactactccccctttttaaaagaaagaaattcccaattgaaccaaaaacaagaaaccttctcccctttttaaaagaaagaaattcccaattgaaccaaaaacatgctcttcttaaaaactcttctcttctaaaacttaactcttctccaaaagatccaaaaattttcacattatttctcccccttttgacaactccaaaagatctaaaaattttcacattatttctcccccttttgacaatgatttcataaagcataggaattatttcattaatgtataaaagcttaacatacatatagcatatcatgtcatgtgttgcaataaaaagaagatgaacccatctataatataataagcatgcattaaagtataaccatgaatcaaagattttacaattaagcttgaatcaacaataaaaattcatgatttcatacaatttataatgcaacatcttaacaagcacataggttgaaaaataaacgctaaacacatatacctattgcatttatcactctttcttaaataacctttagcacaacataacaaagagaatttttaactttttcttttcttgagcctttttctcatatttttctcttttttttattctgagtacgtccctgtcgtcaagactgtttccagggattcggcacccattattttactcacatcgaatacgtctttgtcgtcaagactgtttccaaggattcggtattcattttttcatattttattctctttttcacaatgagcaattaaagctatttgaggaataac

SEQ ID NO: 13807 - DNA, 5444 bp, Oryza sativa
  unsure (1)..(5444): unsure at all n locations
atcatgccaaaagaaagtcataaaaagcactaactccccctcaaaataacctccaattctccccgaacaaaaatcaagaagaaatcaaagattttgaaaaagacatccaattgccaaagatatcacaaatactctcaaaattgacatacattcattagtatcaacaaaaactacaatctcaaacactagcacatgaaaagctaataatcaagaaagtagaacaatattatgtcaatccaaaagtaaattgatgttaccttgaaaagcaatcgtcatctcaacattgaacgcacatggggactatgccaccaaactacctacaaacgagaagatgtcgacgcctctgtgttggggttagaaataagaaattttggaatccaacactgagtcacacaaccagtagaaccagtagatacatatgcactaataaaatcagaaccagacttacctgaaaacttaccttgtcgtttcacaaaagtccgatttgaagtatgcgaaaaattgccccaaggccggtctgaccgccgctgtacctgcggtctgaccgggcctggcaactggtctgaccgcccgttcacctgcggtctgaccgactggacaatgtcggtctaactgtgctcctcgaattaaaacccgatttttgccaatgtcattttgcaaaagcaatttctctttcctttttctgtttatgggcaagtctaaaacaaaaaacaaccaaatgtccattttttccacaaaaagaataagtgtacttttcacgacaagtttgtgaagtagatgattctgaaattgatggttttgcattcacaacatttgatttcgatgaagatgcacttaaagaagacatgatgccagcaaatttaaacacagtgttcttaggctcagatccaatcaaaatttcacctcctagcaacacccaaaataataggaggatgtctagcatgataagcataagaatcaaaacctaaaccacgattgtgtgtgctaaccttagattgatccagaatcatgttgaggttctttttaccatcagaaaatctttgcaaagaacttttcaaataagaaaccttctgtgtaagaatagcacaatttttacaagcatccaaaagacctttttattttctacaagttgggcaagaaaacaccttatcttgtttaacaatttcttccatgtgtttaacacgccctaaagcatctttcaacttcatctcattcaaaacacactttgagcaatcttgagaaatcaaaacaccattgttttgttttgccttatttgcacatgaagcattgaccaaagaacttgcacaaaaagcaactttgtattttttttcaacacattctttgtcaaaatcaactcatcaacaacacgagcgacagcgcggcgtgcgagaccgcacgataccgtctgcgacgtctttcccacgttattttcgcacaatggctgtgcgataccgacgcgacgtctttcccacgttattttcgcgcaatggctgtgcgataccgacggtatatttgtcgtaggctctccggacctctcattatatttgagggataaagtgaataattcaagccatcaaacaaacgtaataaaacatccgacgcctcgagagaaggatattagagacattaatgggcctttagcttgccagtcaacttcagcctgagatgtgcccatcaaaccacacgaaggagacgatcagatgtgttacacattcaggagacttgtcaaatgggctaaagatctacgatacctcaaatatccttaactcatactcatatgaatcttgttcctaggatatgtactagattcacactttcttcttaagcatggttatgcatagcaaatacaaataagacgaaagcgattcaaatttacaactactttatagttacataggccgaccgaccaaatatagatagataacagagaacagcggaagcttgactacccaaccacaagcacaccgattaagggtttaccccattaagttcaagtcctagaaaaagcaatcgaaacccgcaccactcaagaagactaagtctaacctgcaagcaaaagattattccagtagcaagagtcagtaccttaatgtactggcaagccaaaaatcaatcctaacatactacatgtaaggcatatattcaaaggacaatatgtagtttaatttcagcataaagcaagttttggttcacaaatattttgtaaaggagttgattcaattaaattaacaaatttgtaagttcatcataattaacataatatatcatcatatataacaacatatcatcataagcatactcttgttgccttcaatggcacaactcttataatcatcatcactcacacaactcaacacaatttttccatttcaatcccaagtttcatcaacacaaggctatactcatgacacatcaccaaagcgctcatgaccgtgagcatggctaatcgattagttttaaagaactctacagagtttgtacagctttacccacatgatatgaacactatagtttgtttcgagtttgcaagactctaccacattcttcacgttgaatgtggtctaaaggtcataacgaagcctttacattgtctaatgcctaaccttgcacgagcacggcaagtgtttattcacacgaggagcaacccaagtgccgctaggtcggggggccctcgccatccctagcgccatggcagcgaacacatccattcctccacgaggtacttaaccgttatattaaccgttatattggacacgcttagacgcctaggcacaaccgcactaggtagctcctataaaccatcattccgactagttcatactactactgcctcccaatgcaaggttagacattaaacaacttaataagctaaggccgtcccattcctagcacatgtggttgcacggtatacttagatggtgacacaaagttcggtccttaattgactagggcgagcacttcccctataggtatgcaactaacaccatatgcataccacttgccgcccaggtctaaaatcacacttttacaccttttaattcacaaatatcagagatattcacctctgtccagcagtgaaaattttcccctaaattctcattttaaaagtgatcatgaaattatttagaaactactaggcatggctaagcgtaaggcttttatgtaagcatgtataaacccaattgagcactttgaaagtactctaaccatttctaagtaaccatttctaaggttacaatcagtgaggatcacaattattcaaagaagtaaatgcagcaattaggtcatagctaccataaccaagtttcaaataccgttatagtctaaattcatatgcaactttgcaaacaaatatattttcattcctcaaaacatgggattcaatgtgatcaaagattgggaggagaaaacttgccttgttcctgggaaatgttagcacctaattcacttcttcatcatttacgcaattatctatataaaatacacgttatgcaattaaacaccaaaataggtaaaaattcaaaatgctctaaaatgcatgctttgtgcacagtgggtaggtactgatctaagatgaatttaggtgaaagaatttatattttatctctttttatttgtgagttatgagttttagaagtttactcggtacagggtggtatttacttaggtagtgttatgaaatatttttgcaaagtgatttttattaggtttgatttctcaggggtgtagagatgtgttttctaagactaacacatttggtttcataacttttagagttattatgaatttcttatgtattttacaagttttaacgtgttgtaggtaggtagcttctatgtgtacatggttttggagttttatgtccagtacatgtttcatattgtttgtgatgtataaaatgactaattttattaaccaatataatcttagttcacaattttagagattatattacgctactacacattttatacgctaggggagtgttctatgttagttacttaacataccaatctagaaattgatatatgagctaagtgtgctaagtttttggtggttggggatagaactatgacctctctggtctatcaagttttattttggttacttagagctagagtgcatttatatatacatttatacatatgtattgcctaacctataccatgtgactagcactgaagttatctatttaaagtttagtgacatatttagtatagaaggtgccacattttattttacctaattaaagttcattacttgctagttctaaagaaatttggttcattccatttggactaaagatgaattctctacaaattttagaagttgaagggtgctctaagttgtttattccttatataaatatttaggggcttttattgcactgtaagtatatatttttattttatatatctaaagtgctaaacttgatgattctacagaacttgagtttactcaaaaaggaagtaagatgaattttatataaatttttaaagttcagcttgtctaaaattagttattttgtataacatacatttagaggtatttggtgtaaagcaagtgcatctttttattttattttaccttagagagtaagttgatgaatctgtggaagttgagtttgcttcaatttaagttgaaatgaattctctatacattttgtaaatttgtgcatgctttatgtatagtttttcttagacaaattttagaggtgaaatttatactgcaagtgccaagttttatgtttccatattaaatttcatccttctatgagttcacagaaacttgaatcatctcaaaatgagctatatttcactttgtatgaattttacaagtttgcatgtttttctgttgaaaatataaagctctagaggattttccttagattttcagattttaagctcatggggtccacctgtcagtgagagaccaatatgcaaaaggtccctggcttttcaggaaatcaatccgcagtcctatgactgttccatgtgtgtggtagtttttacaaagtagtatctacagttttgtttcttctccacagaggtccctggttcgagctgaaacagagctagccatggctgagctcgttctcgagctttctggcggcgaacggtggcagatctcggcatgaaaccaaaatataaaaggaataggggttcttttcgaagccaatggtggtcttatcgtgatctgtggttaccggaatcaatggcgacggcagcacgagtggctttgggtctcggggtagtgatgcatgtcacgttagaggccggatctaggtggataaaatgcatgcatgcaactctagaagctccagggtgctcacagtagtattggatgaggttggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 13808 - DNA, 1040 bp, Oryza sativa
atcttatattaaaactcaaataatcttagactaaaactcaaatagtcatgtgtgctaagtgtaactgtcgtatattagaaccctacacaatcttatatgctaagtctaattacaaatctaataatcttatactaaaactcaaatagtgataaatgctaagtctaggtgacgtatattataggaccctagccagtcaataattatatactaagtctaattacaaatataataatcttatattaaaactcaaataatcttagactaaaactcaaatagtcatgtgtgctaagtgtaactgtcgtatattagaaccctacacaatcttatatgctaagtctaattacaaatctaataatcttatactaaaactcaaatagtgataaatgctaagtataggtgacgtatattataggaccctagctagtcaataattatatactaagtctaattacatgcatgataatcttatattaaaactcaaataatcttagactaaaactcaaatagtcatgtgtgctaagtgtaactgtcgtatattagaaccctacacaatcttatatgctaagtctaattacaaatctaataatcttatactaaaactcaaatagtgataaatgctaagtctaggtgacgtatattaaatccaatagtcttaattgcattacaaatataacaatcatatatataattacgtcacttgcctgcgcgaattccttcgagggctagctaccactccggcttgagggacgacttcgacaacgtcttttctgcaggatacaaaaagatgtattaggataaacgcgaagtaacatatattgcatttgacgttcacgtttcgttcacgatcgttcacgttcgcgttctcgttaaggtcacgtttcattcacctacgttcgttcacgtacgttcgttcgttcacgttcattcacctacctatattgcatttcacgttcacgttcgttcacgttcatgtttcgttcacgttctcgttcacgttcgtttgttctttcacgttcaattctcgttcacgttcgttcgct

SEQ ID NO: 13809 - DNA, 1168 bp, Oryza sativa
  unsure (1)..(1168): unsure at all n locations
atctcgatggattccgatttctcctcgtggattgctcaaagcctcaaccatagcatcgatcaaatccaaacacacatgggtaaaaaaaatccatgaaaagaaatccaagaacatggactaaaagaaatccatcatataccaggtcaattccaacaccggaccacagtttcccatgtcttccaggatgcagcaggntgaggagaagagcctggaaacgaacagcaacgaagtgcgcccgaactagtggctgcgccaaaaaaaactcaatggttggccatgaagatgacgggttaaggcactatcattggcaaacgattcgggaccctaatgaaaggggatttgtgggggcattgcagagggagttgagaggagtaattccccttaatcaattggatttattcctactacactactaccatctcctagtggaaggtattgtaaaaggcctcgttgggaaggatggttgagggaggtgaactggaggaggcgctaggctagctaggtttttactggggagagaggaggcagcagctcagctggagactcaagacaccctgacaagtgggcccgacgatggaaggagctgatagaaaaaggggaattttgctagatgacacttgttatgtgtggttttagccttaggacactatccaaacttatttttgggggaaagcactccataaacatggtaatttgccagtggacaccacgctgattaaaataatactttccggttgggaaggagagagaaatcgcgtgaaatgccaaaaataccgttgggcccacatgtcagctctatctcccatctcttttttcatctctcagaggcgcgctcgcacagggcagcgtcggtcgcgcgcggagatggcgaggacggcggccggcggcggcggacgagcgtgtggctggcggagtggcagcgttggcctagcggagtggcagcgacagtgagcgcgcgacaggcgaggatgggacgggcgtcggcgacctgcttggcgatctcggtggtggtattgagcgggttggcggtggtgaggatggcggggtgcgcggcgagggcggatgccacggcaagggagacggggtgcgcggcgtgggcggatgccgccgccggctgctgcgcgcggagggcagttggcggtcggcagccgacggcgaggcggatgtg

SEQ ID NO: 13810 - DNA, 9722 bp, Oryza sativa
atagtacatcataaatttacaacgtgcaatgggaatcagaggaaataaatcataagagtcaagtctgggttattattctctgcaatttgcagatggatacatcgtaaatttactacttgcaatggggactagaggaaataaatcataagaggtaagtccggttccatttttctctgcaatttgcagatggatgtattttgcacatcatgtattgcaatcactacctacttcatatttatttaatcctttctagcatgtgcatatatacatcagaattgaacagggatatatccagttttaatatttcccccaaaataggtatatatgcaattttcatacaagtacactgagtaaatggtattaagccaggtgtagctacttacacaaccccagatcaagtgaccccaaagcacccagccatgcaagaagcattagcccttgcaatgaagctcataccaagcatcatcttccttgcagtgacagcgcaggctgcagcttcttctgggtacagtatggcgttgccaggttgccctgacaagtgcggaaacatttccatcccctaccctttcggcatcggccccagctgtgctgcaaccagcatcagcagctacttcaatctcacctgcaacaacaccttcaacccaccacggcctatggttggggactctgaagcactcgtcgaggtcactgacatctcactggagcacggcgagatgcgggtactcagccctgtctactacatctgcttcacggcaaataccacgttcaccaggttcaccgaagggtatgagctgaagcacacacccttcctcccctccccgtcacgcaaccgcttcacggtcatcggttgcaacaccctggggctcatcggtggctacaagggaaccgtgagccactatgtgactggttgctactcctattgtgagagcatcaacagcacatctgatggggcgccatgtgcagggatgggctgctgcgaggccgccataccgactgacctcaccgcctggggggcgatgtttgagatgaaccagagcaaggtatggagcttcaacccgtgtttctatgccatggtcagtgaggttgggtggtacagcttccagcagaaggaccttgttggccaccttgggttcatagatgacagagctcagaggggagcacctgttgtggctgattgggccattaggaatggctcatgcccggaagaggggaaaggcatacctggtgattatgcgtgcatcagcgcaaacagctactgcatggacgcgaacaatggtccagggtacttatgccagtgctccaaagggtatgagggcaacccttatcttctgaacggctgccaaggttaggttcaaatttaccattggtttagattttgagaaacaaaactggtagaattctatggcgtgctcagtgtttgttcagctagagtgtgtaagatatagttcaaaatattatgaacattcatcaataggcagcagttctctttggtttccagcataattcagcatgggactggaaaaagaaacagtcagcttcatttgtggtgcggatttttaattaaatagtgaaaagttattttcagtcaataggcagcagttctctttggtttccagcataattcagcatgggactggaaaaagaaacagtcagcttcatttgtattgcggatttttaattaaatagtgaaaagttattttggaacaagtcatgaaaggcaagttatagcattcttataagtagattaggttgattttagtttacctatgataatgaaagtaatacagactagcttacacaagtttagtttgacttctgaatgcatgctttttgtctctgtcttcagacgtggatgagtgcgcattacgtaagcaggatcccaagtatgaagatatatatccttgcaggaaaggagtctgccacaacacaccaggaggatatttatgcaaatgcaagttaggaaaaagatctgatggtacaaattatggatgtcgacctctgcgtactacagcagagcaagtggttattggtaacgtcacatctgcagattttacttctgtttcacctacattataagatgcgtcttctactaaagtaacactcatattgtggcaagaaaaatactacttctgaaagtaattttgaacactacctagaattgtcgataaaaataaattttaacaaatttggagcagaaaattattagtatcaatattctgaaagagaattttacaggcaccagtgtttcggccattgcgctaatggctttgacatgcgtgttggccatgcaaatacaaaggaaaaggcataagaaggacaaagatgagtatttcaagcaaaatggaggtctaaagctatatgatgagatgagatcaaggaaggtagacacaatccgcatactcactgaaaaagatataaaaaaggccactgacaactacagtgaagatcgagttcttggaattggaggtcacggaatggtctacagaggaactttggatgacaacaaagaggtagccataaagaagtccaaagtaattaacgatgaatggagggaagaatttgtcaatgagataataatcttgtcacagatcaaccacagaaacattgtgaggttgataggatgttgcctggatgtacatgtccccatgttggtctacgagtttgtctccaatgggaccttgtctgagttcctccatggcactgatcatagatcaccaatccccttggacattcgcctgaaaatagccacacaatcagcagaagctctagcgtacctgcactcatcaacatctcgcacaatccttcatggggatttcaaatcggccaatattcttttggatggtcagcacaatgcaaaggttgcagattttggggcatcagcgctgaagtccatgaacgaaagtgagttcatcatgtttgtccaaggaactttgggctaccttgacccggagagcttcattagccattgtcttaccgacaagagtgatgtctacagttttggggtggttctgctggagctgatgacaagaaagagggcaatctttgccaatagcatcaatgaaaaggaatcattgtcctattcttttctcctgatgtttgatcagaacattcaccggaatatgctggacagagaaattatggataaagaaaccatggttgttcttgagaaactttccattcttgccgccaactgcctgcgaccaagaggagatgaccggccaacgatgaaggaagttgcagagtgcctacagatgataaggagacacccaatgcacgcagctagtgatcacaaaggagacagctctgcgcatcacaactatgaaggatcttcatcaccatcaatgtctgcccatttcgacgaaacgatatacaagagcatagaggcatccagattggtacaagatcttgtgagatgatggtatgcttgtgccagcacttaatgtgttaatatcttgtgtagatatcatagtaaatacggtataaaccaatttctgtaatccccttgtatgagaaaattagcaatttgttccccgtggtgatgactgatgatgaatgcttccattctgaataaatattcagttgtacagagtccaattgatcagatttcagaaacgaaattacctgggatttcttgcgccgccgatccaaagccgccaggctgcggctaaccgccgccaccagtcgcgacatccatggcaagtttggaggatcaccatcggtggtcatccatttggacgagatgacagttagcagcgtaatggacgagatgacagatagcattgagatgtctaaacttgtgctgagcgagtgacagacagagttcacaaaactgatggaatttcacgaaaaccggtcggctttcgtgaaaccaccaagtctcggattatgaaaaccggtaggaattagcctgttttcgtatggcgttgactaaaagtcaacagtttttacatttttttcagtcggattttggtaaaccgatgagaagcgatttttactttaaaataggtcttgctacatgatgcaacatcactcttaagtaggatgtactagttctttcttgagacatttcacttgatatgtcggacatatgttatataaaaaccttttttttttttggacacgtccccccagttgcattttattgaaactgaagtggcagcagctcagagcattcagtttcagccattcagtctgtgttgtagttgtagccatttgtttctgtcaatcaagctaattcttttggttagtaggtctctctactcgctaccatcttttgcctccccctcgtttgtttttctcgagtgttgttcctctccaatccactgatcgacgcaccctcaccaaccatgcatcgcggcgtctcgtttcgtcagaagcaaaattcttgcagctgtctcttttcgtcagaaacaaatttactgctactctctcactatcatttccagttttcctcatctttttactagtatcgaaacgtggaggtcattcttcttgccacaatataatctactgtataatagagttgatgcaatgattcttttcaaacctgcacgaagaacaaagatcaaataatcaaaagcaaagaacaatttagtcaacacatatggatattagcctagttaagtttcacgttagtgtgtctgctcaaagcccagattcgctcaagcatgcgttcatgatattccaatacaggagatttctacacaaagactacaagagaagcaaaaacacccaaccaaccaggtgttcacagcatttcagatccaaggaggaaacaagctgtgtgctacgctgcttggcagtgagatttctcacttaatgcaaataatggtgacaaggaatcagccccttcttcaattcagataaactactttaacccaaacatgtccagcggtaatattcctttcaaaagtctcaagggagatctcacctgcattcataatcaacaacagtcaccaaaatcttttgtagtttaacaatatcagatgcatcatcagcagttcagcacccatcatcatctgaaaagaaagtctgagatacacctacttataacccatgatataaccccagttcataaggcataatgacatcacatgataataacgaaaaatgagagtgctagctaagatagaaagaatggagtagcaagtgaccaccattactcccaacttcccaagtccccagccatggaagaagcattgtatggaaatacaacatgtgctactacgtgatgcctgttgaggtgtgcagttataaaggcaatccttatcttcccaaaagatgacaaggtagagtattactacaatgaattttacccagaatagacaagagggccaattatgaagttgcgcaactcttgcaagtgttaaagagaatccagatgcaactagtcacaaaacagatcatatgatgatgcattaccatagtggagggtaatcaatgcatatccctcgaatgagatgaactaccaaagcaaggacatggccaaactgatcttagatgtcaagatagcaagacgattttcacatactagtagtatttgagggtagtatcaaatatttgtgatgcactagcagtctagcacatccttcatggtcaatttgatttcttcaggttcgttatgtctaagccatcaatgtaactatgttattttatgttgaagcaattgcataaaaatgatcatgacttatgtattacacaaagtggagaatgtgtggacagttgggttcttagaataaatttcttcctatcagctctgattttgcccacttgttcaaataaaacatttgttttgatgcaggatttacttgtccacataaagagctataacttctatttagcatttacacatcaacatgggcaggatttctccctaaaactaatacttaatgcctgtttgttaagataattatgtgtaaattcataagatgacaatattgtagttttcaggcaatgcaaatccatctgtacaaattggtgaactcatataaagtattcttctcaagtaagccgtttgattaatgatattggcatatgcaaaagttatccaccaagattgggttggatgcgtcttttaatatttctcatagagaggtttgcaaggtcctgtttcatttaaaacagagtttcagaacaaagctaattaagcagcagaaaaaaggggcatatgcaaaacaaaagaaaaggcataatgggagatgatttaaagtcatgttcgaatttggtatgctattgtttccaagacattagtagtaatcagggccaattaaatgaaccaagaagcatagttgatccttctacctcttccaagaaatgaaggaatgcaaattctcgcataccttttactgtacatacatatcaagttacataccttattgctgtagataagcacatcatcaaaaggcttcaatgccaaataggacctagtacatccaaatacggttatcctaagactgcagaagttatgcataggtaagagcattactccacataaaaatatgttcttgttaaaagcatacattttgtttttgcaggaagccctaccttctgttccaggaattttagctgcccctccctgatccatcttggcgtctcatatgctgctccagtgaggaatgctcttttttgtggctgtggcagatcttattatcagcgtcagaagtgccatcggtgcaaatgttaccgcaatcatttgattgtccactagcaaaccaatctgaacaggccagtcctcccccaacacccaatagaaaagaagaaagtaagaactgcaccatggcagccttctgttcacatgctgagaggatgatcgcaatatattgatgaaaaaaatattatataagcaaacatggtcaacaaatccattgtccctatacactgtacagttaccaacaaatttcacctaagtttctgaagaaatcagctttacgtacacatgttaacatcaatagaaaataaaatagatgcagaacaataaatggggatcgaattcagatattatttgtttgtctaccattcagaatacttggaatgcagaaatgtcacatgtccattctaattatgctacacacgatccattccatgctcaggagttcggatgagcttaatcaaggtctcataatattatttccccacaaacaagaaccacagtaaaagaagtacataacaacagggacaacagaagtaaatacagaactgacagaaagtgcctaatatagagaagcctaattcagatattggctatcctctcttgcagctcagttcatctcccttagatcggcatgcctttgggcacaatctggtcctttatccacatgtagataggcaccagaacatagtatgcagcacatattgttcccatgaggaagcggaagaggaaggtgataggattcacaggtttgctgacatcctcaacctttggaccaagctgcaggggaacaattgaactcttcagtctaatcactacacaccaacatgataatgtatttccaaacgtaagctaaacaaagtcaggtgttcacatttaaaaattaatttcagctggagatggttttttgagctgtcccatttatttgtaataaccaggagaaataatgttaagagaagcaagaaaaaaagaaggaaataaagagaagaaaacatgaaatcaggaagattggtttcttcacaggaaagtttcatgtgcttacatgccatcaagcactatgatgggtaagatgctataacctataacagccttttcacatgaacaaaaatatttaaattgactcagattatacaagtcattatataatatgcaattatgtatgttagaaagtgatccaaacaaatgtattagcatcttatatccttcacatagcactacatttgagctgagactgagacatggcacaggctagctaggctacaagttttgtcgagagaacatttaggcggctgagaatggcatattgtcgacacttatctcttcatcccatcaataagagagaaaaatgaatacctacaatgttcattaatctcatgcaagtgagaaaaatattgacatgttcactcttcaacattcgtcatacccaggtgttgcgttgccaatccatgagtaataatcaacatataaatcagtaagaaataaaagtaacgacaaaaagagtcatccgaacaaaggaggcttatgtgaatttgcaacttgcaaggcaaattagcaaaaaaaaaaacctgcaaaggggagtctccatgttctcttttgacgcccgtcacagagcatcccataatcaggccatgccttcggacaccacggtaccattttggtccaatccttttgagcttgacatccttgaaccctgcctttttgaaccactcaatatactcctcttccttcgggaagagcatccacatgtcagcgaaaaagcgagacagccagaaggttgggtgcacggggccaatcatgcaagccactccaccaagcctcaaaaccctgtaagcttccttgattcctcgctgcggatcgggccaatactcgatgctgtacaacaatcacaccccctcatcaatcacaaccggaacaccggaacccgcaaagacttgactaaaaatcactagtgaagtaatgaaatgcataaccatagcaagttgttcattgttcattgttcatggttcatgtagaaattgaaattcacaatgtgcgtgcgatatcgacacggtttggaggtgaagagagcaaagtgagagggtgaacctgccggcggagacgtagcggtcgaaggtgtcggtggggaaggggaggtcctcggcgtcgccctccatgatggtgacgcccttgagggcctccttctcccgggccttctcgagctggtgcggggactggtcgagcagcgtgacgttctccgggtcgacgcgcttgacgatcccgagcgtggtgaaccccgtcccgccgccgacgtcgacgaccctgagcttgcggctgtagaggtcggcgggctcgagggcgtcgtcccgcatgtcctccgtccagtggcccgggttgatgacgtggtcgtagacgatggagaggaagcggtagaaccagaacgcctccttcttgtgctggatgaaccgcggctgcgacatcggcctcgccgccgccgacgacgacgacgccgcgcacctcagccgagccacggagatgttgccgccgcctcccccacgcctggtgagcacgaggggcctcgacttggtggtggtggtggagaagccgaggccgcgcggcggcctgatcctgcccggcgcggagtgggtgccaacgccgcccgctggggcgtaggcggaggaggccatcgccattgctcctcctcgtcacgccgccgccgccgccgccgccgccacgaaggggagaggagagagtggaagaggatgggaggggggagagtggcgaggagagagggagtcacgaggaggaggggattagtggtgggtggtgggatgggcttcgcctcgtgtcgtcttcctccggacacatggctccctccctcccgtccagtgtgcacgtgggacctgaccgagtggggcccactggtcagtaactgggcctttgcctttgtgttggggcttggagttggaggtggaggacgtggatcctctgtggcttcaagctttgtggtttttgtgttttttcaagttgctaccctacccaagagacgacgtgtgaatacttaacttcaggaaaatactactacctccgtttcgaaatg

SEQ ID NO: 13811 - DNA, 2278 bp, Oryza sativa
aatatatttatcaatggatcaaatgagaaaagaattaataattacttaaattttttaaataagacgaacagtcaaacatgtgctaaaaagtcaacggtgtcaaacatttcgaaatagagagagtaacatttcgaaatagagagagtagtacgaaatgaaacttcaaaaaagcttctgttggagttcattatcattcgaatcaggctttctccaattgacaagggctacgacactggcattgacaagaaatcttcaagtggtttgcacaagacaaacatacaggaactgggattctgtggggtgctgcaatgaagcagctgctttgccttttattactactactaaatactaatatttggaaccaggtttgatgaattattctactgtacctagtgagtttgaactatgaccagtacgctgtcaaagcagcagcatttgccgtttctcctttcagtttcttatcaagaggagctgaatagtaacggcaactggaagcttaatgcaggttactgaagaagcaaatgccctggtgtacatagataagaaaatgtaagaatgtgtgagaacaaagtttagcgatagaaataacacatgcacaataagcagcaagggaacgagtccgatgaactactccctccgacttgaacttgaactataaaggcagctatattttgggacagaggtaagtagaagctaacaagatcccatcatacgagctaagaaatatgtttgatctgtatagtgcattcatctaaacatcaaataaatgcattggcccgtacctttgtcaaatttacagatcaatgtagacgcgcaatccatcacgggctaactgcacatctatcccctccctgtactcatagataattacagtgcatgagtatgcatatctttcaggaacttacaataaagagaaatcagtactctacttcagtaatcgagtagtacatattttgtaatgcagacactagcatgtatgtacgatcatctaagtcatcttgcaggaaaccctaccttctggaccactcttccaacgtttcattgtccttgtgatggtccatctcatgagtcatcccaatgagcaatgcccttttggggcaaatcctcttaacagcatccagtgtctgcatggcatcatagtattaatatttagcatgagaagccagttagttagctttgaggaaacaataaaacaaattgttcaagtcattcaatagaaaaccaacctgatcccaacaaagatggacattatgagaaccagtctgttcacatggagagagaatgtcagcacacaacatgttagtctgaacaatgatacaacctattatggctaaataacgagaaattcaagcaatcagtgataatgttcccatgaattgcaacaaaagtcagttttatacatgttgaaaacttggcatatgccagctctgaccttctctagatgaattgaaatttgcaattgactgaaacaagcaactaaagggaaaaacatccatcactgacaaataaggaactgaggaaactaaccctataaaggcagtccaagatgagcaaatccagctgaccctctccagactttgaaattgctgaaaggtaagcatgtgtgcacagtaatgagctcctgaatagactaaatatttccatggctaagtacacaagtccatagattaatattgcattatagctatgctagagggggcaacgatgtattatggtgagcaacaagccactaatcagtaccagcacgcgtgcattgcagccaatgcaaaatgaaacatactatatgacctagaactaaaaatgcataaaatgattgtcctcaatagtcaattcagaaaactatattcatgactagatgagatcaagcacttctttactaaatggatcatattacatacagctcacgcatgtctgcatatgtctagtcataatagatcatgatgagacaatggcatagaacacaccatcacccctaactcctaactttaacaagtaaagataaagaaataaacaggctgataccagtggaatttatcctgacaaaaatatagaacaagtgattaatgtcctatggtcacatgtcaggatatttactcccaaaaggtaaccacaggcacagtaaccattagagcagcattaggaagcaaaggtataccgtgtctgtgcttggaggaaaccgtgaaacgtctgatatataagcaacttttgattttcttccaaaaaggaaacccagacaaacatagtcctcgccatggatcacctaagagatatacgatac

SEQ ID NO: 13812 - DNA, 2260 bp, Oryza sativa
caaaataaacgcataagtatagtacaaatcatcacttacattctcaattaatgactgttcgcaggtgcaaaacaatgatgaaacatgaggagcaaattgtcaacaaatttccataacattataaattgacaagttttatattcgctgttctaattttatggttattagtttcaaacattacttatcatatcacagatacgtgttgccaattaatcgaatatttatgattggtacacaagcagatctgcacttcacacaacacaagaaaaaggattactgtgggtggcaattatagtgtaatactttagttcaaagaataaaacaaaacaaagagcaaacaacgctaatagttaacgtggcacaaatcacaaagtaattaaattttaacatagcaagacccaaaaagtgcacggcatgtacacttgacaaagttcaattataactgaacaatataaaagcctaaaagccaaggtaagctaaaactcaaatacctgttcatagcaaattgggatagataaattggagttggctcaatatcattcgtaggactaaatggctgtacaatccgaacatcatcaagacccaagattgcatcggcatgctcatgagtcagaataatctgtaatgaataactaaaatgtgttagtgtaggcataaacattgagcattttttttattattttacagtagattcatctatcatagcagctcttgttcgcagaagtgagaagctgaaggaaaaagaaaaaaaaaacaaggataagaactcacagaatcaacacaagggattttatgatggataaaccaccgtagaacttgttctcggaatgtcttcccaacatcaattagaatatatttgtgtgtgacttcatcttggcaataatcaatcagaagagaagtattgcacctgtaggaaccccaagtattaatctagtcccagaaaaacgacacacaagcataatgttgccatcaagcttgtttgtgcaataatattccaaaacatttgggaaacaagcatggtgagcaactaaatgttaaggctgacaatcaccaaaaggggaaggaagaagctaagaatcggttggctagttggctacaaatggacataaatatgcatgatataatctaagccaaccaagaagataaatctagttatatagaaggcattgattaagagtattaaatgcagatatgagcacagatgaagtgccttttactttcagtgataagtatgtatatatgactcttaagactgattagttggtgcaaccgtgcaagtaacatctcccaacatccagtacaaaattcctggaatttcatgttaagaaaaacacaataccagaaaaataagtcactcgctatgcttccatgacattgcacagctgcaacttgaaactgtgccccttgtttctcagtttccgcatactgaaatatagatataccaccactgtgagtccatcttattgaagttccaatatattgtttaatcttacagaggtcgaccatgactaaccactaagcatactgattgattgtctgagcccaaaattttcgatcaatttcttgagcacgccataacatgcactgcaggttctcctattcctcgaagtactttcaacttctaaacaatttatcggaattcactctgcatacagaacatcgctaccatctgctgctgcaagcagccaagcagaaaccagtgcccatattctgctcagaatcagtgcgtgtgaatcactgaatctacaaaggcacagcaccagatacctatcgcatcaacatttctcagctctactgtaaatcgtacaatcccattccaaaacccatctaccagcctaccgcacccaaaagtagcagcagaggcaatcgttcagatctcggcgactcataatcacccgaacaaaagcatggcgcccacgcccgtgcaatctatacaaatgcaccgaactggaagctcccgatccatctcatgctgaactcagatcatccacaccgacctcgtgaagacacaagcgcaaccgacacgcccgattcctagaggatagaggtgaggacgaggaggaagaatgatgtatacctgtagttagggtttagctcggggggcacggagagggactgggagcagacggcgcagggcgggtcggggggctggatcaggcaccgcgcgttgggcacggcgctggagcagcccgtcccgaggaacaccagcgaggaggaggacggcggcggcgcgggcgtccctccttcgccggcgacggag

SEQ ID NO: 13813 - DNA, 6882 bp, Oryza sativa
cgacggcgagtcggtgagggggaggaaagagaaacggaacggaatcagggggagaagagaagatgcggaaatggttttgggaggtcgttttgcagataggtacctggaggtggatgttatttctggctgggtggtttttattcattcaaaaagacccaaatggcttctcaaaaaaaaaattgacccaaaagacttcagaatggagacctataagactataaaagcaagtttaatggtatagccgactactagctccaaatcatctataatcaatttaacgtcaattcttaccatagttacctataaatatatactacactattagttcaacatgtcatacatacattgcatcttggagtctgtgctatagctggctacaaatctgtagcccgctgcttatctctctcttttttaatctcctcgatatgtgtttatagcagacttatagtctattattgtatctgctatgagaaaaaggaagcccataagatttgccacatggataagtatttgattgtttgcatctaaaagcaatgttctttgattagaaaattatctttgattggcttctttgacgtttgtgccagccaattgattttatattacatactcgatgtgctaattgtaaccaattgcaactttatacttcctttacctttcttgtgtgtgttttcatgaatcaaatttgacggcgtcttgctcttccaaaagcaaggttaggtgttaagaaaggcatagtgtggtaatgcacatgaatattcgctttcaatggcatatgccacgcttgtttttttattgaagtccttttttttagcgtggtttgtactttagattaccatggtgtgaactaatatatttgtgtttgtgtattttacgaggaaagcgtttgctacgacctgagcatttatctaactgaaacaaattcacctacgaggttgccttttgtaaacggttcttatcaggctatgcatgaacatggcattttaccatgtactacttaataactcatcaatttagtgaacttaacttactaaacatataaaatgttgtacgtactcttgccacctttgaacaatgtgggagcatgagaagctaacaaaataggattagataagaacaatagatgtaatatatttggatggttcacaagaattcaaatacatgaattttagaagaaatcctatgtagaaaagaaagcagagagagaggaaaaataaaaaaataaaacaagagatatgagctcatgttatacttcttatggaatgaagtgtatagggaagcaatccatagtaaccttgcaatactattcctttggtacaaagggtgtcacagtaatttttttcaccaaggattccaatacttaaaagtaattatatgggctcctttgaatcacaggattgaaaaaaaaatggagaattaggaaaaatataggattctgatataaatataaatataaaatagaggattggaaaatacatgaaaaaaatataggaatgaccgtttggttgggccgcaataaaaacacatgaattttgggagagataaagagtcaaaggattctttccatgatgttctaccttatgttaaatttccttcaaaaatttatgggaagaagcattccatatgaatttcataggatttattcctttgattcaaaagctatatacgaaaagttcctataagaatgaaatcctttaaaattcatatgaatttcctttcaatcaaaggggctaagaatttcttctatccaaaagatcttgtaatacttctacatttgcacgatcctttttcataaatttgtattaactactggacctaagtggaaaaaagtccataggggtgagaccgtgagagtacacccctgccctgacgtcctgaccccaccacggctttcatcaaaaacccgccgccggcgccgccgccggcacattctccggcatcctccggccatttccggtcactctcatagcctccaaatataactacggagggagtagaagctaacaagattccatcatacgaactaagaaatatgcctgatctgtatagcgctgtagtcatctaaacaacaaataaaagcattggtccgtacctttgtcaaatttacagatcaatgtagacacgcgatccatcacgggctaactgcacatctatcccctccctgtactcaatagataattacagtgcatgagtatgcatatctttcaggaacttacaataaagagaaataagactctatttcagtagtcgagtagtacatattttgtaatgcagacaaaatatgtactgctcgtgccaaattatttggggacactagcatgtatgtacgatcatctaagtcatcttgcaggaaaccctaccttctggaccactcttccaacgtttcattgtccttgtgatggtccatttcatcagtcatcccaatgagcaatgcccttttggggcaaatcctcttaacagcatccagtgtctgcatggcatcatagtattaaaatttagcatgagaaaccagttagctttgaggagataataaaacaaattgctcaggtcattcaatagaaatccaacctgatcccaacaaagatggacattatgagaaccagtctgttcacatagagagataacgtcagcccacaacagatcagtacgaacaatgatacaacctattttgcaatttgcctaactaatgcaaatttcaagcaatcagtgacgatgttcatgtgaaatgcaacaagcatgacatgtgttgaaacaagattaaagcagtattcatgtttggcatatgccagctctgatctgctcttgatgaattgcaattgacagaatggttgtctagaaacaagtatgaaacatgaaattaaaaggaaaaacatccatcactcacaacttaaggaattgaagaaactcaccctactaaggcaatccaagatgagcaaatccagctgaccccctccagactttgaaattgctgaaaggtaggcatatgtacacaatgatgaggtcctgggtaatgaaaacaagatagaaaggaaataaactgaccagattcctagctatttccaatgcaaacgatgaacaagtatgcttgcatgcatctccaagagagaagggtttatggataaatatttccttaccaatctccatggttaagtacacatgtccatagaccaaaattgcattatagtatatgctagagggggcaccgatgcattgtggtgagcaccaagccatcaagcggagaattaccaatcagtaccagcatgcgtgcattgcagccaatgcaaaacgaatatagtatatgacctagaactaaaaatgtataaaatgattgtcctcaatagtccattcaaacaactatatgactagatgagatcaagcacttctttactaaatatatcatattacaatattagatacaactgactcaagtctgcatatatctaataataatagatcatgatgaggcaatgggtgtagaacacaccatcacccctaactcctaaatttaacaagaaagataaagaaataaaccaggctggtactagttgaatttatgacaaaaatatagaacaggtgattattgccctatggtctcatgtcaggatatttattcccagaaggtaatcacaggcacggtaactattcagcattaggaggcgaaggtataccatgttctgtgcttggaggaaaccatgaaacgtctgatatataagcaacttttgattttcttccaaaaaggaaacccagacaaatgtagtcctcgccatggatcacctaagagatatacaaaagtaaggaaaatggaaggagcaaaataacagagggtgatagaaaaatgcaaacattactggaaggggaacaaactctagccctgaggtcacaaatggtatctgaagatcactctcgattactctccagtcaagctgagcaactcgccgaacctcctccccttcctttagtttctttctgaccaagtaaggaaacttttgggcaatgctgttccaaattaaacatgtaagttagtacaaatcatcacttacattcccacttaatgacagttggcaggtgcgaaacaatgatgaaacacgagaagagcgaggcaattcaaacattattcatcatgaatacctccagtagggaagagttctggaaataaaaaatcaaaagaaaacaatatatctttggaacaccattttaatcaaagtttctctgacaaggtaggccagttcctttccaaatgttcggagcataccaaacaagtcaatacttctatcaagcctagaaagggtttgctgtccctaaataactaggacaagaatccacatgaccacaaaaaggagtttatcaactatcaacaataacatattaaacatgatgtatttaatatgttttactttgttgaccgaatttccataatgctgtaacttgacaagttttatattcactgtctaattttatggttattaagttgccaattaatctaatatttctgactggtacacaagcaggtctgcactgcacacaacacgagaaaaaagattactgtaggttggcaattacagtgtaatactttagttgaaagaataaaacaaaacaaagagtaaacaatgctaaaatagttaatgtggcacaaatccaaaagtaattaaactttagcacagcaagagctgcaagactcaaaaagtgcacggcatgtacacttggcaaagctcaattataattcattacctgtccatagcaaattgggatagataaattggagttggttcaatatcattcgtaggactaaatgactgtacaatccgaacatcatcaagacccaagattgcatcagcatgctcatgagtcagaataatctgtaatgaataattaaaatgtgttagtataggcataaacattgagcattttttttattattttacggtagattcatccaccgaagcagctcttattcatagaagtgagaagttgaagcaaaaaaaacaaaagaaaagaaaaggaactcacagaatcaacacaagggattttatgatggacaaaccaccgtagaacttgttctcggaatgtcttcccaacatcaattagaatatatttgtgtgcattttcatcttggcaatagtcaatcagaagagaagtattgcacctgtgcgaaccaaagtattaatatagtcccagaaaaatgacacataagcataatgttgccatcaaccattgtttgtgcaataatattccaaaacatctgagaaacaagcatggtgagcaactaactgttaaggctgacaattaccaaaaggggaaggaagaagctaagaatcggttggctagttggctccaaatgaacataatatgcatgatacaaactaagggggagtttagatccaggggtgtaaagttttggcgtgtcatatcgggtattatatagggtgtcgcatggggtgttcgggcactaataaaaaaactaattacataatccgtcagtaaaccgcgagatgaatttattaagtctaattaatccgtcattagcaaatgtttactgtagcacctcattgtcaaatcatggagcaattaggcttaaaagattcgtctcgcaaattagtcacaatctgtgcaattaattatttttttagcctatatttaatacttcatgcaggtacaatctgtgcaattaattattttttagcctatatttaatacttcatgcaggtgtccaaatgttcaatgtgacagggtgaaaagttttggggtgggatctaaacagggcctaagccaactgagaaataaatctaggcatatagaaggcattgaccaagagtattaaatgcatatatgagcacagatgaagtgccttttacatttaaagataagtatgtatatatttcatatttgactctaagactgattggttggtgcaagtaacatcacccaatattcagtaaaaaaaatcctcgaatttttgttaacataaacacaagacaagaaaaataagtcacttgctttgcttccatgacattgcacagtagcatcttgaaattgtgccccttgtttctcagtttctgcatactgaaatatggatatctcaccactatgagtccatcttattaaaattccaacatattgtttactcttacagaggttgagcatgactacccactaagagtactgattgattgtctgagtccaaaatttccgatcaatatcttgagcgcgccataacacatactgcaggttctcctaattctcgaagcatcaataacttaaacaatcactcagaattcactttgcatactactgctaccatctgctgcacagttgcagcaagcagccaagtagaaaccagcgcccatattctgcacagaatcagtgcgtgtgaatctacattctacaacaacacaggcacctctctcatcaacatttctcagctctcgagcgtaccaatcatacaacgcacaaaatcccattccaaaacccatccaccgcgcccaaaacagaagcggaggcactcgttccagatcaaaaagcgtgacacccgcgaaatctacacaaatgtacggaaccagaactcccaatccatccccacgatgatctctgatccacaccgaccccgtcaaatctctcaaacaaaccccaagccgcaacgcatcagcagcagcagcaaacgtgaccgacaccgcccgattccctagaggaagaatttactcatgatgtatatatacctgtagttagggtttagctcgggggccacggagagggactgggagcagacggcgcagggcgggtcggggggctggatcaggcaccgcgcgttgggcacggcgctggagcagcccgtcccgaggaacaccagcgaggatgaggaagacggcggcggcggcggtggcgtcc

SEQ ID NO: 13814 - DNA, 6761 bp, Oryza sativa
  unsure (1)..(6761): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccagcacgttaattcttgtgttggcgaatgccatagtaaatactacttggtttagccaactgctgtaattattgtttaagcaatttgttccttgtttgtggcaataatgatctcttctattctgaataaatattcaattgtatacagccaagttgatcagatttcagaagcaaagttacctgaaaaataaaatgcttcgatttgctccccttagcctgcagccacgatgctttgatcttgtaagataatgaagacgaataactaatcttggggatcatgaattgatgccattctgaatagaacgaataaataaataaaaatattcagttgtgcagtccgatttgattcagaactagagtagagttacctgataacctcgcctgaggtcgcaatgctttggagctggagcgccccgtgtcctctcccaccccatgacgcggcggcgtctcttcctcccgccgccgattcaaactgcgaccgccgccaccaatcccgactgccaagaaatgctagtcctccggcgatctccgccgccgccacctgaggcacgccaccggacccatgtccgtggcttcgtcttggaagggccggaccggggggccgctttccgccggcggcgactccgcctctccacgccgccgcggtgtgtggccggcgatgtgggcgagagactccattccgtcacccgagcggattacgagaatagcctgggcgtattctagttttcaaaacgtaatctaatttgacgctttcaacaggcccaacgaaaatgggcctcaatgacgagccatgggcaatttggggcctcatcggttactaacggtttatttattagcgataaaaataatttatacgaaaatttttatatacatgtattcttagcgaattaaagtcaataaaaaactatgttaaaatattttaaaatcatcttctaaattgaattttaaaatataaatttggcataatttgtcttaattctttttaggtgttgttcttttttcttgaagatgaagttttttatgcaaaacgaggtggtataaacgtatgattgattaagttttaattattacaaacttgaaaaatagattaatataatattttagagcaactttcatatagaaaattttcgcacaaaacgaaccgtttagcagtttaaaaagtgtgccacgaaaatcttaatattcatccagcccttgttagagaaaagaacgggaccttagtacaaccgatggggctcctgaagttatcaagacttctaaactccacggtaggacaatgtcaatgtggagtactggagtccaagagcctcatccgttccatcctgaaaagcaacttcaaatcggatcagtttaacaaaccccattgagtaatttttgattcagtaaaacattttaacttgctgcaaatagctttgagttcccacttccaatttgctgcagctgatgcaaatgcctctctcagaacttaccagtggtggttgcaacaattcacccaaattatcagtcagattatgcttgctgtagctgattcctatttaacaattcacacctcctacctaaaatatgtgattagagagcacgtagactactgctactgcttgattagttgcgactatgctaaatgttctagaaaggcatcacctgtcctctcccaggataagttactttttggtccgtttaaatttctagaatttttatggttttcttcctaattaacttcttcaaactgtgctagaactatgtatttgagatggcacttcacacatctcccatctgagtgagacatgtttaacgcggttggttatgagagtttctgattaagttcacattgaaaaccacatcgattctcaacgtgattctaatagaaaggttgcactaatactccacatattgtaagcttgtattctcgccgttacacaaaatgaaatctaaatttatgtataaatactaagaaaaaaattgagaagtaaaaatatattaaacatacatttttaataacttaactcaaaattcaggtattaatatgatatgataacttccactcctcctaaaattcaggtattaatatgaacatctagatctccttaacgggataaaggaacaacttccaccccttcagaattagagtacgtctgattcaggtattaatatgaccatctagatctaacaacttccacttccacttccactcctccttaacgggataaaggaacaacttccaccccttcagaattagagtaagtctgattagagtgataatgtcctcccaattgaaacatggtgctactttgcatttctccaatgtctccaaacaactaaataactatttacattgtctgaaaaacaactaaataattattgatctcattagttgattgatcctttatgtttacttatttacttcgatttactatttatatataagcataggctgaacagaaattaaacgctgcaatatagtttcagcgagaggtcatccagattttgttcttccatatcatcccgattgcatgtaagtggccgagatgacctttcagaaagagtagagagatggacacgactagaaatgattatattcttggtcatgcatatatgatgggcaacggtttttccaaacaaaaaatgctactgtgtccttcactttttcgcaatacttagcactaagctgttgagatgattcctgtcatgttataagtgttttactgaaccttacgatctcctggcagcatggattagcaggcttgcagcacctgattctaacttacaaatccaccttctcatattgaaaattagactgcattaatcatagaggagtagtttcccgcgtcgactttttatttcagtgtttaatcaactagtacaatacatgtcaaagttaggtactaaaactttacacatatatgcggagtggattttgatccctcgatgggatatcccctcgttgtttgcatgtcactcaaattgttatgaaaaaatttaagaagatgtattaacatgtgatatatcactccacaaacatgcaagtttaaattcaacttctacatcttgcaacgaaaaaaaaaacaaattaatggataaacaaattcaacttcataaatatagaaatttacgtaccatttcagaaaaaataaaaaaaatatatggcaaaatttatcccaaaacaacaaaatttgtgtaattggctaggagacatcgtaaaatcgtgtcgctgctgatggacaccacaaaattcgtatgatttgttataggacactcgagacatattttatcatttccaggcaaaaataggagagataaaattcaaaaaacacaattgtccagccctatctaacccccattggcacgaatggtggcggtagcggcggtggcttggacggcagctagctagcctggtggcgtttgcgatggtggtcagcaagttcggcagtggcaacagctttgacggcgacgataagccctgcgacagcttcaacggcaattggcaagctccacgacgacagctttgacggtgactagcaaacctggcggcgatggctggcaaacccagtgtcggtggcttcgacggtgactggtaagcccacaacggcttcaacgacagctggcaagcccggtggcggcggcttcgactgtggctggcagcggctttgacaacggcaggtgagccctgcggcggcggcttctatggcggttagcgagcggcactgtaaagcaggtgatgtcaccgaggatgaagtcacctgtcacctgtggggattagatagggtttagggcgattttgtcttttttaaatttctttcttctcttttttacccagaaatgataaaatattgccttgatgtcctataacaaattatatgattttgtggtgttcatcagtaataacgctgccactttaacaaattttgggtgttttgtggtaaattttgcaaaaaaaaaaatcgtttctaaccatttctgatccttttcatccctatttggatgagtctcatatgcaagctgcaatagggaaagaaacaaaactacaatttagtttcaccaagagctcatcgaatttgtgcagctttgtttcttccatgtcaatccatttcgtaggccgctctctgtttaggggagagagagagagaggggacaggaggcaagaacataagagattgttcatgtatatgttgtgatgtgcttgttatttatttatagatctcgcaccgtgatctaatttcattcgtttcttcatcagaagactcgtttgttttagtgtgctctactccaggtagttggtaccaggttgattaatgagcagtgagtaacttacggaagtaagaggaccaaattcgaatccatggctcgtaattcaaactaagaaattcacatcaagctcttgatcactaccagaagtataatatgcatatggagacagaaaaagaaattatcagaagtggatatatatcttagaatttgcgccatatatgaatgtttaggttgcaggttatatttttgcacattgcagcatcgtgcacgggtagaaaagagagatgtaaatcaaagaaaagaaccaccattgttttgttctcattctaaattcaaaagggaaaaatatttgaatatgagggaaagcaagtatagttgccttatgtctcagatgtatattggcataatcctgctaatatgtttgttatactcttattctcttcttaactagtgtaaaagggaaaaatatttgaatatgagggaaagcaagtatagttgccttatgtctcatatgtatattgccataatcccgctaatatgtttgttatactcttattctcttcttaactagtgtaaacaaattttaaaaaactagaacacaaccctaacataataactgtttttattatgccaacctaacataataactcttactatgcatggcaagaaatagatcagttcaaaaacagaaaataaactggttttattgcttctgattcgacttttttggattagacaagagagaatttgaagccacactagcccacaccaagttacactagaattgagtagaaaaacagttagaaaaataataatgttacatttggttttctccaatccctcgaaaaacttaacgtatatttatttgcttccatgtactatagtaccatgccatttatatgcctaggtcgaacaggctgcatatgtatctatctaaatattaaagtttcagtaaggtcatcaacgttgtgcagcttgatttcttccatgtcagcccatatgcatgtttaaaccacagagatcgagtcatgcacttgttatatatttccaaacgttctagtgtgatttaatttcatctatccgtagttcagacttcagaagcctcatttttagtgtgctgcactccagatagtcagatcaggtacctggtacaggttgatttctattattaattagtgactacttgttgtgccgcatatagtacgagcatcaaattcaaatccatggctagtaatccaaagtaagaaatttacagtgctcctgatcactgttagaagtataatctataaattacaagtggaggaaaaaattcagaggaagatatacacctcagaactcatacccaatttcagagttcatacactaattgtctgggatattcaggcatcggtgttaattggagtcggacaatgactatttgtggaaatgaaattttctttctgatccaatacaaataatgtggtatacattggaaaaacaacggaaccttaaaatttcgaaacttcggtaaccatagtgtgggttggctttatatgtgctcagaatttaggagctgattaattagctgaagctttcatcgttttccccttaactaagtcagccttacatagagcatcagtggttccaacttccaagacaacttcatgtgtagggagctgggaagaacctatatatcaaagtgaaattataagtactaaaaagatcatgcaaaagtaaaagagaattcacaattcattcagccatgataagaatgtaagattgtgctacagctaatgcaaagaatcatcagataagttcatagaataactcttgacacaacacacaacatagcggaaggaagagaactgattgattagtcaccacaccacagtgccacacacgtagtctaaagtctagcaaattcaggtcaaggatatcaaatttagtcaagagttgacttcaactacatacaagaaaagaaaaccttaacatcacctttgaaatcactcaaataaacatcaactttcttgccggctaaggaaccaaaatgtctgatttactaagcttttaaacacaaaatgatgtagtagtacttaccaaccgcaccagctgagcttttcaatccaggtgaatgaataaatttttcacattaagggaaatgtacggggtaattgttgcctgcatagcgggctgcaggaat

SEQ ID NO: 13815 - DNA, 1644 bp, Oryza sativa
ccaggctgccctggcaagtgcggaaatgtatccatcccttacccatttggcatcggcgctggttgttctgcgaccagcctgagcagctacttcaccatcacctgcaacgacaccttccagccaccacggcctatggttagagacctcctatcagaaacagaggtcatcgacatctccctggagcgtggcgaggtgcgcgtttacggtccagtcagttacatctgtttctcatcaaacaccaccataccagagaaccataccacagggttcaccctggagggtacgccgttcgtcccttccaccacccgcaaccgcttcatggccatcggatgccataccctcggcatcattggtggctacatgcacagcaactctaatctatatgtggctggctgctactcctactgccagagcatcaacagcacatccaacggtgctccctgcactgggatgggctgctgcgagaccaccatcatcccagacctgaaggacttcgcagcgatcttggtgatgaaccagagcgcggtgtgggaattcaacccatgcttctacgccatgcttgtggaggccggatggtacagcttcaggcagcaagacctcgttgggcacctcaggtttgtcaatgggagggccaacagaggtgttcctgtcatccatgactgggccatcaggaatggctcctgcccagaggggaagaaggtgcccaaagactatgcctgtgtcagttcaaacagcaagtgtgtgcaagcaagtaatagccaagggtacctgtgcaaatgctctgaaggatatgaagggaatccttatcttcccaaaggctgtcaaggtaacatacatataaactttctctagattatatttggagaccaagataaacaactccaggaataacaacataaccagaacataattatagccagttttaatgctgctgcgtaatatttattctttttgttactccctccatcccagaatataagtagttttagagttagacacggttattaagaaagtgtgtagaattaaataggaagaggttgtaattggttgaaaagtggaggtaggtgggaaaagtgaatggtggagggttgtgattggttgggaatggaatgttggtgaagaagttgctatattttgtaacaaatcctaagtgctaaaagttgttatattttgggacggagggagtacctttttttcagcttccgtaacaagccaaaatagttcaagctttgattgtattatcccaaatacatacttgtctgtttcaattctattcagacatagatgagtgcaagttgcgtaaggaggatcccaagtataaagagctatatccctgcagacatgggatgtgccagaacataccaggaaactatttgtgcaaatgcggggtaggtaaaaggccagatggaacaaactatggatgtcaaactgtgcttaaccaagttgaacgagtgatagcaggtaaggacttaatgagactcagagagtatacctttgggtgaaactaatgagctttttcaggtttacgatgagttgattcatcttgaaaaatcattctgcaggtctcagtgtttccgcagttgtgctgatggctttgatatgcttgctggtcatgaaattacaaagaagaaaatataggaaaga

SEQ ID NO: 13816 - DNA, 6450 bp, Oryza sativa
ttaaatcactcaatatcctactggatgatgaatataatgcaaaagttgcagactttggagcatcaacactgaaatccatggatagaaatgattttatcatgttcatccaaggaactcttgggtaccttgaccctgagacttttgtcagtcaccatcttactgacaaaagcgatacctacagtttcggagttgttcttttagagatcatgaccagaaagaaggctctgtacaatgatactttgaatggaaatgaggcgttatctcatattttccccttgatgttccaccagaaaaggcactgtgatatgttggattttgacatgatagacgagaaagttatggtagtactgcagaaactagctgaactcgccatgcattgcctgaacccaagaggagatgatagaccaacgatgaaagaagttgcagagcgcctacaaatgttgaggagactccacatgcagcttgtctcaaaatcgagtcctaccagagtttcttgctcgtatgaaggatcatcaatgcgtattccatcagacccgatgaaataccagagcatggagacagccaagctggtactggatgcagatattgcaagatgagaacagtatattcctttcatcgagtagagtaataagtttcttctggtgttgcaaggtcactctttatgtatattaattctttcttatggctaacacagctgtagtatgtagaatgtataattgcacatcaattctcatcaactatgacgtactatgcgaagtgatgttttcagtcataatgatgaactattaaaaatagaacattttgattttttttcactatctgttaatcagatcaaactacaccatcaaagtatcaaaccatatccaagaatgcctgtttcaacagattccacatgtccaggtaacataacatgtatgaatgaccaattaaaaaccatttcgtctatggcaaaaggaaatgatgctaccagtgtaatctactaattcaaatatctagattatctcattctcttgcatatcgatcctattgattgattagcattaggccctgaaatgtaaaggtggtgacacatctgaagcaggtttttacctgatctgatctgaactccggagttcgcatccggtgcccgaaagaaacttgcttcgcttgcttgcttgatctgaaccaccgattcccccctcctcccctccgtcaatccatccaaccgtgggccgcgaccagccagccaccggagacccgaccccgatcgcgtcgccgtcgcgagccagtcgatttcccaaaggaagatcctgatacccgaagaaagatctccacgatttggatggggaggaggcagcaacggagcgagtcccagtaagggggagatctgagagcagctgcggcgagcgggaggagagtggccgccggcggcggcgcgccggcgccgggagagccacgcgccgccgagaagaaacaaaaggcccataaatcaaccggcccaacaacaatgagcctcacgcaaggtctcaatcccattagttgggccacacgaaagtcgaaatatcaaaaaagtccatttcgagtccctcaagtggagggagttaatgtggactttttttaaggccgcacgtgaggtgtaatcctgttcttgggccgcacgtgatcgagatctcgttctgggcctaactagtatgaggccgcacgtgcggaagccgcaatccccattgaagccggcaatcctcgccgccgtcgccgcccccgtcgacggcgatagcctcgccgccgccgccgcccccatcgccggcgaatcttccagtggtttggtttgcttctctctccctctctgcactgtctccgttcatcgtacaccacaaaaagaaattgggggattttctactcaactcgggcaatttccaccaagctactaatttgccatgtataggaaacttcaaggttgaaaatctctgcaactgagcgcgtattatcgtacaggctgatgtgtttgccaaaaagtagggaaacatcaaggttgaaatctctgaatctgagcgcgtattaacgtacggatgataacactagtcatagatacttgtagggtttgaatttctctagccaatcacaatttacaaatggggactagagcaaattattaagagtcaactcagcccatttttcaattccaagtttgcagctggatatatctgcttgcatcttgacttgcttggattgtgatggatgactaataacagattaaagagaaccacacctaattcatacatctatttaaactattctagtgtgcatacatcagttcatcccaagaagaagataacacgataggcaaagaagggatagccatagattcttgttgctaggtaagccagctatggcgcatgcacagctgcttgtgtttctgataccaatggccctcttcctgaagttggcaatgccggtggacggtgccatggcgatgccgggctgcccggacaagtgcggcaatgtggctatcccctacccttttggcattggagaaaactgctctgcgaccaacctaaacagctacttcaacctcatgtgcaatgacacctttcatccaccaaggccacaaatccgggaaccggaagcacacatcgaggtcaccggcatctcactggagcgaggcgagatgcgtgtgctcagccctgtcaaccacatctgcttcacgtcgaacaccacatccaccaagtccagtggtgtcgggtatgacctgagcagaactcccttcctcccatcgccgtcgcgcaaccgcttcacggtcatcggttgcaacaccctggggctcatcactggctacaggggtgcctcgggacaatacgtgactgggtgctactcctactgtgagggtatcaacagcacctctgatggggcaccgtgtgccgggatggggtgctgtgaggcttccatacctgccaacctcactgccttcgccgtgacatttgatctgaaccacagcaaggtgtggaccttcaacccttgcttctactctgtcgtcgccgaggtcgggtggtacaatttcaagaagcaggatcttgttggtcacctcggattcatcaaggaaagagcccagaatggtgttcctattgtcgctgactgggccattaggaatggctcatgcccaaagaagggggaaaaagaacctagcagctatgcctgcgttagtgcaaacagctattgcacggccgtgataaatagtccagggtatttgtgcaactgctcacaaggatatgggggaaatccttatctttcagatggctgccaaggttcagcaattactcaaatttacttgaattttgttacttattaaacattgatttagtaggctgaactgaactcgtattttgtttgattttattgagtggttatattgttcttggtatcttcagacatagatgagtgtgagatgcgtaagctggaccccaagtatgaagaattatatccatgcagaaaaggggtctgtcagaacacaccaggaagctacatatgcaaatgcaagaaaggaaaaaagtctgatggtacaggttatggatgccaacctgcggattctccagactatagaatggttgtaggtgagcgccgtgtatataacagttcaccgttgtttcatcttcataaataagtgtctgcagagtttcataagtgaacatctaaggatcagtttcttgtgatgacaaacaaattatataaattgacttcctactgaataggaaaactaataatgaatgctctagtgcagttttgtttgcagctctgtataatctaaacatttttaatatgcaatgcatgtcccatctatttaagatattcttaatattcaagtggcattctcaatttgtttaatttatgtcctatgcatgaacatggaataagaggaactcaaacttagtatatattttttttcaggtttaagtgtttctgccattgtggtaaccgctatggcatgcatgttgattatgcaattacaaaggagaaggcacaagaaagagaaaattgaatatttcaaacaaaatggaggactcaggttgtatgatgagatgatatcaaggcaggttgacacaatccgtatacttacagaaagagagataaagagagccactgaaaactacaacgaagatcgagttcttggatctggtggccatggaatggtctacagaggaactctggatgacaacaaagaggttgccataaagaagtccagagtaatcaatgatgattgcagggaagaatttgtcaacgagataataattttgtctcaaatcaatcacaggaacattgtgaggttactaggctgttgcttggatgtggatgtcccgatgttggtgtatgagtttgcgcacaatgggaccttatctgagttccttcatggtactgaccacagatcaccaatccccttggatctacgcctgaagattgccactcaagcagcagaagctttagcttacttacattcatcaacatctcgcacaatcctgcacggggatgtaaaatcagccaatatcctgatggacgatcagtacaatgcaaaggttgcagactttggagcttcaaccctcaagtccatggatgaaagcgagttcatcttgttcgtccaagggacgatgggctaccttgaccccgagagctttaccagccatcagctgaccgagaggagcgatgtctacagcttcggtgtggttcttctggagctcttgacaagaaagaaagccttatacaccaatgatttcaacaagaatgaatctctgtcgtacagatttctgtcgatgtttcggcagaacaaacaccaagccatgctagaccctgaaattgtggatggctccaatgtggtggcgatcgagaagcttaccaaagtcgttgtgcaatgcatgagcccgagaggagatgaccggccaacgatgaaggaagtcgcagagagactacagatgctgaggaagctccagatgcaggcaacctgtgatggcgaaaacgatcgtgatgtccatgacaattttggaggatcgccgtcagtgatccttcattttgatgagatgacagatagcagcatagaaacgtctaaccttattctgagcgaatgacagtacatcttgcaacatgctgcaacttcacttgaatttgtctgtgtaatgaggtagtaggatgtagttctgttgatgttatagtcattctttccattttattgaaattgaagtgttttagagcatacagtttcagccattcggcttgtgttgtactaaccatttgtttctgtcaatctaatttcttcgagaggcagtcgtgctaattcttttgctttcttcacatttttttgttttctttggagtgctgttcctcaccatttaccaaacaacctctcaccaaacgtcactagaacgggattggtcatctctaacgggcttaaagcatcatctctttcgggcagggcccccgtcactaagcaaaggtcagtgatgtgagaaaatatctcaatcgggcatccggccgtcacggatgacacatctcaatcgggccaacacaaaagcccgtcacggatgactctcatctctaacgggcctaggttatagcacgtcattgatgactctcatctctaacgggcctagattattgcccgtcacggatgactctcatctctaacgggcctaaattatagcccgtcacgaatgactctcatctctaacgggcctagattattgcccgtcacagatgagtataatccacaaaaaaaaaatttgtttgccttcctggtcggtcacccatccaaacctcacttgtgtgcctttccggtaggtcacccatcgggaattgctctagaccaagtacgtttaacctcatagttttttgaagattggcttccgagaaagaaattgaatttgttggtatgggtattctattaatcttattaagccctatgccaggatgtcacaccctagcatcccctattcatatacattcattcacataacacaaccacaatcacatatcacatatttcactagcaaatcgagttaattggatcaaatatatatttagcaagtattatcatgagtaggaggcaaatcagacttctaggaaaaaataaatttcgaattaaattttatgatactaaatgaactcatatgaaaaagctatcaaaaacaaagttgtagaactcattgagatctaccatttttattttggtcatttctccatctgggtttgattgaactatataaaatttgtattttaaaatataggaaattcaaatattttttgggtagtaaatgatttcaaatggaaaaatcatcaacaacaaagttgtataactcatcaagatctataacttttactttggtatttttttctatataacattttttgaacagtttgaatttgaatttaaaaatatgacaacttcaaacaacattttcaaatactaaatgatttcaactgaaaaagtcataa

SEQ ID NO: 13817 - DNA, 4509 bp, Oryza sativa
tcctgacctcgagtcaaaattttttcatcttgatctaatgcatccttctgtctacaaggtacttatcaaatactgcaattcagatatgcagtaagcagtaacgacacatgccgatgtttttccttggggatttgggttgcctaaactattgtataagatgaatatatttgtaggagaatgttgatttgttctgtcttgcattactgcttctctggtggttaaagttaacataaaaaaaaaacaggcgaaaaaagcttttcattttcttgttttctaataggactggttactgctaaattaggtgaatagcaattatcttatttgacctctgtaaatatcttatgtgactgttctacgtttcaggttggacttcaatttttgtctggtgttatatcaggtggcaatgcttgttgcgtagcaatgcttcttgctttcagagaggccataaaagattactctacaccttccaccaaaactctcaaccgagatcttactgctaaaatcagtagctacgtgtcatttctcatcgagtgcaagcctctttcaatcagcatgggcaatgctattaggtttttgaagaacagaattgccaagctattgcttacattgtctgagtcagaagctaaagctagcctacagtctgacattgatcggtttataaatgagaagataataattgcagaccatgtcattgttagccatgcaatagccaaagtcagagatgatgatgtattactgacatacgcatcatcctctgttgttgaaatgatttttgatcatgctaatgagcttggaaagaagtttcgtgttgttgtggtagattctcgtccgaacaacgagggacaagcactattgcacagattagttgcaaagggcatcagttgcacatatacgcacattaatgccatctcatacatcatgcatgaggtcacaagggtttttttgggtgcctcttcgatattgtcaaatggagcagtttactccagcgttgggacagcagctgtagcaatggttgctcatgcctttggagtgcctgttttagtgtgctgtgaggcgtataaattgcatgagagggttcaacttgattctatatgctctaatgaacttggtactatatcattcttgcttgtaaattaagttattgattaagctttcctcaagacttaactcatgacatgtttactcaggtgatccagatgttatttcaagagttcctgagagggaagatttgtgccaccttaaaaactgtacttataatgaaaatctacaacttctgaatcttaagtacgtgcctgaattccatagatgttatagctggtcattatgtttctcatgttggataatcaatcgaatttcgttcacctgataggtatgacactatgccttccgactatgtttctatgatcataacagaatatggaatggtaagatgtgttcctttctacttctaaatcaattcctcatgcttatattcaaatcatattatacccatgttaacttcgtttctttttgctgctgttttttgtgcttgtaatagttcaatataatgctatcatatgctgaccgagttttaaaattgttagtacagtaccacttggattcatcgaccttgagctgcaaatttgtctccctttcttgctaatgagtaaccacaaccccataactttaacttcagccaagtcaataatgaaaactttttttctgttaggttttgactaaatattgctctagaaaaaggcaatacttatatctagcagtataacggttgcacttatctatggcagggaacacttagctgaatatgttttgctattatttatttttatctttgttgcaagaaggaatctgctaggtatactgggtctcacagtcagtgagcaccagataatctctgatacagagatattctttcatttgattattgttagagtatatggttactggttaggattgataggatccggttgttatggtaggataggattagcttccatcttatctctcagggattgcttaaggtccaaaacctactcatcaaggttcaatatggcaattacaattgcgcagtacatctcttgtacacactttcaattatgtctatacccacaactttttttctaaaaatataactaagccacatatataagtagtcgctgtcatcttaaaaatagtaggaccagtattggcacaatattgttgtttttgtatatgtcctaacaaaattatctttcagaaagctgccttatttggtctaatagtcagatctgtctgcccccaactggccttggatttggacagccgtaccatatgcctcggcagatatgcgagctgtcttcaaactgatgcgttattttacacatgtgatgtaaactttatgagtcacatacctgattgcaataagaatggcatacagaaaagaaaaagagacaaaatataacatggtccttaatagttcaataattgttgactatgtctaatttgaactgtacttctctcatgagtgcaggtttaattgttcttaatctagtttggaatatctctatgccatctagtctttagttctttacactaattgctttctcattgatttatatatcttttgtttgatactagtctggtgtcttcaaaagtcatagttttattgattaatatgaggacgtgaccttcacctttcatagtttcatagtgaaaatactcgtgcattggctgcataacttgatcctacatcagtgctattaagagttctatgacacaaatagttatttctgaaatttcagttagtcttttttactagttggtgattctcgatgatagtcatggtctcatggatgaaaacaagcagttttgcttgcagttacttcccattatatttcttgtgcatactgtttgttttgtctgcataaccagtctgatattaatacacgctatactcaaatttctgcttttgttagtcttatatttctctaccactcccctactgttttgttcatcatttaagatggctgtctcatttggtccattgaattgatgttttgtcctgctgtcgcagctcccacctactagtgtgccagtcattgtgagagagtaccgcagggagcacatatggatatagaacgaatgatattttccttgatgatttaatgagttggatttttaatatgaggtatgataatttgaatatggtgtgctgccttggcatggtgttgcggtcttgtggacacctgattatgctttaaaaaaagaccaaaacatcttttttttattttctcaaccttgaaaggtgtgttatctcatgtagtttctttaattaagctgaagtaatccaaataaaaaacttcaatcaccattgctaagtatggataatgtgccgatgattccacccttcttcattaggtatatatcactgtttattccttgttatgtaaataaatcttctcacgtttgattaactcatggggtgttctttatagtagattggtacatgaggaccctacatgaagtaaaatatgctatgcaaacttacaaggtctaatgcagaggagttcacatgatcccaaatctagtcagactagaacatgataaatgtgatagaagagcatatttgtaatctttgttaatcatgatttgcctcatttcatctaaaagtgcttttaaatcttttaatttttgttgtagttttgtaggttcatctataacttgcactgacaattggaatacttaatcatttaggcgagagcaaacaaccagccaacaaggaatgcagttttggatgtagataggacgggtcatgcaggaaaagtctcacatgtgaacagatgctagatccaaggatttctagctcgcttgttatcttcagtatttgtattcatactaaatgtgactgttgattagtacacagacttgttatcctgtactgaggtgaccagacatgaatttcaatggcacatcagttaacaccgcttttctacttcatcaagcgccctgggtctttttgaacttaatattaactgcgtttttcttgttaattgttgatgtaccttgctggtaaaaatggtgttacttttgtccattttatttatatgtttctgttgttttgctaccccctataaaactcaatggcttcagagcccacatatgttttctgcaggtactgtctatcagcatcatcgtttgagttgtgtggtcacccttggtccaatgcgcacatgaacgctagtcctgccaccagcaagggatgttcatcagtagtcatttgaacagcttgttgtcagtctacaagaatggaccctacaaataaatcatgcatctgagttagatctatgtcactttggtcattgaaagctcatcaaatcaagggctcaagttttaagtggcaccaggtggtggatggcctggtgaattactgttgctccacactcggtggatcattactgcggacctaatgagttctcagtacacactaatgggcatcttttggtggggttcattgctttcctttaagcctgctaa

SEQ ID NO: 13818 - DNA, 6907 bp, Oryza sativa
cctgcacccccaactatcattgtcaattcaaggtcatattggtgtccatgtctgccaaagttcttgggtacaaggactgccacagttctgttcctggctgctacgacaggtatgagtaaacaaacattttgactccattcatttcctttaattcatactgcacattacccagtaaaaggggcttgatcgatcaatgtcaaataggttgctaccatagcaaaatagctacccagagttagttccatgtcaaatatgttgtttgcaccatttattagatccggtcaaaatccaggaattgagaggctacccagaattagttggcgccaatgaaaaaaaatgataggtgaggtggggatgcccaactagaaagagttcttgaaagctctcttttttctcttttgaaggaaatcaatcaccatcccttttttgtttgggtactgcttggggggcatagagatgacaaggcaagccacatgatctgtattacttttcttctctcctccaaagctgggttagccatgttgatagtacttacaggtcgtcctttttttaactggtagctccagggcatctaggcacatacacacactgcgtatcatgtggatgctcaaacaacagtatgacaaactccactagtagaagtagttgacacatgaacaactgcctaatggaataaagatagatagagatagacgccctggacaaaaggacgggcagacaaattagggataatccaaaacattgtactacctcatgcatatggtgtacgaaatatttcatcatctttatatcttcagcttgcatttatccatccacgtaccctctttctccatcactagaaatcctttttggagagtcctacctatcactccaaaatcctcaccagaactttgatatactatttagagaactccttgcctaactgcaggccttgtttagtggagaaattgtggatcaattcgtcgcctgatagctgtaaatcctaaaactcctgtagtgcggaaaaataagagaaatcctcagaaagtgacttgttgcagcaatctcggcttggaaggtaaaaatattaattactctgtcattgtctccatattcttgatcaggtatgtttttttaactagctcaaaaccgtagcatagcatatcatatcatgggtgatgttgagaggagcatatgcaaggggggccctgtcacaaatgcgagtggccaagagggtaccaaatgcaagaggaaccaatagtgagtggtactagcagactaatagtaaggttttcacaaggttttgttagtgaggcctcctctcctcttctgctcctgtttaggttccttattatgtaccaacatactcctgtcttgcacgcttgcacgtgttccttggtatttgccccctgaccaatcagagattcagagacaccctctttcctatcttggctccacatggacatggacataaacatgaacatggacatggacatgaaaggaggaagggaaaagattatacatgctactactggctactagcagctgggactgggaggagagctgctggtgttctactagcttccttcctttttcgcatacgacgatcacctttcaatttcccccatcaatctttctggttactggcactgcattcttctgtcgatccttttgtcttgttactgccactgttcactcttacttaacgcactggcattactagtgaggagtatgctagctttagcgtaatattttaaggcaagttgttcacatcacacaaacatgcatgggatccacaccatgcacgaactgcagttttaaatttgcccaaatatctactactgtataaactcttgtgagatgttcccatggcaccatgatctagaatgacgtggaccgtcctccttcaagtcttagtataatactataacactatgcctccttaaaaatcacagaattgggcaacattctaaattcctttagctgaaactctgcactatacttcggtttggtggaggccacacgctgtcaatgccggtgtggtggttgctgagctggtgggcgacaaactacttgaaaggttgtagcggatctaggcgtaagccttgctcagtggatctccgggccggcagccttcgggccggtagcggatccaggcgtaagccttcgggtgtcgtaaccctcttgggggcgctgtcgagggtatctaaaccctctctccctttcttagcaagttttctctgggtgaaaaccacatctttcttcgatgggcgatgtccttgatgttgtgatgtccttgatgtcttgaggtaggtccttgatgtcatgacctccctggggcatcgtttttgcagtcttgcctttgtggtgttgttgtaggccgggcagcgatcggccacgcttagcgggggtcgttttggtgctcggttccacttgcagtggtttgtgcttgtgtggttagcgtgtggttcttggaggtgcttggtgcacgcccgacctcgacaacttctatcgtgttctttcttgtaacttttctccttaatatattcggatggcctccttcggccttcccggcgaaaaaaagaaactccgcactatacttgctgttgttagcaatagcaggagtatttcttaaggtgaaatgtgattgtccatgtcatctagaaggctataattgggcaacatgagactatgagagagccccatatacatgctttcaatggtgtgtcccttaagtgtcttgtgtggccaaggcatgctattaattgccccctaattttctgcaaacacatggaacgcatcagatgcaaaacacatgcctagctaggtacatacaacatgacacatgacattgaatcaggtcaccaactataatctctgacttctctgtagcaatgatctagagaactactactagtagctagctcctttttggtgagagtgtagtaagcaccaaactctcctgtcgtcttcctccgtggctgtggctatggtccgggcccccagtgggtctggacgtcctagtacacatttgcaattatgcaactccagatttagacattgtggcttctcttttttttgccaaaagctcctcccccaactatccacctataaacagcctccttcctcacttgatcacccacccgctcatcatccatttctcatcactgagctgagctcagttcagttcagttcatggaagtatatctccttcttggcttcatttgacaacttccaacacaagcagaacaaggtgatcaaatcatcctcaaggcttgtcttttttttccttctctggttatctccaatggaggctcccccttctctttccatcgtcgacgaagacggcttcgtcatcgacctctcgctgacgctgggcctgacatcgcctccgccctctccaggcggcgcgtctccttccattcctccgggaagaggcggcggcggcggcacgagtggtggtgacaacaacagaggcagcagaggtggtggcaatggtggtggtggtggtggtgtgaggctcttcccttgcctcttctgcaacaagaagtttctcaagtcgcaggcgctagggggacaccagaatgcacacaagaaggagaggagcgtcgggtggaacacccacctctacctcccggccggcgtcgccgccgccacgacgacgacgacgacgacgacggcgatggccgtccctgacatggtcggcatgcccacccaccagatgtcctccatggcgttgcactcctgccggcctcaccagggctcccatgtcaccgccgccgacatcgccacgctggctgcgccgccacattacaccgtcgaccatggcgttgccggcatcgccagcggcggtggtgacagctcggtggggtggcgccaaaggcaaagggaggccggcggcgagaagcagaggcaggttgatctcaacctgaagctctagctagtagcttaagttgttgctcatcatgctgatctgtgctgagacgatgatcgaggtaggtgctgtgcttttggtttgtttcttcagagattcttctttcttttctttcctttctttccttggttatttcttcttcgtcgtcttcctttgagagctagtgtgcgtagtgccacgcaagtattttctactggggtgtacaattaagaataaatccgtggccattgtaaattaattaattatgctgttgccttgatcaaaagtgttgcactctttgcacacaaatgcatatgcctttgttgtgttcctaattaaccccctctgatttgatgttagctgtttcttgaattactcataattttttttctaagcttagatcatacagggatgatgcagtttctgttaagatgcactcttatatccaaatatatgcatctggagatgattagccagagtttcaagaagattcgtatatatatccctgaagaatgttttctggtgagaactgatgaacgacaaaaggtttaatttgctgatgacttaatgagactaataacaaggattatcatggatgaattagctctaactgcaaaagggatgaagaaatatatgcataaaacattctataagcctctgttgccatttgcctcacgagatccaaataatcccatatgtagggcccgatttattcgagttgtgcgctgagatcgatccatgcttgctactagtagttgtgaacccaacatcaattattttgacgtgacaaatcccttttaatgtttttcatgtctcaagtcatgtttactttcataaacagagtaacaataattcaagtgtgcctgtacatgaacacatgcgcttcatatcttttcagttgagtattggagacttaatttaattgagtttcaatatgaaactcaatagatatgtcataaagccccattttttcggtaacataaaggtcctacccatgatagattccattggtctttttgtctttcttctctgctgaagaaagggatagcctacaatgtttcttgcaaagttattatacatgttacagaactatgttagaagggtgctgaggctgtgttagggtgtgttcggaactacaagttcttaacttgtgctctcttgttttatgtgcgcacaattcctggattattaacaattcctggattattaaacgatgtatttttttcttaaaaaatactacctccgtccctaaataagtgcagccgtgtatatccgtgcctaacgtttgaccgtccgtcttatttgaaaaatttgtgaaaaaattaaaaatatttagtcacacataaagtactattcatgttttatcatctaatagcaataaaaatgttaatcataaaaattttttaaataagacgaacggtcaaacgttgaacgttaatagtacaaaactgtacttattttgggacggagggagtacataataaagttgatttaaaaatcatattaatttatttttaaagtttttatagctaatatttaattaatcatatactaatggccaccttgctttgtgagtttgtgtgtatgggagaaaagggttcttattatataatgtaggatatatgataagtgtgtcgattaagatgacaatactaaaaagaactcttctaatactcttcgatttatgtttttctaatgaccgtatcaatctttctggacataggcaagaattaatcgatttgtatcacgaggggaacagaagctgcatttgaattgaaaaaaaaaaggagacaaaagcagtactttggcagtagtcacttgtcacagcaccaattatatgtagttgcattatttaatttctgttcatgtgtactatgagatgtttgttagtaattaaaaaagaagtattccgatctcttcatgggtactcaatggggctcccaaatggcctagaagcatattactaaattaaggtcccgtccatttctccagtaagagttggataaaaataaagattttcgtgacatgtttttcaaattgctaaacggtgcgtttcgtgtgaaaactttctatatgaaagttgctctaaaatatcatatttatctattttttaagtttgtaataattaaaactcaatcaatcatacattaataccacctcattttgcgtaaaaaacttaagctttatctttatctttatcttaaggagaaaagaaccccacctaaggctcgttccaagcacaggaagtttatagaatttgcaagaataaattcattttcttaaaaaaatctcctttacaatttttttgttccagattaggcctaatcaaatttcaatttatcgttgataaatgctctagttacatatggtgcacatttcttcaaagttacaacctgcaatgatctgcatccagacatcaatttgatgcactgtccctcacaggcatagatgttagccaaccacccaagaaataactactataaatccaaacttgattaaatctcacaaagattaaagaattttctactctgatttcctccggcatgccaattaaggaatgtgagaggggttggacctggctaggaacagatatcttgtttttttctatgaaaaaaaaattatgttccaaataaagcattgtctcctcggccagttggcatgcacatatggaggcagcagcatctcccagtttcggccccagccactgtgtctgtggctcctgctgctgctgtcactgtgccacatatgatgtgctgcaagtcactgttgttggtatgttgctacaaccaagcagctgtaaaaagaagaaaaatgctatcatctaaaaagggaagaaaaaggttctcatggaataaaattatccaaatcacctgcaaaattcctctgatccaaaaaaaaggcacagaaatgtacttcctccgtttcatattgtaagattttctagcattgctcatattcatatgagtgttaatgaatctatacatatactccctctattttttaatagatgacgcc

SEQ ID NO: 13819 - DNA, 8934 bp, Oryza sativa
aaaagtcaacggcgtcatctattaaaaaatagaggtagtatatgactagatttattaacacacatatgaatatgggtaatgctataaattcttatattacgaaacggaggaagtagtgttctgtgataaaaatttgatgttacgaacaagattatatcaaactcttgaccagtgacaactttttaagtacttatagttttacatttgacatgtataaatttatcttgacaagtactaaattgtgataaaaaaaattcacatggctaataccatgaacataaatcatatattttcaacgtgtattataaactttgtagccgttaactttttatgactataattggctaacttacaatcattaagcaattatctatagtgcactttggctgatgatggagttctagagctccgtagtggcatggttgcatggcagaaactttatagatgtacttttcatgtattatttatctaataagtaactttttaacaaagaatacagtcatactcttcgggcccatttaaatcgcaagaatgaaaaaaaaaagaaggaatagaaaatacgaaggattcaaataagaatataaatgtaaaacagagaattgaatacagaaataacataagaatacttatttgattggagcataggaaaaacacagccggatgagagagatatactcgaaagaatatttaaggttagacctcactggtggagaagtgctttttagtcccggtttataaagatcgctatctttagtcccgattcaaatacccgggactaaagatcgatcaccaaccgggactaaaaagagggaagcggcagtgagatggtcctcttttctttttttttcttttttattttctcccgaattgagtgggatatatatcctaaatcaaaccccaaatcctcaaatcaaagtaacatcccaaatctacatcccaaatcttaaaattacttatacacataaatcaaatacatcacaaatcctacaaaaattacaaacatatcaaatacatcacagatccatacaaatgtgcaatgaatcacaaaattatctatacaaatgtgcaaatgggctgccgccggccgcctgctagccgccgccgggcgcggccccaccagccgccgccgcccgaccgcgcggccgcctcgttctgctgccgccgggcgcggccccaccggccgccaccaccacccttccgccacacggcggcctcgctccgctgccgccgcccgaccgcgcggccgcctcgctccgccgctgtcgcacggccgccgccaccgtccgccgcacaaccgccgcgcggccagctcgcttcgtcgccgccgcccggccgcagcagagaggggaaggaggaggaggaggcggggagggggatcggaggagaggggaaggccggaagggggagggaggggagaggaagaaggaagaagggatgaaggcggataccgagacttagtctcggtggtttttaacgaaggagataaaaaagggaggtgataccgaggagatatcggcagtttattttggtcccggttggtataaacaaccgggactaaaaatagatcttataccaaccgggactcaagataattggagcttaactgtacccaccaacttctttgaaccgggactaaaatgatctttcgtcccggttggtgtaatcaaaatttttttaaccaggactaaagataagatcatctttagtcccggtttttattgcaactaggactattgtggaatttggtcgaccgaccaaagatggtttctccaccagtgcctcttgttaactttcctccaaaatctctataagattacgtaatccgtaggaattttaaaggatataatatgattcaatcatttgtttcaaaggctttcataaaatttttttttttcataggattaaaatcctctaaatctactacatttttcttacgaatcaaagagccttcatgtattaatgaccggagaaaaccttttcttttttccaagaaaatgatgttacaggaatttttgttggcagtgccactctcattaactagagagggctccacatcacagtgacagtatctgttgccacttgttgtttgtcggcaatagtattaaattaggtgctatatggcgaataatctgtccacgcaggcatctatatgctacaacagtgcaacatacggaccgttcctattctggtaaagaccattttctgttgctccagttactttcgtacggcagctgagttggcattgtctgctttccacagctaacttgtttgttactaagaaggctgttcagattgatgctagttttaaccatacattttttatatagttatcaaaaatatgtctacgtttagtttgttactaaatttttagtaaatgcataagaaattctgctaaaattgttaacttgtcaaaattttggcattgccaaattactttagtaaggtttattttgattataatctgaacaggccctactataataatagtgtttttttttctgttctttcacttttcactatagtaaagcaattagggagaaattcatggatcattatcctacttctatttagatcattatcggcaaaatacgtatttacaaacaaacaaactgctgcatgatgtgatagaattaaaacggcaacataagagcatctccaatagcctctccaagtgactctctaagctaaattttaatcattccaaccaaaaaatgtgctccaacagcctctccaactagatggttaagccatccggttggccgaaaccctccctcttctagccaaatttggtcagccaaaaatcactggccaaccgtaggccccacctacatccctcctcccatctcctctcttgcatcggctagctcgctgctggcccagcatcgacgacgacacgaaggagagaggcgccggagctgcctccctccgtttgcataccccccattgccgccgtcctctgtccagccgcgaccaccgccgtctccagccgtgcgcgatcgccaccgtcgtccgcatcgtcgatagctgccggattcagccagccgcgcgacctccaccgcctccacgtgatctccgcccccactcggtgaggatggcctacccaccgacggcggcacagacgatgccgaccgccgctctgccctcccctccctttccctgcagcggctcctcctccttggtctgcccgcccagcgccgacggcttcttctcctagtgcggcgagggagggagggagcggcggcagggtggctcgatgccttcgccaccgcctccacaacatcgccgccgctgaccccactggcatgagcaatagcaacgtcgccgccggtttgaccctttgccgttgatgccgtccgcgtctccgccaccaacctcgcctcgccgcgtcactccgtccgccttcggcctcgtcgcccgtagcagcctccttcggcaagagagaggattggagagaaggggaggaagaagaaaaggaagagaatggcaggtggggtccattggaatgtggagagtctgttggaatagaagaaggtaggctggtcaaacaggtatttggagagtcaaaaatagccactttgtaagagatgctctaatgctccatgacaaaggggagaaaagcgatagcgtgcagtaagcatcagatccccacatgacattccagatgggaaaaattattgccgcaagaactgtttttcttttattttcttttcttttcccaacaagctaccaccaagctgatggatgattcagatgtctcatcgcgtaccttgacacagattttttttttttgggcaaggatcaaaaccgaaaaggaaactgcgtgtataaatgttcagaggatgatgccatggagatcactcaccaggttgatcgtcttcttcctttggccttcttcctcatgagtgaacccttcatgtccatttgacgccatggccattagcagcatcagcatcagcatcagctgggcaggcatatctctgcatctgcatgagatctttgccctgtcctccactgcctcctgtcgccaggaactactactgccccactgatgcccatcatctccaacagagggaagctgctccctacatcttcctgtaggcctgtgaattgtgatcatggcctcatggccatggatgggatatgcagcagcagcagcagcaacacatctggattctggacagatgtccatgatgaacaatgcaatcgcctcgatgacgaccgtcggatcggcgatccgatggcgggaacaaatgccacgtccaccatgcaagggagaacaggtcaggcatatcatgatgatttaacagaaggcagctacaggtgattaaacacaagaaaaatatcatccaagatgctggcaaatggcatcagctcagggggtaccagcaacagaagagaagctggagccatgtccatgtaaccagcttgtggtaacacttggcttcccaaacatatggtagtgcaaaagtttaacatggagcaccaaacatatagtacagaaattgaacatggagcaccaaatgtagcaggaagaacagagagaccaataatgcatgggtaagggtataactttagtgttggggaaatagaatacagtgtctacgccacaatggaggtcactacgtgacaagacgaacaaaggacagtggttctgaatccacaaatcatgatgttcaacaatgtcattaagaattgaattattggcagatctgctcgacagcggccacaatttgggcaggctgcacgacggttgcgtcctccagagttgcagcatatggcgtcggtacatcctgtgatgacaagcacatgatgggggcatcaaggtagtcccagaagttatcaatgatggccgacctcaggctggcgccgataccacccgttcgcatgcactcctccacaatcagaacgcggtgggtcttcttaatggagttccctatcgtgtgcagatcgaatggtttcagcgacctgatatcaatgacctccggatcgtaccctttgttcaccagtgtcttggctgcctgcatcacatggtacctcatgcgagagtacgtgaggatggtcacatgctcacctggacgtaccatctcggcctcctccaagcagcaaatgtattcctcatcagggatcttctccttcaggttgtacagaaggacatgctcgaacagcaccacagggttctcactccttatggcagccttcatcaggcccttagcattgtaaggagtagagcaagcaaccatttgaagtccaggaatggactggaagtacgattcgagacgttgtgaatgctcagcaccaagctggcgaccaacaccaccagggcctcgaatcacaatcgggatcttgaactggccacctgaggtataatgaagcataccacaattgtttgagatctgattgtaagcaaggagaaggaaacccatgttcatgccttcaacaattggccttagccccttcattgctgctccaactcccatgccagcgaaagaattctcagcaataggggtatcaagaacccgaaggtctccaaacatctcagccaagcccttggtcaccttatatgaacctccatagtgaccaacatcttcaccaaatacacaaactgtaggatcttctttcatctcttctatcaatgcttctcgaagggcctcaaacaacaggacctcatgactgcggaacaaaatgttaatgcagtcaggcgacttttcagatcaactacatgcaaatgatatttgtcgcaaatcattctgaagatttctttatactttgaaggtagcataatggcattcaagaagaatatacattattcactcaactcttcaagcagtatatcagctgtaattattgtaacaaaatttaaacaaactacagttggtcagtgttcgtcgttggcattactgattggattatcctggcaagattagattgtgttcagcatatctaaaagaaaccaatgatcatgtaatatttatatgatttcatctacaacagtgctttactcgtaaattaacaaataatgtatatggagaaaataaagggtactttggattgttttttgctagttacaagctcgaaacagtcatcttttttttagcagtacccaaacgttcctggacaagttctggctgtcactaatttgcacttccctggcctcatttggatgggctaaatccctagcccatccatgtgagtggtccaggattttagacagctgcaaatgaggccttactgtagtgtgaaaccaacaaatagtctcctgtctgtcaaaatggatcctgactggtaaatgaagaaggcaagaacaagtccagttgcatggaagtgactccttatagactacttcaacgagatatcttattattgccacattcacacctataactttatgcacataagttttaatttcaatgagtagctgttgttcttcacaatcacatatatccaatttgcacaagctaagcaaatgttgtaaaccaaaccaagtccaagcaaaaacaggaccccctaagtgcaagtgccagacctgctgatgcaggatacatattcaactaaagtactaaaatacgagaatgaacagaattgtccaaggaaccagctacccaagcattttatgtcctctgcaaactagttcaagatcaagtagtttatctaccatacacagggcagcgtaaatatgtcttgtgtgatgtgattcaagctaaatgtaacacaactggctattaacataaaatggcaaatgatgcaatgccattgccataattgttccattactgggatcccagggactagttctctatttcgaagaccatatcattcaggacatgtgctacacttggctacattgttcaaacattaaactggtcaccaagtttggagataattaaactgctactgttcttttcctccaagtctggagataattgaaaacatgtgtgtataaattaactaggggaaaaaaaactcaggctgctttgttcatgcctcccagttaacaccactaattagagaaactaaatcaataaatctcatttccaccaaagttaaaagcataggtgcacagcaaagcaataaagcttcggattacaactttacaagccacaaaaagccagtaattctgttcatatgagctatacaatccacacacaagacagtagtaatcgtcaaaaatggcaggaaagctactccacttatacgattgcatctagaacaaaccgaatcgtttccccagtctgaatcaatccagaattccaggcgttctcctgatctcttctcttcgtgaagagcaacacaaccattttgaaaataaaatggaaaaaaggagagaaacaacttacccgccggacttggattccgccgtcgcatccgcactcgcctgcaaacacacaaagaattcagaattcagttaaggaattctgagcagaggacgaagaacaaagaacaagaacaaagaacccggcacgtaactgtaaccgcggcgcgcgctaccaccgcccctccgcgcgcccgcaccgacctcctcgccgcgaccacgcgcacgctcctgcctggcgcggcggatctgggcttggcggaggcggaggcggcgccgtgcagcgcgtactgcagcgaggcggcggcagcggtggccatttctctctctctctttgctcgctcgcgcgcgcgcgtggcgggacggcgagaggtctcggattccggcggcggtggcggctgctgcggcggcggcggcgcggggagggggtgttttatagtgtgaacgcggcgagcgcggcggagatggaaacgaggcggcggagagcacgaggcgaggaggaggagggagttttttgtcgtggacccggtctatggaccgaggagaggtggggcccacatggagggtgccggttcacgggggatgggtgcatggaccgggtgcagggagagtgggagcctcggttgcatcgacgggctttgctggtttttgatggacctggtttgctttctttgggccgatccattaaggcccaattaacaaggccttcctttgcttctacgaccattatatatatgggctttattctgatttctttctttagagagaaatacttcttttgagatgatagtcatatgtgacataaatagagttatgaagaacacaaatgtgcaacaagaagagccatttaatggagaagaaatagtcatccaatgcaaattgtagtaaagaagatttaaatcaggtaattagaggtgtacatccagacctatcaccgattgattaatgctcattttatatctaccccagtttctttttcacttactagctaatatgcccatgctttacaaggataaacacacatctcattaatttttttagctcttatcaatttatcatggagcccttaaacaaaaatccgatcgaactacccgttgagaagtaggacgatttttccgccaatgtatggcttaattaggggcaggcaaaagtgtattattttagcaatatatagactcagtttcactgtcactactatgttatttttaagtagtaaattaagattctgagctaaattatacactgttcatatcttactcatacagttccaaacaaaccagcaggtgggtcctgacacttactagagttcatcaaaagttagcttacttctagtttcttctctcttgtttcatataatccctggccgtgtacatagtgatgagtatgaaaggagaatataagaagattctagaaagtagaaacctctaatggtgttaattaattgatcacataccgtacataaatggggctgttcagattatagtcaaaataaaaattaccaataccaaaattttggcaatttggtaatattgccaaaattttggcaagatttattatgtaattaccaaagtttggaagtttgctaagaaactaaacggatgcacatatttgacaactctaaaaaa

SEQ ID NO: 13820 - DNA, 5674 bp, Oryza sativa
caactccatagaaatcacaaaacccaattcaccaaagccaaagcaagaactagatcaagaagagagaagaagccaagataatccagcagaaataatttcagaaatctatagctagatagatcatagatgctgcctctgctgaacatgcaagctgaagctgctggtggcgatggtggtgatgcagagaagaagagtggcaacaacaagcagatgatggtggcggcgaaggtgtccatctccattctggtgatgtcgctgccggtgctctacgtctccttcctccgcatcccgccggcgacgctcttccgggacaccaccttctggttcctcatgtccaactccatcatcatcgtcatcgccgccgactccggcatgctcttcttcgccgctaggcccgcctcaagctccggcgagcttcaagccatggttgtcaccgatgtcagcctcagccatgcattggtggtggcgccgccgagaggtggccaagaagacgatgacggtgttgtcgtcgccggcgagccggcggaggaggagtcgacgatgatgttggtgccgtactacggcggcgaggtggtgcaggcagcagcaaggccgacaaggctgacggcgagcagtgaggcggagaggacgacgacgatggcgcgtcgccgtcgtcgaagcaggtcgcactcgtcgcaccacgcgctgatgatgacgccgccggtggtgcaggagaagagcatcgttgtcgtgagggaggagaagctccggcgaactgcaacggagcggccgccggagccggaggaggagatgacaacgacgagcagcagcgagtactcgcggctctccgacgaggagctgaaccggcgcgtggaggagttcatcgccaggttcaacatggagatcaggctgcagctcgagaaggaacaagaacaagctgcagctgcttgacatatgcaagaatccgccatggccatgtacaaaatcgatcaagttcaagctcaaagctcaaaggctctagctagctccatgtcatgtccatgtccatgtagatgttgatgcgagtttgttaattaggttgagcttttggacatggagctagctagctaggcataagctccatgtcacagaaaataggtcggttttttaaaaactcccacaaaattcctctaggcctattcagatcggaggaattttgcaggagtttttaagaaaccaagctattttctgtgaaaattttgtaaaattcctacgtttcaaagagccagcagtagctatagctaagtagttagctagtagcttcttcttgcttggttcctcttggtagtcttctgcatccatagatgcaggagagtgagatgagaggagctatattctcatgagggatcatataatttgtattttgtatttgtgtacatcatcaagagatcagatcagaacaatccaagagatggagtaatatattatagcactagtagtagttgttgtactactgatgaggattagattttgcatgcatggggatatagtaataactaataataacagagatctctatggcaagagagatgaagtgtatatatggcttgtttaattaattatggctgccatgatacaagtgtcctctctactgtacttctggcaccaagatttttcactgtagaaatgttttgggagtgggacccacctcataggaaaactgtaacaaatatagttaggttaaacatgtcgaaataaacatataagatgtctcgaaaaattcagagttgcaacatttttctccctgtatttctaaaacgcaagtctgatttttgacatgaaaaatgagggtgtatcatccatgtggagtcttgtaaaacaaaactaaattcacacgtacaactggtttcctctagagaaacataaattaaagctcaaatcaagaattcagagactgatctttttttgtattaacttattaactgaagatgcactgctcgaacgattttgccatcagaacagtgtacagcttcttattcgatcgatctgcagtacttatgagttatgacgacgacaagatcttgtcctcgtgatcttacgcacaagtacgaagaaatttcaatgcgctccttgaaggtatatatattatctcattaatctacctctgttaatttgcatcagtgaattgattaagctggcttagacatgaggatccagatgcaggggaggagcaaggttcatagcacgagcttcacttaggtaacagtaccactgtcctgtcatgtactgtgtagtaaagtttccagcctaattcttcctccggttccataattcctatcattttagataaaattaaaatcaaactattaggactttaatgattattaacttttagagcatttagtttaaagatactaacaacaatatgtatagattagcctaaaaatattttataaaattaaatacttatttattttttatatttattatgacagaaaattattgtcattttgtagatcatgttactgtgtaaaataataggtattatcaagctgaagggaagactactagctagtaattaagtaattaagttccatccggactggcaacctaactcatttacagtgcgtccatttgcaaatgacactgtgagcaacagtttttttttctcgaacgcgcaaaaaaattacacatcaatatattagaagaatagaatgtttgttacacgacgcaatcagtcagaccgacttatgccaataaagaggggggggaagactaaaataaagaagagacgaaagactcctgtgacggctacacacaactccaaatagctgggagggggcagagccattacctttctaggagaaccccaaaattagctgataccagctaaagactaaacactatgagcaacagttaactgatggggatcaaggctcctagatatttgtcggcaagaacgtggttaattaattaacttttgcactgttaattacaaggatgattaagtatagttccctttcttcaaaatataatttttgcactatgattttaaaaatataatattttttttgtgattcagaggcatgtgtcaatacaaggaaaatccttgttcttgcaaacaaaataaaagagcaggccaatatatatacacaataatttgctacttaattatctctgctaggctagctagctgacctacatcaaggttaatcaagctctattttatcatttgttggcttatgattgatcactgcaaagtctttgtacttatcccaacatctatgatcacccaactgtaataaactaaaagagaagcattgacagggggttactcaactcttagctgtcatgatacacgtgtgtattcgtgtggcatgaatgttactagaattacacatatgtatgcacttctctaatcgagcttaaagaaaatcatacaccaccattgcttacatatattgtaaatgtttgcaaaaccaacttattggagaggtatagcactggaaactattggagtatatatcatttttctcgattacataaaagacgcatatataagtacagcatacacacacccaaaaattcctgaaagggtccggtaagggtatttctatatccctcagcctccatatacactagtagggaaacgattaaacggtaggaaacatttggatctctaaggctgcattctttaagtttaagttcccaacttcccttaatttgattagagagtgtaagacaagttcatgcttggtggtgactgatgagtggtgacctacctacctcatcctgcatatgaattgttggcctggcttgaaaccagaggatgccaacatgaaaattcatgttgattcttgtaaaattgtagctagtgaaattagtatggatcttattgtccattctaggccttaccaaactagcttaggctatgttcggaacttccagttcccatcctctctctcgtttttcgtgtgcacgcttttcaaactgttaaacggtgtgcttcttgcaaaaagtttctatacgaaagttgctttaaaaaatcaacttaatccatttttttaaaaaaaaatagctaatacttaattaatcacacgctaatgtactgcttcgttttccgtgtggggagatgggttcccaacccacaagtaacggatagtgtttttattcttattcaccaaaaaggtatttatttgtgttaagcccaatttttacaagatatatattaccaaaaaaaagattacaagcatgtggccaaattggattttgagtagttacttctaccaatgcaacttgcataacaagatcaactaggaagctaggcaaaccaaatcaggatggccaacaagctggctggtcatatgtaaagctcagaatttaaataatgtttgcctcatcctgtgcaaacacatcctttagctgctaaggagataaggcacaaaggccatatatgaacccttttgttgaaacttttgctataatgcatacaagcaacaagacaacacatacttgtgtgaagcaaatctgctttgactttcttccacacgaaatatctctaccttgacctgattgcacactggattgtgatgtacatgattgaatccaagatgaaaggacaataaactttaactggaacatacttttactcaccaccaaacaccatactttttctttattctatcaaagaaagcacatactctatctagctagtttatcctcagaaagtaaattgtactttttagcatcaaaaaccaggttcattggttccttggctcctttctggatactcctatataaattattactcatattcagcttaaactttaatcaatctttgatcgagatatatgtcaatgagataacgaatggtaaataatggattgtgtgaattttttggcaaaaaataaggaattaattaccccttccttgttatatatgctagatttctaacttgggatcgaaacaatctagaacatgacacgttgataaacttgtggatcctatatgttagacttgcataccaattacagctcacctcactgaaataaaagtgaccccctttgacaatcaaccatggcatagctagctgtcatgaaatttggttgcttacatagataaaacagaaaatctagataacggcatctcgtaggaacgggatgacttaaaaggtctacgttatttccatcaaaacagttgtacacgcatgcggcacgatttcctactaagtggcaggtctatactccacaacacatccacgcgtatgtgtccttcctgcagcacaaggactctaaatacactggttgggcacttgggccatgtgaatcaatttgggcatgcacctctatagacttgacttacatcttctatataccacggtcatttttaattttttcgttttctccttttcttgctttgtttcttttcttgagtgagacacattgagatttagtatgtcatgtaaattaattgacacaatgatattatgtaacatagattttatttttctttctctttttgactggtgttcacttttccgtcgctatgctgataccagctgataccagtatggtaccagttgcatggtacctggtacctgtgacagctggtatccgatacctgtgatacctagtacctgatacatgtgacacctggtacctggtacctgtgacacctgatacctgatacctggcacctggtacctgtgataccttgc

SEQ ID NO: 13821 - DNA, 1405 bp, Oryza sativa
attcctgcagcccagctctaactagctactacatcccaaaattaaagcctaaaagggcacgacatattacacactgcagcaagatcataatatatacctcttccattccaaaatataagacacaaccacccttaatccaaagaccaagaaataattattatcacctctttatttgaatcaatctaactaatacaatacatgcacccaataaaattaaacatattatgagtgtatgatttaaaaaatagtaatttaggagagaagatatgttaattaattgccatgcatgcatgctttatattatgaaatacttttaaaaagtagttgtgccctgtattttggaatggatggagtatcaattctttatttccatctcaaaacattcttcatggattactgctcacagcaacaggctggtgttggtttagtattttacttctttttttttgggtgtaccatgtacacaaagtgaaatggtgaaatattggaaatcatcagcaattgttaatctttcgcatagttacggtggtcattgttagttgtgcatacatggtttttcaggcaatgattttccatgttaaactcttgactcttgttatcttgatcatctttgttatctgaccccgtcatttgtaatgatttgaagttctgatgacctgaagacagggactgatgctttatattagactctgatagatggactgatgatttcagatttcctttaccctcggttacttcatgtcttcatatcaacactttgatatatacatactccctcggtccataaatatacaagattttagccctgtatttatccacaattataaaggatcttgagatattactagtcccataaatcacctccaattcaaatttcttcgcatattattcctgaccattcctcaaccttaatttctagtaaataacctataattccttatattcgtggatggaggaagtactctatatcctctttaatgaaaaaagaattggttactgattaaaagcactgatctttgcaagcaaagactgttgtaatagtgtaatcaggctcatctgataattcctttccttgaagccagcattcagcagcaaatgcttcatggatattggatcagttcagcaacagaggaattaccagagcatgtccaaaaatatgttagtttcttccttactggtttatactgaactccggctccggcttcgttttaatttgttctctaaagtttctagtacgatcaccattaagcagatgttcttttgaatgcactgatccgagtagcagcagaagtatatatatttcagagcaatcaacatggcagagggagacctgcatttactagcggataatgtactacagaagaatcaaaacctattgctcacagatgttccatacacaatgagg

SEQ ID NO: 13822 - DNA, 2495 bp, Oryza sativa
tcctgcagccctgtttgctacgttcaacataaagagcagtatcatatcatggccatctagtacagaagatcacacgagctggcaatccacaacagccattttcttgtgtgtagtacatccggtttccttaaattgagtgaaaagaacaaagaactgaaacagataagtgttttttttccttttatttcttttttattttgggagaaaggggtattacccaacttctgttccaagctaataattgtttggacaggtacagaaaatgctggggataacagcggtttgaattagatagttttacatcgcataacctgacctgcatagggtatcagtatcaccaaataacaatgcgacaccgaaccaactattcaattctaatgaaatatctcagcaaggccacaacttgtatttctagagaaaatctagcttcccagcaaatcaaggcagaatggagaaaagatctttgaccataggtattgactacatggtaacaagactttgcctgctgcttgggcaatattatgataaggagaattaatttttgatcctgacagtctgttaactattcctttcatcatacaggaacgaggacttatgaaaaggattcaacaaggcatgatgctgcatggtctctgttagctctacagttacttctgttattcttggtttctcccaacaaaggattctcaatgactagaatctttgtactgaatgcacagcaaaatgtggcacgcataaaaacagaaagtatcggtccattttatactcttcgtgacagattaaagcaggcaaatgaaaatcatgtgagctgtacatcttttgatatttaggcagtgctgatcttaatataggagcattacctttacgtgtgaatgtagctgtatttactccaattacatgaccatatgagtcaattagtgggccacctgagttacctgtcatttgtcaatgttagaaaattatgtgaaataaggggaaattgtgctttttgacataatacaaatacccagcttatatgaccaatgaactctggatattaagcgacgaagctaaggaacatgaaaaaacaaatactacctccgtttcaagttataagactttctagcattgcccacatttatatagatgttaatgaatctaggcacacatatatgtctagattcattaacatatatatgactatgggtaatgctagaaagtcttataatatgaaatggaggaagtagatgtgaaatgaagaattgtggaataagaatcaaaagctgccctgcaaatctttaaaattcctggaattgaatggtgtgtgcagaacaattattttccacttcagaaaagaaaagaaaagaacaattatattcctggaatggaattgaatttataaacactttacacttattttccattcatttcttctcagctttttcttatcaaattgttcatggcataccaacaacaccaaagttttgtgaatgagatgatcatcacgaattttgtagatagtggatatttcattgagcaatgaaatcacatccagatcattacgaatatatagcaccactttcagctcctcggtagctaaatccgtggctgtcaactaacctataggttagtttatacactaataaattgatcagaaaatttctgtgcagttaaaatcatatttagaattatctatagatcttattttcaaaggaattatatttgttgggcggttgggccaccagtccacctcccattctcttttctcaaggcccattgagaagctataccatgattgcatccaactctaattcataggctttgacacctggactcttgggcatttaggccagcccatatcaagttcacccaatcataccctttaaggtctggccacaaaacaacgcaccaacaaggcaacaagttatgcccttttatacatatatttttttagaacagtgaacgtatcttccaacatcacttacaacacaaacagtttttcaccatgctcgccatatggcgtacatatttagctgatgcttgtgttagtccctatttcaaccttacagtcagataattcacaccaccacactgaaatatgctctgttcatgcatctaatccaaacagaacaagttccatagatctaacgttcttctaggaaagcacagcactagtaatataacacgaaagcacatctcagatgagctttctatttggaggaccatgcccctggtttctactcacatagagaacagacaacccagtccatacgtcaagtaccaaaaaagaagtaaccactaaggcacaagataagcccaaaaagaagtgaatctgaaagactacatcagtacatttaaaattaaattaaatgtatctcaactgagatagagcaaaagcaaaatatgaaatgttgccatcggccatatttcaaattaaataatcagtacactacaccatttcagaactagttggtacttggagtatgtcacaaggaaagatgatttactctatataa

SEQ ID NO: 13823 - DNA, 4340 bp, Oryza sativa
agctctgcccaactcgcaagccctttgatgttccaatcagagcaggcctcaacttatcaccatcaacatcaacctgcagcaccaatagacttcaaatattgaatttggaaccagattcacataactgaaacttcatcaacaaaaggtgcattaccttcagaacagcaagatcatacgatggatcacaccctactagccttccttccttcaaataactattcccactagaatcctccaataacacctaaaggaaacactaaacaattagccaatggttaaaacttaaaaggcaagaacaaggaaggtcactatctttagttaataacacttcagtgtataacagcaacaggaaaccttgcagcgatgaaatgcagatccatccccagctaattttgcaaccacatggtaatttgtcacctgaacgaccaatgtgaccaatcagtttttgaaacattaaagaacaatactctagcattatgatcacatatttgcgcatatgaatgcatcaggattccatattttgaacaaagttagcaagaaataatccataaggtgatactccttccgtttctaaatatttaacgccgttgacttttttaaatatgtttaaccgtttgtcttattcaaaaaaatttaagtaattattaattcttttttatcatttgttaaatatacttatatgtatacatatagttttacatgttccataaaagtttttgaataagacgaacggttaaacatgtgctaaaaagtcaacggtgtcaaatatttagaaacggagggagtaattgttttctttttaaaacaagatgatgatatctttttgggggtgaaatggagatggtcggtgcttgctcacaatgtggcccgcggtgtcccagacgaacccagagccggtcccctccaccgtggcgcccccctcctcgccgtcctccgcctccaccgcttgcccgcctccccgtcccggcgtccgcccgacgacgaggtccttgatgaacaccaccgacggcgacgcctcctgcatatataggaggaaaaaaaggtgatggtcggatcagcgcgttagggtttaggacgcggcgtgctggaatctactaccacctggaagaggcgcacaacgcgggcctcgtcgatgtcctcgccgcctccgccgccggggtcggcgcgggcggggcgcggccgaggggaggccgcgaggaggaggagcgccgctgcggcggcggcggaggcggaggaagcgcggcgtgtggtggcgaagggtggtgagttgggaggcggcggcggcggcggtggcggtggccggaggaggagaaggcggagcagcgggtggaccgccatggctggagtggcgctcgttggacgcgcgctatctgatgcgtggctgggagcgaaggcggtattgttgaaatacgccttcatctttgcaaagcgaattttgggagcacgccttgtacgtttcaatttcgagagagagtggaaaaaaaaaaggtttatgccatttcgaccagattctaacaatcagtagttatgtaaccacgaaaataaactaaaaatacctactagcttctcagaatctcttggctcaaccaagagtctgtttggggagcttctagcaacggtagattatcacagaatcttcagttcccccaatagtcgagattgtcaccaagattttgacaacatttagttatagaacccaaaaaataaattagaacctaggagctggaaaacacagcttctctagatttttcaaaagttggctaacagccagcagattctcataatcttgagctcctccaaccagggcgtaagattgacatgaacaccagcaatgtaagtaaacaatgaaaatgtttcatctcggagtagaaatttactgaatacgattgaattaatatggtggattcatttgttcttccaaatggacccaggtatgctcctagaaatgcagttagtttgatcattggcctaagaaagcttttaggttgtgtttagttcaacgcaaagtttggatttttgttgaaattgaagatgatgtgactgaaaagtagtgtgtgtatgacaggttgatgtgatggaaaaggactgaagtttggatccaaactttagatctaaacacagccttagaattgcagttatttcgggaagtatggaatatttttcatttgacaaaagccgcaatacaacgcaggtaatttcagtcgtattagcaatcaaatttataaaagtttgacagcaatactttgaaaaacaagtcaaaaaggaacagggataacgcaaaaagcagctagcagcatgattaattcgacgaaggctgcacactgcgtacaagaaaaacgactgatgttattatatacacttcatcagtataacactccacacacacaacaaacatatatcgctaccattttctgtgaatcatcaaacatgaactactactggtagtataataatactggtagtataataattctggccggcgacgagcaaattaaagtcatacaatgtcgtggttcatcggtgaatgcgccaccgggacaacggcggcgccggtgagctcgtcgagggcgtcctcctccgtcgcggcgggtggcctcgccttggggtcgtacctcttgctcgccgggttcgccgccgggtcgtacctcttgacgaccagcaccgacgccgacgtcctgaactccggcgacgccaggtagctccccacggggcccagctcgtcgggcttctccaccagcggcgccgtcggcggcatcctccccaccacgaacacgctgaacatggacagcgagttgatcgcctccatcacctccgccttgctctgcgccggccgctcgtcgaaccgcaccgacccgtccttcaccatgcccaccttcgacttgaacgcctccaccgccgcctcgtcggcggcgtcctcctcgtcgggctgcgcgcgactcggcctgaaccgctccagcgtcacggcgacaccagggtgctccgccatccgcgtcgcgtacgccagggcctcgcggtcgtcgggcccgccgaagaagagcgccgccacggagaaggccacgttcttggcggacacctgggcgtggccgccgaggccgcggtcgacgaggacggcgacggagcagggcgcctcgcggaggacgcgcttgttgatggcgtggtacgcggagccgagggactggaacgtgccgtcgtgctggagcatcttgtggtacggcatgacgacgatggcggcgcgcttggcggtggcgctgtcgatgacgtcgcggtggatggtgtccaggtcggagatggccgtcatggggcgcacccgcaccgagctcagctgctggaacgcctcgaacgccaccaccatctgctcggccttgtcgccggagttgaagaacggcatgccgttgcggcgggcgcgctgcaccagggtgatcgccgacgaccgctccgagagctccacgaggtgcatggcgtacatcacgaggcggccgcgcccggtgccccgcgacgactcgacgaggttgagcagcgtcgggatgttgcggttggtgtggaagcaggccagcacgcgcagctcgccgtcggcctcgccgccgtccacggtgcggcgcttgtacggcgccgtcggccgcgccggcttgtagatggccatgacgatcggcgtcgtgatgaacgtggtgaacagcgccatgagcaccatgatggcgaacgcctcgtcgttgagcaccttgcgatccttgccgatgttgaggacgatgagctcgacgagccccttggtgttcatcaggaaccccagcgtgacggcctcccggacagggatcttgacgagcaacgacgtgatcaccgtgccgccgatcttgccaaggcaggcattgacgatgacgagcacaagcaacccccatgacttggctccacgtatggtggccacattggtcttgaggccactggagacgaagtagagtggcaggaagaggccggagatgaggtcctccaccttctcgatgagcacgccggcgaacggcccgtccttggggacggcgatgccgacgaggaacgcaccaaacagcgcatggatgccgatggtgtcggtgacgaagccggcggcgaggacgatggcgagggtggcacaaatgtacagctccttgacgggctccccctccggtgaccgccgcgccatccacgccagcgcggggcggaggaacaggaagatggcggcgacgaagccggcggcggtgaggagcacccagagcgagatgatcggcgagccggagccggagagcgcgacggcgagcgccagcaggatccacgcggcgacgtcgttgaccgccgcggctgacatggccgggctgcag

SEQ ID NO: 13824 - DNA, 6494 bp, Oryza sativa
tgaaatgagtaaatttcacaaatctacatatacttggatcaaattatgacaaaactatagaatttagtgataaagttatcaaagaactacatatttttagtttagatccacaacactatatttatttaaagttacaaaatctttagttttgtgataaaattattgttaaatttatagttttatgataaaatagttgttaaatctgtagttttgtgatataataccttaaattgtagttttgtgataaatttagcactaaatctgtagttttattaaacacgttcataaatctgtagttttgtgaaacacattgttaaatctgtagtttgtgatagtttaattaaagtatgtgtagttttgtgaaatttactcaattggagaaaacacttgaatgcttgtaatatcactccatttgtgaacaagtttagcgtttttcattagagcagcagtggttatatgtaagaacgtaacactggaagaacatgaacatgtagtgtgctgtagaattcgtgcttatcaaggttctatagttgctccccggtaaaagaaagaaagaaaacaaaacaaaacaaaccgtgtaagtttagtggtcatggatgaccttgttgtttaatttgtggttcataacaatttaaagttgagctaccggccaatagttgtgtaattttctgtaggaaaaactgaatgatgctgtaagaaatgatctaagcaacaaagaataagttggtcagagggcatggcaaggaatgccaatagataattacgcatccacgaatggttacaagttacttgctttgcttgatgaacgaaaagcattgtttaatagcagttggcactgttacctacttacctgtactctttttcttgcttaagcaatttctgcaagtcaaagacagctagctaatcaggaagcatatctttctttcaataatgcattcaactattcaccttaatttttccccgggtctattatatcctaaatatagtgttgacttcgactaataaaacaacacaagaaatacaaccaaaccttgcactgaacctattggcaagaaacaggtccacattcattttcttcatcacttcttaagaatcagtggttttttttagaaaatttaagaatcagtggtggcttactgtaagaagctaggggctatgcatgcgaaatgaacgtgcagtaaactgcagattggctagctagttaatcagtgcagttgaaagtcagcagactgtacagttcctaaaactattttcttctcctagttctctataaaatgcagattattacagctcctcagagttaattctttctaacaagatgaaagtgacatgcatgtatggcaaaagtcaccgatgcagttcacacttttcagtaaacacatggcaacattgtccaaactccaggacacagatcacagatgtggtggatatcacgaatgcaagttgcaaccagaaatcacatctttctgggagaaattaagatgtgatatctctatggcaaatagtgtcccctctaaacgtggtgcaagcaaagagagtagttgccctgaagtttaggagtataaatatatactattgtttgaagatgctaggaatcttcttgcttctaggtgagcgaatatctctgatctcttggaaaacaaagcatataaacctgaagtatctgaggcaggtatcccctaggagagtcagtatccagcctgcctgatgcggttgtctaccacgtgagaagcacggctcagccaaagtcttcccttattataggatctaaggaacctaatgtggtattgattaatcaaccaatagctaatttggggaaatatatattgcactaattacatattgcattggttctttagatgcatgcctctttccttcgtctgatcctataatgatgaaactatatagtatcaaggtaaggcagttactgattgtatgttatgaaaaaggaaaactaagttactaccatatgttttagcttccacatccagttaatatgggctttaatcatgttcatgtatcattcctcctcctgccatactgtcaatgtaatagtatcacaataatttcttcctccaattgccattttcaatccatttttataggccacgtgagtgtttcttttgaaaattaaaaacgcaggcatccagttaaacctcttcttttttatatttttctggaaaagaaaatctcgaactctcacaccaatcattttttcaccggacaactctcaccaacctaatccatacccactgctcatattcacaccctaataactattccatccgtccctaaatatttgacgccgttaacttttttaaacatgtttggccgttcgttttattcaaaaaatttaagtaattattaattcttctcctatcgtttgattcattgttaaatataattttatgtatacatatagttttacatatttcacaattttttttgaataaggagaacgatcaaatatgtttaaaaaagtcaaatgtgtcaaatatttaggaacaggtggagtacttaaatgaatcccaaggtcccaaggcaagcaccaactcctagatgtgattgatctacttaagaacacgaacactaaacaatatatttgtacaaactctactagaggggtttttaaaatatttctcaagtaataatcactgcaaaattcaagtcaacatatattatcaaaccagtaccccgtcaaatttggtgttaatcagtccatgcccactctgttcatattcatatatcccaataagtaataaatgaatcccaaatcaggcaagcaccaactcctagatgtgattgatcatctactttaagaacacgaacaaacagtactaaacaagatttgtatacaaagtatttttattaaaaatatttgtcgagtaacaaataagtgcgaaattcaagtctacatattatcaaactagtggtaccccacgaaatttagtcagctgaatgtgtatgcgtctctatcacgcacgatcgcaacggaaacgggggaagaaaaaggccacgaaaaggattcgattgtcccatcggctccgattttcaaaaattccaacccccgcaacaacaatttcctcccccaatttcgcagttattgttccacttgcgcgagattttcagcgccttcacatccaaggacaacaaaattcagaagctgggaattaacagagccttcacctcgaaggacatggagattttcagaggggaacagagaaacggataaggacaaagcaagcaagcaacaagagagagagagagagagagagagagagagaggcggaggggaacacggcacgccgcaaccgaccgagcgaaaccctaggcgccccgggccgaaccgggttggtccacagtactacactagcagagcaggtagccatggcggaaggaggacttacgatgatctcggcgatgacgcggggctggcggagggggcggaggaggtaggcgaggacgcgggtgacgacgacgacgaggcagatctggaggatgatgagcggcagcgcgaagtccagcgggttctccttctggaacgccccctgcgacgtcgccttcatcgccgccgggcagctgcctccgctcgccgccatcctctactcctccttactggtgacttctcactccccccgccgccggagtggaccaccaatgcgcttcgccgccgccgccgccgcaccacggcgaggagggaggagtcgatcgagtcgagtcggagaagcgaacacgaatcagacacgcacagccacactcggcagccgcgtgggggtggggcgctatatataggggaggccgcgtcggccggggtgccacgtcagcacccgaggaggagtctctcagaagaggattaggagaaggagacgatgaagaaggcggttacaaatactactactgctacaagtcggtcgagacaagacacaagaggggatttttttttattattattatgtcccataatataagacagggttaagattgatacggttatcttataattttttattatatattaacaaaattatgaacatatgaaagtaaattcaaatggcaattcaatgatataatttttagcaagtaaaattcaattcatattcaaaatgttttaaagatggaatcttgaaatgtgtgtgtgtcgagtataagcgattgtaaaacggtgttcttttttaattagaatataagtttatcttgattttttgttatcaatgcattttaaactgttaaatagtgttttttaacgaaaacaagttactttaaaatgtaaagaaataaagttggtaagggagaatataaatattgtctctggatttcaaaatctattatattttaggataaatttaaagagcaaaatcccttatttattatgagacgaagggagcagtacgtagaagcaaaactctaataatcccacatgcatacaagaaaatttttttaaaaaatgcagcctctactgcttgcttataggttagattgtttgagattagtttagggcaataatgcataccaagcgttgacattgcccatgccttgtctacacgatggaaaatctaaaaaacatgcgtacacacaatgcaagcagagagaatctgagattttagacacggtatataatagtactagtagctagctactccctccgtttcaagttataaaacgttttgacttttgtcaaaagttaaactacttcaaatttaattaagcttatagaaaaatatagtaatatttataatattaaattagtttcattaaatcaataattaaatatattttcataataaatttgtcttgggttgaaaatgctactccctccatctacttttgatagtcatatttttaaatctgaaaaatttatttttgataggcatatttcaatccaacaacttatcatcttaatggatttcttggatttaatgcgtgactcttcattcttccacacaagattggctacatgagtatcgagaaatgtaaatattaatgatcgcttgtttacgaggaatgactagtagcatgtttagatggatgataagtagaatcagttatcgttggtctgtgtgccaagatgaaatatgactatcaaaaatagatggagggagtattattttttctacaaacttagtcaaatttgaagcagattgactttgacgaaagttaaaacatgttatgatacctgaaacggagggagtagttcagtttgttcatagccatctagaaactaacacgtgcacaaaagttggattcattgccgcactattatatcatatatgcatgcatatatacctagaggctagagaacagcgttttttttttccctttctctgccagcaatctaactcaggaaattaaatttcgataaaatttgttacatgacactctaaatttatggcatttgttctcttacactctagtttcatggttttatctaagtcactctagttttgtggttgcttgaaaaaaaataaatacttccaccattattttagtgtatatatatatactctttcaatggagagataaaactctgtaccaacatgtcgcaatttgggtaagttttaaattttgtataatatgtgtctaaattcatctaaaatgtattcaaattcaaatcttgcaaggtgactcaagggtaaagttgtttcttttaaattttatctctatatcagaagaggatatatattaaatagttggagtacatttttgcaaacaaacacataactaaactataattgaatgtcctgaagcaaatgccaccactctagtgtcctcaagtaaattttgccaagtttttggattagtaacaaatgtaacagtcttcaactatttagtaagagttaactttttcacgatcctaaaaaagtatttgcaagtctttgcgatttcgatcgatctatagtgttaatcaggagacatatctcgatctcgacataattataattaacccccactcaatcggttaacactaaaatatacatctagtcttaatactcaccaaatatacaaagggtaaaaatatacatctacctcaccgaatgtaatggataaaactaaacctcgaagtagcaatcatagactcattagtcatggtcacaatatgtaataaggccctgtatagatgggactaaaacttttaagtccctatcacatcggatgtttgaaaattaattataaatattaaacgttgactattaataaaacccatccataatcttggactaatttgcgagacgaatctaatgagcctaattaatccatgattagcctatgtgatgctacagtaaacattctctaattatagattaattaggcttaaaaaatttgtctcatgaattagcttttatttatgtaattagttttgtaagtagtctatatttaatactctaaattagtgtctaaagacagggactaaagttaagtccctggatctaaacaccacctaagcatacacatacatcaacatcgagtatcttttgttaagtattctcctaggtctg

SEQ ID NO: 13825 - DNA, 13493 bp, Oryza sativa
cgctctctaacacatgttctaagagatggaaacctaaaggcatatctctgatcttaccacatttctgttaaaagctaagtgagatactagctattacaagcgatgagttaacatgcatgcatgcaagtagcttatgatgtatatataggtacttacagccagttgcgtaaaagaatattttctacatgataataatataattatagttaaactttaactcatagactatacaaattctaaaaattaatcttatccgtttgagccagagtagggaaatatatatataggtagacagatagatatataaatattattaaaacaatatagatagatagatatatcatccatccacaaatataagaatatttagttatttatagtagatattaaggttaggaagaaaagattccggtgttcctcattaaatgaggtaaatgaggtatggtttatgccctgatagttgaggataggatagaaaaatcaatatgattaatatgaggtaattaatatgggaattactagtactctaaaatttcttatatttacaaataaattttaaatggttgaaatgtttacatcggtgaacaaatgagtaatctctccgtgctaaaatatatcaaactagaattggatatgatacatattatagtaatacgaatttggatatgtatgtccttatctaatattcgtagtaatggaacatgtttcatccagttttgtgttgctaggtggtgtttgaatctcctgaagatgaagatgaagattaagtgtttcacgcaaaatgatgtggtaataacgtgtgattaattgagtttaaattattataaactcgaaaaatggataaatctgatattttagagcaactttcacatagaaagttttcgcacgaaatgtaccgtttagcagtttaaaaaacgtgccattttaatccaaaagtttatcctctaattttgatacggtggaagtagattagtattcgcgtcgtgacagttgcgaatagtacattttccattgtgtatgtgcatgtgttgagggggctgaccagcggcaaaagctagctatagcggcgaggcgacgtgttctgagactctgcttttcttctgcactttttagcgtacattactcttggggacaaaaaaaaccttttctgtactagcgaagaaattaatctggcgtacacactctctgaaagataacctctctgactttttgatactccgtactcgagccgactacgtaccttgagctatcaacaaaactgtattgctgctacttgcagagaataatgaattaataattattacttcctccgtccctaaatatttgacgctgttgatatttttaaacatgtttgaccgtattcaaaaacttttgttaatattattaaaaacttaagtagtagtagtatatttaaaaatgaatcaaatgatagaaaaagaattaacaattacttaaattttttaaataagacgaacgatcaaacatgcttaaaaaaaccaacggcatcaagtatttagggatggagggagttattaacatcttaatttctcttttcgtgtgtaattaaacaaaggattttgtcaaaggccactagcgtcgattggctggctccagtagctagataacatgtgggtccaaccctgtctcttaattattggtgtgctttgaggacaaaagtttatatttgtcgtatctcaatcgtttttattaaattaaggaatatatatgtgccaattgccatcatgttgctgtggtaatatagatggaagaaaaaaggaactcggggacaatctaccaataattggagaagaaaaggttatcctacaaagagtaaggtaaatattgaaaagcaagcgggatatatatagataaaaacttggaagtaatgacgttttacgagattgtgtcattgtatgtgtttgtgttgcgtgcaccattttgcaccaccatgattttggtgtagacttgattaattgcatttttttttggtaattggaaatttttaggtgaatggaatagtctagcaaaaccaacaccatgtacgtactgcctcgagcaatatggtgtatacgatgaagctggtgaagataatgtacacctcgacggcctccccatcacgtcctcacgtgtaggggtaaaaacgatcgcataaattctttatcaacgagcgtggtttttgtatgagcgtacgtttccgaccgtacgatatgcaaccgaagttgagtacttcgttcatctcaaaatgtagctttttcttcacaaccaatcagagacttctcctcctatttaatttaattacttgtaagcgtaatgaacttcggtacttttttgtcctggaagtatgttattcgtcctacgcagttctgcaaatgcatagtacaaattaaagtatagtgcctggccggtcatatatggctgtgtttagatccaaaatttggatccaaacttcagtccttttccatcacatcaacctgtcatacacacacaacttttcagtcacatcatctccaattttaatcaaaatccaaactttgcgctgaactaaacacaggctatatcatgctgtttaacttagggatgtgtcgtcaagtgtcaatgtacatcgacaaaagcctcgaaaataatatgcatatgtgcatgagacttgactaattcagccaaataatgcatatgaaaagttgatgacaatattatgtcctttatttaatttcaatttatattatcttattctggaactagcggtgtgtaattaatgctccgtccggttacgaagctacatcattaacatactccaatgatgcactgtacaagatgtgctgttagtttgaccttgtaaattactcatcccatgaatctaataagcttaatctgaacatctaaattttggcggccagatcaggatcgatctttttttagaacaaaaataatgacgatcatacgagtcttccttagcttttggcatattttcagttactttttatggtaaattttcctacagaccactctaaatttatgtaattttgttgatgaacgtcgtaaaaatatgtaatggttgaaagacacataaaaatggtaatttgctggaggacatttctgatccaattgaagagataaatttttagaaaggcgagaatacccttgggactatctacaagattataacctaacgctggagtgaatattgaatatgatgtatgctaacaatatacttaggcaatggcctggtaaaaattgatagttgcataattttaaaatttgcactctaacccgtattagaggcatatggccctagagacgttattatcttgttgaataatttttgtcttcaatcggaccgaaaatgccattcagcaaattatcagttttctaaggtgtcctctgcccgtgacacctttttacgatgtccactaaaaaaacataaactttagatatcatgcagtaaattttatccatttatatatatacacaagctaactagctcagtgacatctcaagaaatcgagaaaattaactcttatttgaaataaagtatttgctatggagttctttatatatatatatatatatatatatatatatatatatatatataagcatttaattaatgttgctatggagatggatccccccttacaatcaacccatcacttatctagaaatcttatcacacgaagaacgtccaggtcaacacgtacacgcaggctcgcgtattacacgtaaccttgcttattagtgagcttttataatttaatcagctcccttagcttatcaaattcagagggatccggcaggacacatgtacggacacaatttgggtttgcatcatacgtgacgcaactagctcatcatctggcacgcaccatgatatacggctctctgacttttttctatttttttttcgcctgacgtgttgctctgacttttctccgagggtctgatgacgtcctacctgtgtcctttgacttttcaaatgctggtccagctccgtctctctcacggtttaattacgtcgtattataaatcgttttgactttggttaaaattaatttgttttaaattttattaagtttgtaaaaaaattataacattttcaacccaacacaaatatattatgaaaatatattcagttatagatttttaatgaaactaatttgatgttgtaaatattactgtatttatctataaatttggttaaattggagtagtttggttttgatcgaagtccaaagggcttatagtctgatacagatggagtatttactatgagtaccttcatattaaaatatagtaaattttagcatcgaatcttaataggttgtctagattaatttttaaccaaaagttatgatatagtaaccttttcgattacatgaaaaaaatacatgcacatgcataccacaatatatacacactagactcgtccatacgtgaatatgctttctaatacacgttcacatgcacgcacaagtggtcagaccataacctcactaaaattatattaaaaacgcatctgcaaattataatttcatatagtcaacaggatttaaatcttggtggatgaaattatccatatccatgattttcatcaacatgtcgagatgaggcttaacttacgtgtcctgactcgatcggttgcatacaagcaattgacttggtttcattggctgatcccaaataatttgcttgatcagtggttggagacgagtagttttatagtcggcgtgtctaagtcgatcggatcagtcatgcaataatgagtttttaatataaataaattgtatagttcgtttcaattttaaattctgtgcctgttgcttgttaattgaattattgcctctgtggagctaggtaaaccaaatcaaattgaaacactagtgactacttatcgatgagcgtgcaatgtcaacgtctcaatggataaacatagcgatagtatatgcactcatattatatagaccggctatgggtagcttgaaattcttttcatttttgctgctgtcctattttactacacaaacgactggaggcatatgataaaataaggtgtaaagaatgaatggctaaatacgtacttacacttcgttgggtggaaaaatttatggtgaaaaccaggggcggagcttggtgtggggcagcttgggcttgactggaaattttggtcacctgtgataagtttggccatccattatttacgcattattttatcctaaacgttcactcatttttctatccaaatcccatatcttgtaatccattttctagcccttagaagtcccattattttctagctagtgatctatttgtcctgttttccttccaagaatctctgctaatgatcgatttgtcctgtttttcagtactacatcagtactatattcttgatctgcttacgtttcattttgagttgtaccttttttctgaataaagagtttcagttgtacttggacagttggatggcaggtaggagtagtgttgtaatgacaagtgcggaggtatgcacattatcctattcatatgttcattgataaatgtactcctaaatagcagcatttctgaactttctatctctgactttctcaggccatcctaatctgattagaccttgttagagccgaatggacatggactctaccatgcatgatgcatgtatgtacttgcagagaagctatgaactcttgatcccattgacaatattaattaatcccttcgtctcaaaatataaagattttttggttatttagcaaatactaaggttaggtcaaaagattcttttttagttatttcagttgttaatttttgaattttgaattgcttgaattccctttccaagcatttgattaactttggaatcattgaaatgataggaatcataaaaatcagttagcaatgcttatattgtggtacataatttgaatcttagaaatgcttatattttggaacatatggagtatatctatccaccctggattacttgcttgtggaaatcagcaactaactaaaaaaattagtatgatacttttccatgttctacacaatttggcaaccacaggaatttttacaaaatattactgattagcacatgcctttctcgtttgtgagtggtcatacttcatacagaacgtatggaaatcatgcgaatttctgtcagattcctggatgttttaggactccaggaagtccagatcaatcgtcatagttttttgccctgagaggtcaaagtattctctggcctgatcttagccagattatgtgatagtaatttactccactgttagttccgtttgttcttcttctctgtgctttgatttttttttcctcttttggttagcaagtgtaggagacgggtaaatttcgtctttgttttttttccctgaaattagcggtgccttaccaaccggacaggcttagcttaagtcttcattaacttccatgatccttaatattcagtttcatcaacaatgacaactgaaacaccattagacaattagtgaccaactgataacgacctgtgctttcagttgattcttaatctatctacgtcctactttcctatggacttctggagatgctgatgagctatgaacagagacatgtctcaacggacgtaggcatcaaggtctgaacataacaatcatatcttacttggatttcaactctgttaatcctgcttgttcttcttcttcttcttcttcttcttttttgcagcagttcttgcatcaaggtctgctagctttcattttactagttcttcctttggttgctttctgaactcctgttgtgcatggatgcatcgccagtttgactgttgctggataaagtttgaacagtgccaagaaatgtcattctttcagaaaatgacaccgttgtgtagtactgtagctattatgacagataaattcacttctgacctgtcctttttttcaattactctatccttagtctttaccttttttaagacgcatgcaagttcataaaaaaagaaaagatgtcaaactcttttgttctttctttgagatggatgatgctatactacacagataattgattacttgacaactcttgcagctgaatatcttgttccttggacaagtgtcgcagtgacaactctgacaaatgcatacttgcaaggtgcagagttgacttctggtaatataaaatagacaaagggaaaaaaaacctttgttggatacttgtatgagatgataatcctgagtcctgactcttgggtttcagttaatcatctttgtttctcaattatttacctattgttgtttaaaaaaatatttacttattagtacagtttcagagtttctcttcacaagcacaaagataatacagctcaattcggaaggtgataatatgcaagatctctaggaaatgtcaggcacctaatcagtttaatttgattcaaattatcagagtacaacagcagatcatatccatggtttctgatcacagcagtctgagccttttaggtcacagacaaatcgtacaccgtccattttcgatattcagttcctgaaaacttctgtcgttcagttgttcaggttttcttcatgctgatcagccatgacttttggcacaaccaggcaacttttattgagagcccgttcaaattggtgtcattttgaatcatattattctttaggtaaaattgacaaatattttttttatttttttagagaaggatattttttacccggcctttacattcaaccggatattattctttaggtaaaattgacaaacattttttattcttttagacaagcctttttagattagaaacttagcctatcaaacagggaaattcgttcctatgaagatttgaacttagaatcttggggtgctactcagttcactacaccactaggctacatgccttttcacagaattgacaaacatgtggatgcatttagtttgttaccaaacattggtaatacctagaaaattttaacaacacatttaacctatcctactaaaatttgataatgttgtcagtttgttaaaattttggtgttgcaaaattgtggaaaagtttattgccctgagattggagttcaaaacaaagaatgttagtgcatgatatacttgatgtataatgtcaaacagagcataaaaaaacagtcgaaagaatgtactatctgataaatcataagagtgatgcatgcctgtctgctagtactttactttgtgattaaagtaggtgatcttcaataggtgcagaaagttcaggatattgtgattaaagtatacagcttagaattctgatgtatatctagcatgctgggtcagtaggtccccaggtacattgtatgtaacaatttttttagagggactaaacaaatatctgaaagcaactagctgcttttgaaatttatttagcaaaaactacttaaccagtttttttaatcacttgaaaaaaaaggtagattattcagaataagatataggagaagagacaggtgttcaaccacagtttacaataagcataaatgaaattaaaatctgaattatggcctagacaaattaagcagtaagtctgaactgaaagaaagaagactacaacactatggattctggacccatttggcaacggggaagatatcaaagcccaaagacaacaatgaactgaacccaattgaagcccatgtagacaattatgtaaagcgttcgtgaaaaaagtagacaattatgtaataagtgattgtagttttaacttggttgaagcaaaggccaggtttacacccattatgggtatttataaatttgccactggtttttctaattttgcaaggatgccacttgatgacagttctagtgatattattgcaatttattagtgacagtcttgcaataatgatttaaactagtggcaaatttgtaattgccccaaaggaaaaatgtatgtttgacctcccttgaagtccataattgaagcccattctgacttcttcctggaaaaaaaaataggtctgaaattgtgagcgctcaagtttcttaggttaatctaagagtagtagttaattttctccgagcatcttttcctataaacaacgcttacttcagatcacagaaggaaaatttctcattatgttgtggcgttttaacatcgaaaatgttgggacctacgtgtgcagggaatctctcttttgttagcgtcgtctcgtctgccatggctgttccaagtagagttatcctctttagtgtaaggcagacaaatgaaaagaatgtttttttttggatgtttgtatgagatgctaaatcctggaacttgaaaattgagggggctgttcagattgtaaccaaaataaaccttattagaatttgacaatttagcaatattgccaagttttggcatgattttcttaagtatttactaaagtttggtaaaaaaaactaaatggatgcacgtctttagcaactttaccaaaaaatgatatggtttgaaatgacatcaatctgaacaacccctgagatacgcatatttgcttctcaaggtatcaaccattcactgagttgagaaatcatgtaaaaaaaaagttcagaaatatcttcagataggcgggttctgaagaaaaatcaagccgaaaaaaaaaacctccagccctgggcttcggagattgaaattccgaacccccttgccctctcttgcttaaaaaaacaaaagttcattgcttgcttgctttattggttctgcagatcactgtatgtattgctgtattggatttctaatgttgaatccaaaacagaaaagttcatctactcttgtactgtcctgcaatcacagtttgcaatactctggcacatctgcacgagtagaaattcagttgctgtagtagttggcacagccttgctgggagatcgtctgaatttctgcattgccgaaaattcgatgcatgctgtacttctcaaaggactggaatgcagggcctcggccgaagattcgatatacagtatttctgaacgcaaaggtgaagtgttcttatatgtggctttgattacaaaacaggatggaattcgaattcagaacatgttcaagcaaaaaattatgaaagaggacgcattagtaatgttcagaattcagaagatgctttgcaggttgttgaatttgcaccaccaaagctttgaaatagtgtaggctttgatccatggaccgaacatatacatctgtaatttatctgattatccctttgataattggcagaaactttctctctgctccatgccgtaggatgttcagctgagcaatccagctctcacgcaaaacgggaaagaaaaaccagttctaggcacgatccaaactgatcaagtcgcaatcagtagtgtgcgtaaaggtgattaatctctgatcccgttgctttcggtaggaaaattagaagaagaaaaaaaaatcctctcttgggttcggagattaaaactccgagtcggccttggccgtaagtattgctgctgcaaagcctctgtgcttgcttgcttgctttattggttctgcagattgtcgtatgtatcgttgtcttggattattagcgatgaatcccaattcccaaacaacaacaaaaataatgcataaatctagtcgtttctgtatctggtctgcataatgtataagcccatgtcgttcaagtgacatagcaaatcctgaaatataagggttaattggatccatgcctctacaaatatgcaaaattagaaaaatggcactactattcacgatatcggctatatgccactggaatttggagaaattgattccataccactccctcgcgttttccgtccacttttctatcatccctgttaatttctatccttgtcgtcttgctgttatctctgggacctcgccactgcaacgacaagcacaccgccaccactggattcactcgcgccgcacgcaggcacagccgcccaactctggccgcgagttgcggtgcaagaagcggaggaaggaagcagagaggcggggagcgaggaaaccggtgagtttaatttgagtttcggccggatagataagtatgtggttcttggcccaaaaagatcagccaagatggggttgggccggtcgagagagcccattaaaatattaatatgcctcaatttatccccggcccaccaaaatggcccgcacgcaagtcctaatccagttccgggcttccggcccagcaaaaagccggatatagtgtcattcgataattaagcagaaggttagatcactgagatgtattagtagggtctctaggaaaatgtcaggcatctctgattaagcagtatgtgacaaaattatcgaagtacaggcaacagaatgacatggtttctgaatcacaacacagtcaaggttacaattaaatcgtacattgttagagaatagagaaatggaaatcatgagccggaagaatcatagatctggaattacatccatttttctggtgtttaagtttttttcctggcgctgacatcatcttcagttcctgaatactttttcttgttctgaatttttcttcatgctgatcggctttgacttgtggcacaacaccagacataacaccaggcaattctgaattgatgaaattaggacgataagagaatattagtaaatgagattgcatacataatgtaaaacaaggttttcaaaaagtagttgaggcatgaaagaatgtgctccaatcagattaagtgagattcatgttaccctactacttgatagtataatggtagcagtagataatcttaaatagtgcagaaagccttggaatgtgatcaaagtatagtgcaaattagaactttgatgtatgtctagcacactaggtcattagctaggtctccattgaatatttttcatacagttttttttagatggtccctacaaattgctgaaagcaattaggtagtttaaacattaacttggcaaggaactggttatgagttataaccagtccatttgaaccacttgcagaagacagagttcttcatgatagattcaatagaaataggagaacagactagtgttcaatttacaatcaatggcaaatgggactgaaatataaatcatggtcaagatgaagcacacatggtccaaagaagacattgacactttggaatctggactcatattgcaacagtgaagactaaaccccatgactgaaatgaattgagaccaaaccatgtttcatgtacactacagtctctatggggcatagtttagtattttgtagtccaggacactctgttgcataaagttatctggattcagtgatgtgctcgtccatagtttgagaaatacagctctctttttttttcaagcctggtacataataatgctaaataattttaactggcacaacagttcactattctcaattcgacgagttaacttcatgataacttctgctataattatggtgctactgctcctcatcagggaaaaactagctaactgcatttacttgttctagatgacaactccaaattaaccaatagcagcttggcactgaaatatctcagtatctctagctagcatgttcaccacaatggtcttgcaaagtgcttaagcaaattagtgctacacatggatgctgaataagaacaacactacattttggccatcaagaacaaaacaatctaatggtttcatctgcacatatagatgtttaccaacaagcgaagctattgtaatctaccacctatccttgacgaccaatacatcaaatgctacctgagtaggagtagcaccctaaaatcttaagttcaaatctccatatgagcaaatttcatatcaggttttttgagagactaagtttctaattttaataagttgcatatatccggttggatgtaaaaaccaggtaaaaaattgccttctttaaaaaatttaaaataaaatacgcaagattttattatctgaatgttgtcaatggaacaggttcatctagcaaatcgaaagattaaaaacatgcgaaaattttaacaaaaatgttacttacttagtcatgtcttcctctcctccttgaagtcccagagctgcagcctccgctccccaccattggtcgtcgccgccggagcagcagcagcagcgccgccgacgccgcctgcaaggaagaacgggaggccggcgacctcagccggagcggcggcgaacctctgcagcaggaacgggtgctgcgacggcggcggctgcggcggcggcggccacagcgacgcattggactgaagtgtgccccgatcgaaggcggccaccgtggcgtgctgctgctgctcctgcgagaacgcgaggtggggcggcatcgccatcacctcgaacgacatgggcgccgccatgtgcgcgctctgcgccgccgcgtagtacgcaagcgtcgcctgctgctgttgctgcaatggcttgctgccgttggtgttcgagcagtggaggagctcggcgaacgcgccgccgccgttgtcgcagggggcgttggcgagggagagcacggagctcttgctggtctcggatgtgctgacct

SEQ ID NO: 13826 - DNA, 3709 bp, Oryza sativa
cccgcgacgtcaccaccttgctgtgcctgtccttccgggccgccgccgcccgcgccacccggctcgtccgccacgccgccgccgtcgccgccgacgcgcccccgccgccgacgccgacgagcgcgccgcgcgggcgcttgcgctccttgccgccgacgacgacctcctccatggctgacgcttgcgctacctcatgcgaaatccgcctccgcttcgtctgctcaaatttgggggggaaaaggggataaaatttgtaaaaaaaattctttacgaaatgatagctttagaggtggcaaagattgcaaaaaaaaaaaaagatttgtgggagttcaaattgtccacaaaatcttctcagaggttgcaatttgcaaatatagtaaaatttggtagcccatttgctctcccttgatttgtaaatggattgtacattgcaatttatgaaaaagtaggagctttgtggaagaatctactaaaagcaaacataaatctgaaccttttgcggctgttcttgcagaattatttatggtgccaactttgctgtgacaactttttttgtcaaaacgaacttcaattagggctaacaacaagaagaataatcaaaacgtcgagttgattaaagaatttgtaatttgaggtcatgtatcagaagctcccatcttcccagagtcaaatctggcaagcaaatcaagaaatctctggacaaaataattccaagaaaaaatggggggaaaatagctttaactgaaactctcaaaccactatctttcatcagttcatcaccattttcctgcattacttaaaggaaacaaatctctgaagaaacaccacccaaattttcctccaaggggggaaatttttcaaaactgcatccatccaacagacgaaaatcgaattcaaccgaacagaatgcatcaaatcttgctcccaaaacacatcaacaccagaccaaaacacacacacacctgaagatcaatccaaatcgagatatttcacctcctatccttccaagaaaaaccccaaatcaatccccggctcaaattcagccgccccagagaggaatcaaagccgctcacctgaaggggatcgatcgaaaccgaggacccgggcgaactagctccagaattcgagggaccaacgagcaaaagctcactctgagctactctgaatctctctgatgctgtgagctgggcgccctgcaagctgtagctgcagctgctgctgctgctagctggtcttatcgcctctgagcaagctgagctcagcaactctctgcaagctcagcacatatatagaggagcacatttttcagaaaagacctcggattttccatacttcgtggatgtgccccgcgcacagtaccatgcaggggcttgactgcaaaaaaaaagtcaggttcacgtttcggatttattacggtcgtgctttgtaccatgtactgctctacaaccatttagccggactatttggagatgaaatgaatggattatatcgaagagatcttatgtttttaacaagtgtgaccacatgagttaggcggaaatgggtggttaaccattgtggttgatttgggtgaccatgagtcgattcgattgcaatgtaattttgtaataaatactgacatgaggtagggaaataagtagttaatcattgattttgtgttattgtttaaaacgtttttcaggttaaggaaaaataagccactatgcaagaagatgcggatgttatcgtcggagcatgaatcttgacgtgatcctacgataagtaaatttgattgaatttttttgaggatatcaggtggttgaaatcttgtgattcgcattaacaaaaaaaagaaaactattctttcttgacttgtacattactcccctggtttcatatttttttaatgttttgaataacgttttgattttaaaaatatatatttaactatctattattctaatatatttataaaataaataaatatttaattgtattaaagtgctagtttgtttttaaaagactttttagtgtctttaatctcggtattgtccaaaacgtaaaaagatttatggtgcaaccttatcttttcacttatgcttatatttatcagccaaaatttgaattttcaactttaaatttgaagttgattttgaggtttttttcatcgaagtttattttttagtctttgctttttgattgctaagaacacatatataaaagttttattcataaattatttttcgttaatgtttggcttatttctagaataagccaaaggatggagccctacggagtagattatttctttcatgagtgtttttcataccattgtggtgggggtgccaattaagcgctaattaacagcagcccgatggtgatgaatggagctagctaggctaagctagtgaaatgaagaggaagatgatgagatctggcaggtgacgtggacggtcaaccggaaacagttgacagtaggggtacggctttccactttagagacggtgtaaagaggagtagcctttcctttacaggctgtgcgtgctgtacactactgcatttgttaaatgtacctacatactactactagtccactttctacgtactagtcgtcgtagactgctacagttctactagtattactaaggggatgtttatcaaatgatgtaaaattttgacgtgtcacatcgagtattatataaggtgtcgtattgggtgttttggcactaataaaaaactaattatagaatccgtcagtaaaccgcgagacaaatttattaagcttaattaatccgtaattagcaaatgtttactgtagcaccacattgtcaaatcatggagcaattaggcttaaaagattcgtctcgcaaattagtcgcaatatgtgcaattagttattttttagcttatatttaatatttatgcaggtatttaaacgttcgatatgacaaggtgaaaaatttttgggtggaaactaaacagggcctaagctacaagccacttgcatttgggtcagcaactctgcatacagggccggtcctgggtttttggggccacggcaaaacttatatatatatatatatatatatatatatatatatatatatatatatatatatatatatatatatatatatatatatatatatatatagtcatataaacacacaacatttaatattcgatgtgataaaattatctatatataaaattttaaaacttcaaatagaaataaatagcagtagcgagcagagaaggcgatcggcggacgatcgacacgagcgtggctactagcgagccacgatttgccaacttgctgtttccgtttgcgagatgccaagaagtcaagaagttgccgagagcgcaggagcagcgagcgacgtgacgtgattgaggctgcacgatgtgagtggtgtgatgtgatcgaggcgaagcgacgggagtcagatgaagatcgcttcggcttcgctaaaacaggcctgacgatggactaaaatttattttctatattaggctatttagctgtctaacttaatatagagccatagctcatgaactaaaattatacggtacgtagtatatatactatatgtgtatatagggggcccctagattttgggggcctcgggcggccacacggcctggccggccttgtctgcatatagccaagctgcgagtatatacttgacagatgctaccaaaaaggcctccttgcaatggacaaaatttt

SEQ ID NO: 13827 - DNA, 3999 bp, Oryza sativa
aaaacttaagcccgtcacggatgacccctatcagtgacgggccacaactttaggcccgtttgagatatggaatgttatctcaatcgggcctaaagttgtggcccgtcactgataggggtcatccgtgacgggcttaagttttatacccatctaacatgtatgtgcgaccatatctcaatcggacacttttcagcccgattgagatgacttccttgtgacggcccgctatttctaagcatattagagcccgtcacagatagaagtatctgtactaatgaaacttgtgctctaggggttcatgattggtcacaaataatgtctctaatcaagcaagtcatgatagagagggcactatgttcaaagtagagatgatcataggatcaaagcatgcatataatatatatatatatatatatatatatatatatatatattagcaacagagatgatttttttaaaaaaaaacaattaacatcagaagcagaaaagttcaacggatcttgttgatgaaattggtgtgaagccccttacaatgtcctccgttatagaggtggtgtatcaaaggtggacagacaaattaaacaaaggtttggaacgttgcaacagataaatggccagtgtagcgcattaggccaatttggggaaaaaaaattggacactgctgtgcaggtaacactggcaatggccatggaagcatgacggtcactgaatgtggccatgttgcaaggcgaagcaaagatcaatggaagcaactcagatggttcaaatggatacaagtatatttgtgtcaagacagagcaacattcttaagtttaatgttaagttcggaggtgagcaaattgtagaactgcttcaagcctgtaatgatgtttttttattcccttctaactttggtccacaaaccctaaccttatgattatagtactaaattcatccttaggaccaccaccactaacttccatttctacgcaacaaattaaattcaccaaaacaagaaatacatacagttgacatgctgcagcctgcagctcgctaatgccattccttggactggtggtggccattacatagaccagagcaatatgaaaattctcaaacaaaagaaatggtggccattctgcaatatgaaaggggattatgaatatactgaatcacaatttcaaccaacttatcagtgtataaaacgctgatgatttttacagcactcccatacagatttcaaccaaatttgtgctgaatttgtatattatttcatatagatttgcactgagccacctagtctttcacaggctttgctcagagctgactcgagctgcagctgtagctggctaagctcatccattgtgaccaccaatggcaggtcttctctagttgcctcttcaagcttaacatatgctagtttaacagttcagatacctgaccatcatgaagagttgtttgctcactcacacaaaatcacaccgtttcaattcagtttttgaaattgctctgaaatctgtaaatgaaagaaggctttgttaattgtaacctgtaagcaggagccaggagcaaaaaaacagacatggacataacatcaagattgaaaactaaacatggtaaaaacgtgaaaggcatgtgtaaaccatttctttttcagatgctttgagaaagtactaatatagcaagaccatgactcattgattcagtatctacttgactacttactacctctgtttcagaatgtaagactttctagcattgcccacatatatagatgtctatatgtatgtgggcaatgctacaaagtcttacattgtgaaacggaggaagtaattagtattgactcaccttggctcttcctctgctagctactgctgctcgcctcctgatgccctgatgccccaatggcggaaggcctgatctgctagttgcttggcaatcggcaccactgcaccagcgatcttgtcgcccagtgcccttgcttaggtgctcgctgatgtgccgccaccgtctgcctctgccggctcacactcggcatccgatgcgcggctccacgcccacggcccacctccgcttactactcgttgtcgccgcaggtctattgccgctgttcgttgcagaagcctgcaacatggctgggtcgttgttgccacttgccaagacgcccccaatgcctcaatcccccaaggctccaaccctaatctatggagtgattgagagagaagtggactggatgagagagaagtgatctgagaagcgggtgggagcgcgacggcatgcagcggggcggtggtgatgcagagggcgtgtgtcggaacccggaattaacaacttggatccgactaagataatgtatcaatccctgaatcagtaaatattgatacatacaatataactggttattcattgcatacgttaaagttttacaatactaagggttttacaataataggtactcacctaactaattaattaataattaatacacagcggaagtttctatacattctgactagggaggtataacctttagggattctctaagttatcgggatcatcgtagtaatagtcataagggtcctcctcttgacccagatctgaaaaagaggttataagagcaaggatgagtattcacaatactcagcaaattatcatagaaatatgttatgcattgacatatagtagggttctttgcaaaaagcagtaataaacaatctgagagagttatagcaagaatttataaacatatagactttagatttctaaccagggtaccatatgagtcccggtactcaactccatgagtacggctattcgaatagtttcaaggatattctactgcagcagatgtacgctttacccgcagtccacgacttgctgataatcatcggctttagtcatggcctagtattaagtcattaacaattgtggcacctgttccatgaacttatatcctcatatgctctgaacgtattgttaacagcagcaagaggagttacggcgttcccgaggtatttaaggggaactgatcgtatgacaccacgtcatctcgatcagggtttagaaatataccatatagtttatactcgagtatcacaaacaatttacctgtacatggtaatggttaaagttgcccttcgcggctatagttgcctcctgtgcgaggacttaaaaataagaaccactatacagaggtgccatattgctaattaacataataactaggtctgtccccattctagaaactgcggtcgtacccgttcgttcgacataagtacctggtaataactatatcgatcgagacagtactagccacccggaaatcaaccaaatcttacgtactgtcccaatctaagtataaggtattttaaccagattgtaagcaaagtaagcaatactaaattatctgggtttctatggttgatttatgcatataaaatagaatattgaatagaaggctataaataaataatttgtagaatataggcttaaatgatcaaaggtatatggtaacttgccttgctcgatgtcctgagattgattgatattatctattgagtcagaagaaccctcaagacctagggttatacatataaaattcaaattcaaaaaggaattcaaatgaaatccaaaataagaaaaatagggaaaataaaataaaatagaaaaaataacaaaagggggcacaaaagatagagaatgattttagaagaatattggtccaagtttcactggaattggatctatattttaaaagatatgggcttctaaagtttgaaaatcaattaaatgtgaaatgttactgtgtgcgggtcccacctgtcagtctctctctctctctcttctcttcttctacctccagccgttccccaaaggcggccggcggcgctagggttggtgattgcagtggtgatggagggggaaaggggttgcggccgaggaggggagggagctagagttctccggcgacggtgagcggcggcgtacgggttaatttgttgtgtggatggcctatcggct

SEQ ID NO: 13828 - DNA, 3103 bp, Oryza sativa
gcgcccctcccctccaccggatttagcgggaggggagctggtggcgacctgtgacggcagcggcggttcggcggcggcggcggctgttcgacagcgacctccccttcgatctattttttttgatatatttgtgtgaatatgcttcctccgattttatttttgtgattgaattccgattgggaatttttttggatggggggtgattgaattccgattgggattctagggggaggtgatggacgaaaaattggtgtacagatgaagtgacgaccggaaaaatacgaatatttatattagttatagatataagaaatcctactaaaattttgacaaattaccattatggtaactatgctaaaattttggcattggttgaaaaatgacatcaaagtgaacaggcgctggatgcactgtcacccagtgggaaatttaccaaatacttccccgtggcggcgtaaaagaaggaaaatctcccatctctgtctcctccgctccgctccgctccttgcgccgccaagacgagtcgcggctgaacataacaggggaggggcggcgatctccctctccatctccatctccatctccatctccatctggcgagcagagcaggggaggggaggggatcctcacctggtcagcctctttctgattcatctctctctctctctctctctctctcccatcgggactggaatttgcttgcgttcgttcgttagccctagcttctcttctagatctggaagaagctcttcttttaatttcatagccttaaccttaatacaagtaacagtttgtttgttccccgaaatatttgggggttcaattgaacccccatgtcccaagttggatccgcccctgcttgcagaggtttattgctgtgactttgagggcttatgaaccatattctccttgcaggaaagtgtgggtaaagcgcagggcaacaagaaatggcagcattcctgaggtcaaaatgttcgtcaggtattgagatttgagaatgcctcaacgtttatatgattgtacggataggtttgcaaatgcctactagacacatttggcttgtgcaaagttaggatatatgttctactccataaacaaaccatggacaaagttatggcttctaacgatagctgttggttggacctaaaccagtttagattggcttttagcctaaattaaccaattgttgattacttttgggatttgatctagtgcgaaatgatgattaattcatagcattcaaacacgtgcacaattaaaattgttgattctgtgcgactgatggcctttaaccataataaaacagtatcttataccttacaagtgctcttacctctagttagatttttttgcctctgcctgatggcttaatatttttagcttatggtgctgtggtatgatgctgatctaatttgcatattgctcatggttgttcttcatctttttagttggacgtaccttgatgggaggccttgggaacaatctatttggagccgttaactcatctgttgaaacggtgtcaagaccatctcattgtgatcctatctttcaggtatgacttcttctatctagcagaaacatcttgacatcacttcttatagcaacttgaaaagtctaaaattaattaatggacaaacgtcttgttcttttcactagagaacccatggcacagtagacaagcatatatttattccactatgatgtggttttgttgatatgattgaataccttttattattttttttacgatcgacatcagggatttgctcagttgtcaaactagattgtttggcagattggactccatcttagtatcttatacgtttcttttttgtcgtactcttttagccattctttaggaggaatttttattgttcttatctcaaaacagcagggactccatgtcttggtattttaaaataaattttatgtgccctgctattcgtgcgacgataataggattgttgctgggtgccggcatatgtagttctttgaagttagttatctcatcatggatgttttccatgtggaataaaactttaactcgtgttctcattctggtttcagcaaatcagaacattcatccagatgagaacaaacctaaaggtggtagacaactctggtgccaagcgcgttatgtgcatccagtccttgagggggaagaaaggagcgaggctcggggacactataattggatctgtcaaggaagcacagcctcgtggtaaggtgaagaaaggagatgtggtctatggagtggttgtccgtgctgctatgaagcgaggacgcaacgatggcagcgagatccagtttgatgacaacgcgattgtccttgtgaacaacaaaggcgagctgattggcactcgtgtatttggtcctgttccccacgaactcaggaaaaagaagcatctcaagatcctagcgttagcggaacacatagtttgagatgcttacatacctggcaacctacctgttagttctgcagaatgaaatgagcatggtgctgtctcaagagtattccaccgttgttttgatcagttctgtttgcaataatgtaccctcaaaagattaaatgagctgatgccctgcagtcagtcctagacaaatcagattctgtactactatttaacctctgtagtattgcattccattcagatggaaacgcatacattgcttatgttctcttgttaaacctgaaactgcaactgaactcttgtgctttctgatctcaaagtgtttcggttcatgtgttacattgtgtgatcatgccatcctattcctagtttcctaccattgtcctgctgggacatgcagaagttataaagcttcatctacccacatatttctctttgcttctgatttcaccttaatctcccaatcaaatatgagtattttactctgtacatcaagtcatcaactgcagatgatcagatatctgtttgtccttgatcttggacttggaagaagcatgcagagtttgaaggaatgtgttgagtttgtaatttgttgttgccaaatttgtcatggtcagagtcattacctctcctataattaagctgaacctatggagataaacaaggcacactggtaactaatgctcaccttg

SEQ ID NO: 13829 - DNA, 9308 bp, Oryza sativa
aggtggaggaggagggagctggcgcgagtactcgagccacgatatccacgagttcgacgcgtccaacatcgggatcaggaaccacctgctgaagcacgccgcgtcggcgtacctgcagtccgccgtcgtcgtgccgccgcgggagcaggggtgcctcgcccgcctgtggcgccacgtcgtccggctgcgcgccgcccgcggcggcggcggcggcggcggcgacgggggagcgcgggggcgcggccgcggccgcgtgctcctgcgggcgtgctcgtggcagggctgcgtcgacgaccccgccgagctctgcgcctcgttcctcgcgcgctcggcgcggcgcatcgccgccttcctcgccggcatctgggcctagactagcctcgccgcggcgcaccgcggcgcgccgccgctcgccgtgcgcgcgcccacggattcttctcgtgatctcgtcttttgctgctactattactgcagcagaatagcacgtaactacactacattattaggagaggcagacacaaaaaattatatatattaaatttcttccaagaaaaaggctgattaccgatttactaaaccttgatttttttggggtttttttctttgttagagaaagctggcaagtaattaagatcaatggatgtaattttgctattgatctataattctgtaatctctacgtaaagctgctacttttgtagtaaagtaagcaatgattttttttttttgcacatctcaatataaggatggtgagataaatgagttggtttagtttgctataatgccaaaatatactaggtaatgtcaaaattagttaagttccagactttggcaatatatatgtgtattgttgtgaagtgtcaataatttggtagtgcataatttgccttcaaatcaaaatgatcccatatacataaatgtatacgagaaacaacaaggaccattttggattggtgtcgaaatgtccttaccaataatttagtagtttaaataatagtgtatgtggtttgaaagctaaattattaacattgccaatgtccaatttgatgctttctatattatattcgaagcttagccctaaattggactcaaaccatatactactaaaatattttgtattgatattactcaaagctttgatacaacaaaggtttttgatattactcaaagctttttcgtggtatcaaaaattatctagattttgacgctaccaacattttgatagtgtattgaaccaaataagccctaagtccataacttgtcttacgagtatagtttgtgaaatatctttgtgagaattattggcaaggctttttttccctttagaaatactcttttacgaggattttagaaatatatttagtctcatatcaatgagtaatgaacaattgaacatagctttgacaagatttgttgcagatgatgtactcccgctgtctcagtatgtagcaatttaggatgggattagacatactccctctgtactcgtaaaggaagtcgttttggacagggacacgatctccaatatacaactttgacttcttgtttctataaaaatatttattgaaaaatgatatatgtatatttttatgaaagtatttttcaagacaaatctatttatataatttttacattttcaaactcaacaacttgagagttattcataatttatattcccaagatttgacctaaacattgttctaaacgacttcttttacgagtacggagggaatattctagaactatgaatatactccatttttgcagtcctagaatgagacgaaggaagtaagacattgatattgttaaccttttttaaaaccatttttttccaccattgagatattgcaagtgcaaccttgatgtcaggggagtagtacagtttacaaagccccttggccctaccctacccatctttaagaaggttcagctaagactagtataccaacctagctctacatagacgatcgaaggaaccgccatagtgatttgatttcaaacagaaaagaccattggcgatcaatgaaatcatgacatccatcccctactacagtgatacgagacgagactaaacgataggagacaaatttccgctttattttcctctttaattatcctcagggcgacgcatctggaccgtccatccaaccccccccccccacccccaaaaaaaaaaactaatctaaccctaatttaatcatcatcaacaacaacacaaaacgcacgcacgcatttcgaattcgaaaagagaaaaataaaatccccccgcagttgcaacggtcggctcccccctccattttccccatcgccctcctccgattcctcgccatcctcgccgcctccacgcatctctccatccctctcgacgcgggatcgatcgataggcgatagccttctggggcttggcgcggctcggattcgaagtgggggtttggcgcggcggaggagattgggcgtggatttgatttcatttcggggcgcggtggttgatggagatggaggaggaagggagcgggaggggaggggatggccccgccgctcatggccggataggtgacacggcttcgcttggtgcttcgtgcgtgcgtgcgggtgtgggtgtgttttgggttgggtttggtttggtttctgacatggtctcgattcgatttgcttgcaggcggcgactcgccggtgatggtgtcgtcggcgtcggtcaggaagacggtgaagatgtccgagacctgcgacttcatcccctacgtcgacgacgacgacgacggcaacagcgaaggttcgcgcgcgcgccgcgccatttctagatctcgaattctcgatacatcgcgctggattttttttgaatttgtctgaatttttttctcgttggactgcgcggtgacgaccagaggagaattccgcctcgtcggggatcctcccgtgcgacgggatgcagcacgacacgcccgattacatcaggaggggcgccgcggccgccaggcacaggatcgcgccgctcgagctcttctcgggcccctcgccgccgcagggcccgccttctccttctccggccatcggcggtgccgccctggaagccacctccaacgatggcgtggccgagccgcaggttcatcctcccgaaggcatttctagcatcataagcacaggtggtggagagcaggagaccgccaccatgggttcacaaagcgtgcatgaaacacttcacattgaggaaaatgaggtgatgcttcgaaaaatttgttctccctttgtcccaaaatataagaatttttagaatagtgctaagtcaaacatttttaattttgactattaatagaaaaaatgatcaatcatgtaaaattgatgttaccagattttatattttgggacggagggagtactaagaaacaaggaggtactagttactgctgttcttggtgcttaatggaaggtgatgtatttgttgcagggaaaatgcagctgctgtggacagctcaagcaggagtactctctgcttttgagggagaaggaagagtgcaggagagttttggaggacttgatgagggagaacgagctcaagagcagggaatgccacgaggctcaggcgtccctgcacgagctgaggatggagctgatgcgaaagtcaatgcatgttggctctttgggtaagaactcaaaatttgtgtggctaatctactccagctttccaatggtagtaggcgtaatggaagattaagttcggctgtgattggagaaatgaataagttggatgtaaatatgtcagctcaaagtacttgtaggaattcgctatttatgtaaccagtagttacagtggttgtttaagtatctcatcaaaaaaatgtcagcatgcttgctgagtggctgaatgcaagctttctttttcatcatgcagcatttgcagtggaggggcaagtgaaagagaagagtcgttggtgtcagttgctgaacgatttgagtgagaaatttaaggtaactggtttcatattcaaagtttgtttactactcatgtacaaatagcacaattgtctgggaagtcaaagcagcatattttattttattttcaaaaaaaaccacaggcattgaaggcagagcaccagattttactacaagaatcgcttgaatgcaaaaaatttgtggcagatgctacacaaatgactacgacaatccaacaacatggtataagtgtggcatttcaactagttgtacaccctttagtttgttgcgtgtatatatttctccacttcctagagttggcaacactaatatcttaaatggaacagtgaaccaatatgcaagtttggaatgtgagtttaaggatctcaaagagaagttcactgaggagacaaaagaaagaaaagatctttacaacaagcttatagaggtcaaaggttggtttgatttgttgctatttgttggtttgatttattgctactgcaacagatggtgataataatagacttactaattactatgtcttgcgtattgatcaggtaacataagagttttttgccggtgtcggccattaaatggtgaagaaattgaagaaggggcttcgatggcagttgattttgaatctgcaaaagacggcgaactaattgtcagagggcatgtatcttcaaaaaaggttttcaaatttgattctgttttcagccctgaagaagatcaaggtaaatcccttcataactagtacagtttatcaacctgtatccttgctcaagtttttaacgatgtaatgttctccgatttctctacagaaaaggtgtttgagaaaactgtgccttttgcaacttcagtgctggatgggtacaatgtttgcatatttgcttatggacagacgggcactggtaaaacatttacaatggaaggaattgaagatgctcgaggggttaactacagaactctagaggaactctttcgaattaccaaagaaagacaaggcctttttcagtatgagattactgtcagcgttttggaagtgtacaatgaacaaattcatgatttgctgctgacagggactcagcctggtgcaacagccaaaaggtatgtttcttgtgaattctaacagcaacatgcgagaaccaatatatcatggcacttccttcacaggctagaagtaaggcaagttgcagaaggagttcatcatgtgccaggacttgttgaagcacgtgttactaatatgaatgaggcctgggaggtcctgcaaactggaagcaaagctagggttgtcggttcaacgaatgctaatgagcatagcagccgatcacactggtcagtcccttaaattcatacttttctttgacacatttttcatccatttatgctaaagttgtaattattaaatcctaacctcgttaattctgtatcagtatgcattgtgtaatggtcaaaggagaaaacttgatgaatggggaacaaacaaaaagtaaattgtggttaattgaccttgccgggagtgagcgagtggcaaagacagatgctcaaggagaacggctgaaagaagctcaaaatattaacaagtccctttctgcacttggagatgtcatatctgctcttgcaactaagagccagcatataccgttcaggttgtgaattactgtcctttaagtctaatttttcattagtactgtcttatgagcccagtgcccactgacatatttattgtcccaaattgacaggaactcaaagctaacgcacttgctgcaggactcgctaagtatgtagaactttttccttgagtggtaggatttacatctattctttatttttttggtaataatgtttgcaaacaaaacaggtggagactccaagactttgatgtttgttcagatcagcccaaatgagaacgatgtgggtgaaactctttgctcgctaaactttgcgagcagagtgcggggaatagagcttggacaagcaagaaaacaagttgatgttggtgaactgtcaagatataagctgatggtacagtagtactatgtcaatatatatacttttagtaagatcttagattccatctttttttaatctgaattcatactgctcgttttgctaggctgggagagccaaacaggacagtaagaataaagatgctcagattaagagcatggaagaaacaatccaatcgcttgaagcaaagaacaaggccaaagacctactcactatgaatctccaagagaaggtacttcaagcatcttttatcttcggctgcttaattggttcctccagcgcctttgcaatataaacaccttaatcagttaatcaccaattcaccattactttctaataaagatgttgtcctcatactttcatgaatgaagaattcacatgcttacagttatttacttgctctctcattatatatccagatcaaagagctggaagcacagctgctggttgaaaggaagatagcgaggcagcacgtcgacaacaagatcgcccaagatcacctgcatcagcagcagcaaagcaagaagccagaaaactcaccgtgcccgacgagaagccccatggcagagaggaacctcaactccacagcagagaagccagtgacgttgctcaaagacctcggaatcgcgaggcagatgttctccgacagcaacacggacacctacagcatcaaccacctgatgtccatgtcgtcggagaaggagaacaaccctgccggcggcgcgcagcctacaaaagccagaagagtctcactctgcggcggagctcaccagcagccggctgctcctcctcgccggggctcgctgatcccgctgccgcggcggaactcactgatgctgcctctaccattgcccaagcccgcaacacccgcggcggcggcgtcgccgctggacatgatcaccgagcagtgctcctcgccgctggtgatcgcccccaacgacatcaggggtggcggcggcggcggcggacggaacaagaggatcatcaacagcatcctgcgtcgcagcctgcagaagaaggtgatcatcaggccgccactaatggcagctcatcagtcagggaggagggccggcgccggcgtggctggtacaaccacccatggcggcggcggcggcggggtgatgagagcgcggcgtgtgccggtgagcggcggccggggaggaggaggggtgcagcacaacagggagaaggagagagggtggaacaacgggaccagcctcaggcagctcaactagagtgatactccctctatcccatagtataatggattttgaaaagaagtgatatatctaggactatgaatgatagtcatagatacgtcgcgtccctctagaatcccttatattatgggatgaagggagtattatgcatcgtcactcagctcagacgggtgagtgaaggagagacttatagaattgggagtagttttaggagggtttcaggtgttgatacctcattagattgtgtggtgtcgtgggtgtgcttgagttctcgagtattgtgagagaactctttgctgatgtttcattgtgttcatagattgatgattggattggttgatctggctgccagatcttagattgctggagtgtttgatctggctgtcagattctattttacgaaactgtttcttgctcggatcaggtttacaagtgttttccagttcaagtttgatcaaattctgtaatgatctcaagtgttttccagttcaagtttgatcaaattctgtaatgatctcattttctttccttcgcgacagagaggaattaagttcgagtttgatcaagttctgtaatgatctcattttctttcattcatgacaaaaaggaattagaacatgacgggagaaaaaaaaagtgaaaattcatgcttaccccctccgtcccaaaataagtccaatcctagctacgaacctgaacacatgtgtgtccaggttcatagccagagtttggctttttttgggacagactagtaggttaaagaaaaaattgttgcaatctgcacattttggtatagaaaactggtgatacaatagaaccatgcgcttgcataaacattaagcagtttaggccctcaagccagactatggtgatgcataacttatggctatcatacatgtcccatacatcgagctcctcggtttgtttctccaacacaaatatgttatagagactagactaaaaactaaagagtacaaaattggtaccacggcctcaattcaacaatttagctccacgtccgcttcatttctgctttccttagctcctgaaattttcgagagagagatcaaatgtcagatcatagctaaaattttgttggtaaattaaatacatcaaggttatggaagaatttcgttcaggcaacatagaacacaaggttgggttagtggaaaaggaatgtattatcttaagcaggattaatgaaagagtgcatgtaccagcaaacaattgtttctaaaaaagtaaacaataaacaaaaatctagtaactaaagtaaaaaaaaatatatctcagaacttcagaagacggttgcccatccatctcatagaaaaagaagacatttgacgtatggatgcactccgaatagattgatttaaataaataaaatgtcaattttaatcaaaccatcgactgtggaaaaagcaggtataaccatcatggttagttcttttcagtcaatagcaataagcaacgttagcctccattggacattgatagacgacacaacaacaggatgaatattccgtggacttacaattcaatgatgatcccgcaagacaagtcagccttgcttttgtgttagcctctgctaatggagtagtcttctcttttgcaatcatccgagcatcccagatccttattataccatctgatgaggccgaagcaattaggttgcacagttcagatccatcgttcttgtcgtcgaagacaacaatccctttcacacgagttgaatgagcatcctcaatgcgtgatgtaaccttgccactggaaagatcccaagcagtaataccgcgttcctctcctccagtgtaaagtattcccttctaacaaattaaatcataaacaagtgagcggtatacaaaaggcaacaccatatagtcactcaatgtttctataatatctatagcatccaaagattaacctcaatcctcatgcataaagcgaaatgatcagctccagatagctaaaagaatagcatggactggagctccaaatgatagctaattcaccacaatatcggtaacaatataatcaatcaaaagccgacacattgaacaatatgacaaatttcatcaaatactcagcacctacactgtaactactagcatttatgcctaaccatttagcaaccacaactcataagca

SEQ ID NO: 13830 - DNA, 10982 bp, Oryza sativa
tttgcaggcgcaaaggcgagcacccttttgccgcagtcgatctcatggatgatcctagcatcctcggagtcgtgcacggtcaccttctcctcggcggccatcacgaagcggtccccaccggcgccatcctcggcgtaggcgatcgccgtggccgggtgctcgaggcggcaggagaagctgcggcggccgcggaggaggttgagcatggcgaggccccccgagcggccgacggcgagcgcgacacgccccgtggggtgcacggcgagggcgtcggcgggctcgcggtggcgcgggaagacgcggagcgaggcgaggagcgggaacccctcgccggcgtcgtagaggtggaggaggccgtcgtcggaggcggcgaggaggttgcgcgggacggggccgagggagtggatggcgagggcggagaccggcgcggcggggtcgaggagcgggccgaggtcggcggcggcggggaggtcgtagaggcggacggtgtcgtcggagccgcccgacgccgcgagccccgcgcgcgccgccgcggcggcgcagcggatgggccccgcgtgggccgggtaggagaagagcggcgcgagggctagggtttccgacgacgacgcggaggcggaggaggaggttagggttttgagggagaagccccagatgaagcgctcgtaggagccggcgatgagagccatccgggagagcgcgccgccgccgccggcggtgagaggaggagggtttgggaagagagaggagagaggagaggagacgaagggtttggggggttttgtttggtcagggacgctgtcatgtggggccaggctcaggctcggtctttcagtgcagcacgaatcttgacgatcatcagatggctagtagtagtactaacatggaagctggtttccgagaccgacatgtgggcccactaggggctgtgttgctttcttcaccttccccgctcttttcacgcacacatttctcaaactgatggatagtttacaaacggtgtatttagttcatgtcaaaatttgaagtttggttgaaattggaacgatgtgacggaaaagttggaaatttgtgtgtgtagaaaagttttgatgtgatggaaaagttggaagtttgaagaaaaagtttggaactaaactcggccaaaacttttctatataaaaattgcttaaaaattttcaggctagtattttaagcaactccattttacgtgtggaagagagaagttgcaaacctcagggaacaaacacagtgcaaacatgcaatctgtctttctttataaaacaaaaaataattaagaattcaacctctacgtcaataaggatgtgcaacgtcttaatctgcatcgatgaaatacgatttgggataattgatttgcttggcatgggcctcatcgcagaaggttagaggcaacatatgttagttgtgcacaatgaacttgtaagcaaaacaactctgaatttgcaatggaggattcatttgtgttgtctaaatctttcttgtttgctgtaggaattggattgcttctaagaaaatctagcaaaatagagggcctaaatcttgtatacatcaatgaaggactcgtataaacatcaagattttatttagctggtgataatcaaaatcaggtgtaatacacaaacaaaccatttgcacaatatatctacctaacaaaactacaaagacaaaaaaaaagagatcatctttgcttcttccagtatctgtttcaatcgacaactaatgttttcattttatttctaacccgaaaacctcttttccttcaatatagctttacataaatttttcatcaggggctctcttataccaaagagctaccagctattataagtatagagtgtggtgagttgatgtgcgattatgaaagagattttaggctaaagttgagttccaaataaattgttgcagtgattatctaattaattatagtgataatttgctccattttgtttagagaacaactactcactccaattcataatttttgatgttttggacaagattgagatcaaacttttatagctctaattattaatgtccaaaacgtcaaaaattatggaactggagaggatactatgtcgtaaaatcaagaatgatggtttcttcgtgcaaccaaaaaaatagataattgttatctgaaaatatctaattgttcaaggaaaaaatatggtgctagtgaaaataagtaagataatgaaatattttttatcactaattcatggttgtcaacgatcttacttactgataattatttttgacggttaaagtcaacaaactagcttaaccaacaatccgaacatgtgttctaaccagaatacaaaggggaggggaaccatcgccacaatccaaccgttgctccccacatcaacggccgagatgtaaccttcctgatctcatcaccgacttaacaggaaatttttcttatttccaaaaaaaaaaaaaaaaaatctctcctctcgtcgcactcttccccccgaatccaacactaaccctaaatcgcagcggcgggcggcggcggcggcggcgcgatggaggaggacgcggaggggatggaccggttcgacatggacggcgacttcgagggcggccggttcggcagggacggcgagttctactacgagcgccgccgcgagcgcgcgccgcagacgcgcgacgacgcgctctacggcgtcttcgccgagggcgactccgactacgactccgacgacggccgccgccgcagccgccgcaagcgccgcagggacgaggccgagcccgacctctcgcgccccgtccacttccagtccgccggcaagttcatgcccagcaaggagcccgagcccgagctcgaggagaggcccggccttggcgccgctgcctccgcctccgcctccgcctccgcggcgggtgaggatgatgcggcggaggaggaggaggatctcgacctgcccacggcgttcgggcagcggatcgcggagggcgcgagggcgaggcgggaggagagggcgcgggagcgggagacggccgcgcggcgcaggcaggcgtcgggggtggcctccgggaagccggcgccggctctggggagcctggggtccaacacgaaggtggccaagatgatggccatgatggggtacaaggatgggatggggctcggcaagaacgagcaaggtatagtcgcgccggtggagaccactctgcgccccaagaacgccggtctcggaagcgtcgaggggttcaaggagcccaagccattctttactaaggagaatttgccgcctccgcctccaccggcgcccgccaagaaggagcagcagaggtggtcgaagaaggccggtgcgaagaaaggccccgtgctgacgaagaacgagttgctggcgatgcgcagcgagcaggagcaggacgagcagcctacggttgtgcagaaggtgatcgacatgcgagggcctcaggcacgcgtgctaacggacttgaaggggctcaacgtggagcaggagatggaggcgaacgatgtgccgatgccagagttgcaatacaatgtgaggctgcttgtcgatgaggccaaggctgatattgtgaggctggatgggcagctgcgacgggagcaggagaaggtggcaagcttagtgcgggagaaggagaaagtggcaaaacaggaggctttgcagaaacgccaactacaagttatggagaagattgcaggagtgctggagcaggtccgagtggatgatactgcaggtattctctctctggaagggttgcttaagacctttcaggaattgaaggcatgctacgtggaggaattcaagatgtgcagtgttgcatggattgcctgccggtttgctcatccgctactaatccgagtcttccaggggtggcaaccactgcaaaatccgttgtttggcttggagatcatgtcatcatggaaagatttgctgcagggggatcaagcatatgacttctcaggtgatgttgaatcgatggctccatatgcacaattggtttgcgaggtcatcctacccgctgtgaggatatcaggaaccaattcatgggaggctagggatccagaaccaatgcttcggtttcttgaatcatgggaacggttgctgccccctatcgtgctccagtcaatattggagcatgtcataatgccaaagctttcagctgcagtagattcttgggacccacgcagggagaaggtaccaatccatgtatgggtgcatccatggttgccaatgctaggacagaggatagataccttgtgccattctattcgatacaaactgagtagtgttctccatgtttggcaagctcacgatgcatcagcctatgctgtgttgtctccatggaaggatgtatttgatgccgcaagctgggaagacttgattgtgcgttatatcgtaccaaaattgaaaatggcacttcaagaatttcagatcaaccctgcaaaccagaaactcgaccagttcaactgggtaatgatttgggcttctgcaattccagtacaccatatggtccatatgttggaagtagatttcttcagcaagtggcagcaggtcctgtaccattggctgtgttcaccaaatcctgatttcaatgaaatcatgaactggtacaagggctggaagggccttttcccaccagaattgcttgccaatgagcgcatacggatgcttttaacggctggccttgacatgatgaaccgagctgctgaaggccttgaggtggtgcaacctggcgctagggaaaatgtgggctacttgagagcaacagagaagaggcaatttgatgcagcacagcaagcatcacaatacatgactcaccatgcggtgccaggagcagccatggcggatatgagctttaaggagtctatccaggcatatgcaatggaccaaggcttattgtttatgcccagagttggtaaattctacaatggtatgccagtgtatgagtttggcaccgtaagtatttgcatcgactctgtgaagcgcctactctacgcacaacttcaagaaggaattgagagatggagtgctgtctctcttacacaattgatagaaatgaaccggaaggcgaggcaacgctagttgatcatcctattgtgtactattactaaaaggtgtcagttttgatcatcattgtagaatatttctaaagagcagatggtttaatgatgtatctgaacaggttgttgtttggcctagtaactttgtagtatttatattcatgctttaatatgcaccgtggtgcctttttcttgccatagaatgaacaaatgatttattaactattagttatcaccatgacaattctatttggttgtgtcatcaatatttttatttcttggatgcttctcttgggctgtacaatttgttgatatgtgcttgctttgaatcattcagttagatttgaaaaattagaaaatgaggttgggctctgggtggctagttgaattgtatcttctttatttgcataaagctcaggacaatactgtaaagagttatactatgctccgcaattcagatgaattagccgtggcagatttagtgagcattgcactcagttcttccttgttcttcaggacatttcagcattcttgcctagtgttgctataaagaaatgcttggtcaagcaagaacggtaatatagaaaaggtgtgatatttggtatccttacctactataccaagatactcacatagtatgtatatcttgagatatatcattctttttgcttaccttcgatatgcaggtaaaatcatttgatggacatgggattctttattttctctaagaagatagctgctgccattgttcattgtcaaggaaactcaaaagcttgatgaatattgcttctttattagatcatacttagataacctgtatgactgctataggaatgagtgaaaatgtatgtcaatttgttgtggatgtgggaggtgtgatctcatttcatgttatgacattatacatgtaaatgtaactgaggttatggtggttttataaattgttcattctgtgaatttatggaatcttctcagttcccatgatttttggggcggtttttgtttttcaggcattagaggcttgtcctggtgtaatttgtcaacaccagttgccattgttgggtgagtttgggttgtggtcgaattctatttgttttgttggcctgatgggtgtgtgggcttatttattgctaaagagctgcagctttttgtaatctttcggaccaaattctgttattatcagaaaaaggtgtcaagtaaagtttttttcctttcatattttgtaaaatatgaataactttgcaataggtactgaattaaactgaaaaatctcgagatgtggctgagcagtgtgttactgactactgattgctggaattttgctatcttgcttcttcactaatatatgtggaatttgatttgctttcaggaataggaaaatattcatgaataccaattcggagcaagaacacactacaaaagcatcttagttgtacgaaactaaaccaaattttctcgtccactaatcaaattggaactgagttactgagatgctacataaactgaagccgaaagggtaaacaacccaagaaaatctttgccatgtccaacttggagcttctaggatggccaagctgagctctagatcagtcctgtaatcctgttcagttccattcaggcagatcactcgatgtcgtcgacgatgggaaccgtgccatcatccacggcggtttgccgcagtcgctgaatcgccttcatcacctgtcaaagaagcatcaccatgagcaccaccaccgttgatcaaagcttccatggagagatcacaaggatgaactaaagagcacacctcattgtcccagttggtcctggcagtgatgatgatcagagctaccgtttgcacagatactcctatgatcaagccccaccagatcccctgattaacataaacaagatgttatgagttgcaactgatgaaatctgtgtgaaaaactgtaacatagaaaagtaaactggaaagaaattaggagagagcagtagtatttacagctgcccccaggcttgttttgtatccaaggacgcatccaattggcagcccaatcaggtagtaggcaccaacattgacataggcaaccaccacctgccatccactaccaacggccactcctgcagatttctcaaaggtaaccaagcaattcttcagttacaatcatgctactacttggcagccgagaaatgcgaaatgcgaagcgtttgtgctatgtgaaatgcacctgagaggattggctgaattccattcaagaagatgctgatggacagcaacggtgtcagtttgatgacagcctcgatcacggtggtgctgcttgtgtagagcgtgctcaggggatacctgagaactaggactagaattgtagccaggatgctgaaggcaacgcttgctgtgataaccacgaagaccgagaaccttgccacatttggatggccagctccaagctcattaccgacacgaatactgcataataagttcatgcaaaagtttgaataatgaagtgggattgagaagtgtgtatctttcatttgcactcacctggccgcatagcttaaaccaagcatgatctggaagtcccaattccagtaattgatgctgacatgcgtaaaatacatagcgatgtgagttacatatatatgaatactgcagtagtgtataagcagacatttgaaactgcaagaccaatgagtatcatgaggtaaacagggtgtgggcggcataccagatagagagcgaatcaagtgcaatctctgggtcggggaggaagccagtaagaagcacaaatccttgcacataccaaatctccaacctgaccaagaacacatgaaaacaagacataaacacgcaagaactatggctcatagctcaagataagtagatcactcacgctagcatgacggctgacgcgaaggcaagcttggcatatccccagaggcctctgaacgcgagcacggacaatccagtccacgtctccttacaagccggagtccagaccatgagcccccatgtcaatgccacgagcacccaccaagagaagctcagcgtcagtgccgcgccgaggaggccaaagccgagcacgaacacggtcagccacgatatgaggatgtggaagatcagcacggccatggtgatgtaggcaacggggttgacgatgttctgggcctgcaggaacctctgcatcgggcagaagagcgcgaacgcgagcagctgaggcaccaggccgcgcgcgtacagctgccccgctgccgccacatccgcggcctgcccaatgagccgcaggaacgggccggcgtaccagtaaaggaatgcgatgacgatggctgtcgcgaactggagcaccagcgccctctggcacacaatgcccatggccctgaacttcctggcgccgtacgcctggccgcacaccgtctgcaccgcgctcgccatgccaatctgcagcattgcatgcaagcaacacacacatcataatgctttacattcccaaacaaccagagtgcatgcaagaaatcaaagttaccatgatgccataggctaggccctgaatgccaatgttggtgatggaggcgccggcgagctcgagctcaccgaggtggccgacgaacatctgggtgacgaggctgagagtgaagctgaggagcgtgatgaggatggacgcccacgagatgcgccacaggttgccggcctcccatgccgccagccgcgacagaacgctccgcggcacgggctcccggcgcagcagctcctccgacgcacccgaagactcatcgacgtccagcaatggcgaccgtgcactgcttgtttccgccattgtctcctccccttaagtgctttgctcaacataattcataatggaccaaggcatttatagacctgccaaagattcatagctcttttgaattttcagtagcagctaactaaccttcaagtgccagacctaccagtccgtttgctgctgtgaataagttggttgctgtgaagaagtaggtgcagtagtaaggcatgaccaattaaccatggagtttgcaatccagctgaacatagacaactaggaagctgccagtttaggaattaggatagatgaattgcagattgcattgcatccagaaagcaaaagaacaagctttacagcatgtagtatcgtattgcctctgactctaaccatcacaattgcttgtttttcgaatcttaaatattggatgaataaatacaaatagatcgatacgctgtaaatcaattgctatcttgttttacttgtttcagaagacctctttcagcaaacttaaccatgagttttccaggaactggtttgtttttctctgaggccagttgattatcaactttttggcataatttaacatcaggaattaaatttctccggaacatacgacaggccacgttgtaggcctgaagtccgaggcctctattcagaaaactctccatcagaatgtggcatgtttgagcatctctcactgaagcagttctcagtatcttgtagaggagactgtaagcctcattaagtttaccgaaagcacatagcttctcaacgacctgattgtatgcgctcttcatctcttgtcttgctagcattttttccagtagattgagcaagtcttccaaattgcccttctcacagtatctatgtatcactgtcctgtatgtaacaggtgtagggagcacgcctctgttgagcattttctccacaagccctgtcgcttcttttaatctacctttctttcccaaagcatcaacaacaacagtataagttacaacatcaggatgcctgttgctcagatacatgtcgtccatcaaagagagtgctgattccaaatcaccctgccgagaaaatccatgaatcacagtagtgaaattaacaacattaattgtacagcctttgctctggcactgttccatgaagtctttggcctctgctggttttctgtccttacatagagcatggatcagtaagttaatctccacagttgtggggaagaaacccttctgcaacatctgcactaccacatcacatgattcttttagtttcccttctcttctaaatccatgcattacaacgctgtaagtgatatcacttggagtccaccactcctcttcgctcttgtttagcaattcccaggcctccgacgttttcccaactttgcagagcccatttaacagagcagtatgtgtgactgtatttggcttgcaatcattcttatacatatgcttcatcatctttcttgcttgatcaagttccccaatgcggcaaaacccatcaactactgtgctatatgtcacaacatcaggttgacacccctttgagatcatctcacctacaatctcttttgcctccgccatcctcccattcaaacaaaatgagtgcacaattgcactatatccaacctcatccactctaaatcttttcccctccgattccctcaagaactccaatgcctcatctgcatggccatgctttgcaagcccatggatgagcacattataagtgacctgatctggaaatagacctgcatcattcctcatcctttgaagcaaacctcggacctcttccaccctcttctccttacacaagaagctcatcactgtatagtagctaatcttatcaggagggcacccattttgcagcattacaccaatcatctccatggcatcaacaacccgccgagccccgcacaaccccttgataaggcaattgtatgtgtacacatctggctcaaccccaacgcggcgcatccgttcggcgaactcaagcgccttgtcgacacgcccggccaccacgaggacattcaccgccatgttgcaaatcgatatgtcaggcgcgcacccgtccttctgcatgaggtggagcacgcgcatggcggagcggagcttccccgcacggctgtacgagagcatgagctgcgcgaactgctcggtcccacgccg

SEQ ID NO: 13831 - DNA, 26200 bp, Oryza sativa
  unsure (1)..(26200): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtatgcacatatcaattatctatcagcactcatgccaccatatgaaatatcacaatctctagtaagtaaggctgtccttacatatcacagagcaatcttggaaagtaataagcaaactacagtacattactaaaatatcaattcagttttctggtcgaatctcagaacgtttctgcttagaaaatctaatctctcccctaatacattggaggggaaatctgttctgtgctgcctactgaaaggcagaattattttaagccaatctcattgtcatccaaagtactacatctaatgaagtgacaatataattgaagaaccaaagcaggggacatacttgtagacgaacaacttgggtgaaatgagagagcttccatgcttataggcaacatatggaaactgatctgtaatctcctacaataaagaaaatgatttactctgtaccgatcgaccgtggatgagatcggcgaggcgggcgcttcggtggcacaggtcggtggcatgcgtcgctggaatggcgaggaggatgaggagttgtacgagtcgctggatcgtcgtgctcgttcacgtccgcctccgatgacgacgtgaccactgaccagcagcaccggcggcggcggccgcagcagctgtgtcgtcgtacgtccgcgacgttctccgcctacgaggtctggatctctgagccgacctccgtcgaggagcgccaccgcgtgctgctgcgtcggctcggcctcatctccgactccgatccccgtccgtctccacgcctatcctcccctcgtttggtggcgttgattcaatggaatgaggatgtaagggcttgtttggcctggagctggagctcagccaaacagtttcagctccactaaaactgggagtgaagttgggtgaagctctctcacaaaatgtactagagttgtggagctgcgtcactttagactcaactcctggagttatatttaggagttggagctgtaccaaacaggccttaaagatcagttagttggtgaattattatagggtacgtccacctattaggcagccactcagtgaaatcatttggctttttcgtacagctatttttggctatggctgcagatgtaagaaccgaacaggcccattttctgtcctcaccagttgccaacgaaatggctgactcagggcagtggtcggcctcccagccgaaaagccctccagacctcctgtgtggcatgccggccttcaccgccgccgtcggcctccacccccgacggccaagacacaagtgctgccaatgcctgaatccgattatattcgtcattggtttcgtgagtttgtgtacgatttgatctttctgactcgatttaccatcgattttctttctggattcctcaagattgaagattcgtatcggattttgtcttgagcaatagttgttgccgttcttatttgagcaataaattgttgcgcatcttattagagcaataaagttgttgcagatttttttaaaacatatggacggtgtctttcctttatcttcctttttaacctaacttcatctcaaacacttcttctattcctccctatcgatcttctcacacatgcgcggctgatcggcagccctagcacacaaggaggcacctgttccattccagtggtctcctcccggccctcttctggctctgacgcctgccctgcaggaattccccccacactgttgttctctctagcatcgcttacggagagacttaaggaaacttattcatatttccagaattccaggtatgtatgtatgtatgtagtgtctaacttctatgttattactggaattagagcataaaccttgccgttaatgacacagagccgattagattaaattagatagaatttggtaatctacgtgatccttatgtcaatcatactgtcattggaagtttagtgccggcaatactgttagattaagcttaattactgtgcttagccaccagaccaacgcatgcaacagtactatataagtatttaattaccatgtttgatgcaagctaaatcaaatgcttacaaccattgtgattataacctgaaccattatattttccttttaggataattcaggattcatagtctaaactgttaagaatacaggaccatctatgtaatcttgggagattgttttcctctcctaaatcaaaacttgacctaaattttagtctccatggtaaatgttatacggagtttgcatgtatctgtgcacacttattatacattgttatacctaaacaagaacaataaaacttataaatctgccactgtttgaactgttcaacaatttctgtatgttcatagacgtacatttagcctttgttttactaaaaatacattcacacttaaatattgctcgacaccaaaactatcacggcaccaaaattgaaataatgtttatagatacagcttgtgaaacatcgctagcatcctgaaactgaaatcaaatagagtaccactgaatgtttggttttaaattgagcatgttacttactatttaacaacttaatgataataagtgattagaaaataatattttctttgtaggataatgtcagactctacggccatggacaaaagctggatggacttatctaataggagtcttcctgaatatcagcaaggagttgaccaatttattcagtttgctttcaaagattacaatgcagacaaattcctccgatgcccatacagaaagtgcaaaaacaatcacttctttgatcagaataatataaaggaacatctctttatccatggagtgcagaaagactacaaattatgggtctatcatggataaaacgtcccagattcagaagacagtggcaatattgatatggatgaaaattatgataactatggtatggatcagatgatgaatgattttggagaacctatggttgtgaatatgggatcactgggtggctcaacacctggtttgaatgatgacatggataactctacagtaactaacgaagaaactaacaaattctacagacttctagaagatgcagagcaagagttatatccagggtgtggtaccttttcgacactagcatttattgtacaaatgttaaatatcaaatacctctatgatctagtgcaaatgcaatggaggctctattttccatgttatgcaaggcatttcctagtagcagtaatgtgcctaagtcatatagtgatgcaaagaagactatgacagatcttggattggattacacaaagatcgatgcttgtttgaatgattgcatcctatatagaggggcttatgataaggctgattcttgtcctgtttgtggcatttcaagatggaaaaatgaagggcataataatgtctctaaatcaaggaggagaagagtgaagaaagtcccatagaaggtattgcgatacttcccattggtaccgaggttaaaacggatgtacttgtctacaaaacttgcaacacatatgcgatggcacaaggagaagttagtagatgatggatataagagacatcctgctaattcaaaagaatggaaggacttcgatgggaaattttcttcatttgcattggacgcacggaacatccgacttggtcttgctagtgatggatttaacccatttggaaatatgagttcttcatatagcatctggactgtagttcttgttatatataacttgccaccttggatgtgcatgaaagatccatatatggtgatgtctatgataattcttggcccaaaagcacctggtaatgacattgatgtatacttgtagccatatgcttccacaaagcagacttttaatttacgtgctgctttgctttggacaattaatgattttccagcatttgaaaacttgtcaggcattagcacaaaaggtaaatatgcatgtccttcatgccacactgaaacctgctaccacagacttgttaatgggcacaaatattgttatatgggacatcgccgcttcttgccgaggcgacatgtctggaggaacaatgatgcttcttttgatggccaaaaggaaaagcgaagtgctccaaaaccattgtcagaagatgatattatttctcagtatgagaaattcgaacaggttattgcttccatcttattattgaatctttttgtgtgatgcttctaaattaaaaaaaatcaaactatgcatgtgacatgataatactataaggcataacctttttttagaactatgactaaccatatgaatttggatttaccaccttactattgctgccacatgtttatttcaggtgaagtttgggaaatcagggaagaaaaggaaacactctagtacattgtatggtacttgaaggaaaaagagtactttttttttccaactcccatattggagcaagctgactataaggctgtaacggactcaaaatttcaggaaaatattttgcgaaatattttaagttatgctcttctcgattcttgcattagagtgatcttacttttaatcttttcttttattttggacttaaactttatttgcaaagttaatcgctatcttttaaattttacaaaagctctctatttattttatttaatctctaactttgactctaaatacatttcctttgaacccattcccgaacatctccaacacccacaaatatcctttcgattcccgctcagctatctccagaacacatgaaatgccattttctaacctccctagagtacatgaaatgttgatacctttcctttgaatctccacctaaatatctctagagtcacaaaaatatccttttcaatccccctttgagtcaatatacctatcctctagagtttatcaagctaccaccaattccgttcccgtagaaattcccatccacatatacttccgaatccagttctatactccaataaatatttcctctttgaaatctcattcatctaaattatccactcaagatttcaaagtctactatttagcttgggccaatatttccctgattgacccaactctctgttatatcccattaaccatttttatttttggggctaaaccagtataacttcctttttattggaatttattttggatcaaactcctatctagacctatcattagaaatccccattttatccttcatacaatacctaccacaaactcctctagaagatcaactattcaaattcttctatttaattatgaatcaagccgccaatttgattcctatggcttgatcacacccttagcacaagaacgatattatcacgaatatttgaatgattgctcttgtgctaagaacactatttccaattttttccttagaaagtctaacttcccttagccacaaatactaaaccaagaatccataccccatatcttggaggtcaaaatcctagttatttgcctccatctatttttgctaccatttcaaatttatccaaagttagaaattaaattattgcctttccttccctttttgattattctaatttttaatttttaaatattaaagaaaaacttccgtgccaagtcttatgtttgattcttattgaattctataaaattggagcacttttacccatttcaaatttttccaccaaattttatctcaaaataaatatccttgattttatttaaaatattttcaaactccttttgttttaaaaacctttcatttaatttttttataaaaaaaccctccatacaaaattttcttaggttccatttcccttgatttctatttgatttctttgtccaaagtccaaaaaggtccacatccatccatccatcctttgattttcatctcctttaaattttattcaaattccatgttcaagttcaaaaatcccaaaactttcattctttcatctcctttgaattccgttcaaaactctccacacaaaaatattaaaccttcctaatcaattcgggccgaaattcccttcttttcggcccattccttttcctcctctctcccttccactcactccttcttgggctgccggcccaactgagccgaagcccagccgagccggcccaaccagccgcctctctcttcctcccctgtgggcgccgccactggcgccatgggcacgccgccgcccacggcatcgcgccgtcgccacggtcctgccgccgctgcagctgttttgcctagctggagcgtcgtgccgtactcctccacctccaccgcccaacgctgccacggccgccgcgtgtgcgcgccgcccttttcggccaatggaagaacgaagccggcgccgtcgtccacttccccacgctgccgccaccataaccaagtatcccttctcctctccgaaccgacctccgcggtcgccctttccccctccacagccgagctctctaaactctctttctctctttcctgccatgccggccaccacctcgccaccggccgatctccctcaccggagctccgctggccaaatccttgcgccatccgggcttgcctcgccgaggtgaaccaatttttcctatttcccctttccttccaccctaaatcgagccaccaccggagctttctctctcctggccggaccaatctttatcctcgccattccggcctcctccctcgcttccctcgctggccgacctcctcttcgggtgagcaacaagcgggaacaccacccgccgctggcgtcgccacctctcggccaccggagcgccgtcaccttgctcgcgcttctctctctcttctctcggcttcctgtgagacagaggaaaagaagacgaggaggagaaaaggaggaagaaggaaggctatgacaagtgggccccactgcatactaatccctttcctttttgtttcaatttcaatctctatagacacccatatttctcaaatcatagatccaattctagtaaattctttatctaaattcatctaatttcaaactctttattttgataccaaattttctatttttaaattttatttaaattttctcatttaaatccctttttattcatttatttatttacatttcgaatttaaaatttattttaattaaccttttttaattattctattttattcaaatacctttaaatttaaatttctgtgttatttaaaaacccttttttaaaaaactaaatttttcctttaatttatttaaacaccttttatttattcatttcaaataccattttaaattttatttctttaaaaacccattttgaattcaatttcctttgatctatttatttccttttatttctaaaaccttcaattatttcttttgctaatccaatagccactaaacagttgtcgtgcaaactttacgcttccatgagacattcgtgtagtctacaaaccccgacgtcgaatcgttgatcgtaaaacacggcataacctagttccaaggtcaaagtgttgcccttcacaccgcatgcctcgacgcgtacagtgattgaagcctcactactctcccgacctccacagcacactagtccttggactatgtgcaatcctagccgctttgctgtcactcacagctttagagtagcactttccatcttgcaaacccacacgaatttttcccaactctctagtcattgcgctgtatcatcgactaaataagccaaatatttagccgtaatgttgcttatccttagcatcggctaaccaactccaaatatctagccattgtgctactctattctagcatcgactataaaccaaaaccaccaaataaaccctacctacccaatctctctttttcctcaactttatttgaaacccaacctttagaaaccaaaacccctctcttttgttttccaaactaaaatttcttttgacccaactcctttttccttcgccttgctccaattttctttatttcttggtttatcgtttctttgtagcaatttgcttataggctctatttgctatctttttcgtattcgtacgttagaccgtacagcaaattctatcgacatccaaggagctgacgtggactcagatgattacgctaaagccgcgggaaatcttaaggcgcaaggcaagacataactaaaattttgatcatatagaaaacttaatataactgtcattttatgcatgaaatattactctttagatattaaatactttcaagcatttttgcatgagattatagaatgatgctttagtcatcattttatgtggttcactattccaaatatctttacaaacttaggaatccggttaaaatgggctttttgaagtgtgatttatgaagttggtatggaagttttgggatgttgagatattttggtggtttaaccggattataattatccccttataccatagaaatgacatagttacgcccatccacacgaccaagtaattggacttagcctagtacattgtcctactatatgaaagattgttgggtggcttattaggagcaggttttgtggtgaatcatgcgtaaggtgtttgggtggcatgaatcacaacagtgggcttcatgaaagtgtgacgatatagataccttgcctaggcctggcaagagtttgaccactatgatgaaccaagaccccactgtgcagtaactagtggtaaatgggactctcgaacggctatggtgtttacaacctcgcgaattgttctcatcgtgtgggtaaagctgggcagacattgcagacgtattcgaatacaccatgctcccggtcaaggagatatgtcataagggttattcctactccaaaagtataagtagttttgaaaatctaaaatgttgagacttctccagaattggcctagatttaggagagggtttttaattacttttccatttaaattaatcattgcatatgatcttttccattaaaacgcttcaaatgctccaataattccaataaaaatcctcataatacttgatcactcaaagtatttaaaacaaattataaccagatcatttaatgattaatttgtatttaaataattactcgtatgttcttttgtatcttacaaattaacaattgagctctgaaaaatccgagaattttcagagtataattaatcatggagaatgtaataataaataaatcaagccattttttatttaggaagttttatttcccacatttaatatcacttgtaaatgtgggaatatttaatataaattctaggaataatttattaaataattttattaatccctggaactaaaatcagggtgtgacatctactgaaagagggcgcatgctaaatctaacaacccctatgataaacaatggattaaaaatatggcatgcaagtacctaacatatgacatgagaacgtttatttagctattctatgcaatggttattgcaagctattacccaatcttcctatcgcacatctacagatttatctcccaattaatataaaagaaacacactggtaccttgccgttcttaacgccaagcaacgtgaagtgcaaatactcgattcgctagccatatatcccaatcagtgaagatcgacccgatctaaggcgtgtggtgagcgatacacttcgatccacttgtacaattcaaatcgagttcgtcgtgttttaacaaacctgacattacaatcacttcccagctggtagctatccagagaggattacaggggacaaaaaaatcagcacccataattacaacatgactggcctaatttcaatattacctcatgggaatacagcgaagtccagcaattgccaaagcaaggagactacgtgggttactcctaaactcttccacatgctattcatattatttaattattgtaatgtgttaacctaacgcctcaatttttctaacgcctcatgtggcctatatatccttgagttcatggagcattggagcggatcttatctcccaccaattcaaattcatgcaactaaaaccaactctattcatattttgcaccaatgcttcccattatgaaaatcatttaaaatgttctccctttacattatgcagcaagatattaaaacatttcaacaagacttagcaggaattttgatcaagttcaaactgaacaatattaaagactgtccactgctacaaaccacaatataaatggaatattgtccaacatttaccatactatgccctcttttgttcaccaactgaggcccttattaacaaatttagttacttcttgagtatttgactgttcccaaacattgttgccttttgagttaatttttatagttgagatttttatttcctctagttactgcacaaaacacttctttaaggaattgtatttttaaaaacaaaaattcagttggtttaacaatttttactaatatctgtacccattttctcctgattaagctgtgttggggtaacacacacatgtaaacacacaaagaaagccgatggaatagaaagccacaacaatccgataaccaaataacaatgtgtacacaaaaaattgtaacgaccattattcagtggcatcattacagggcatagctaaataacccgattttatgaaaaaaaaattgtgcaggacatattgagaccttagtttgacaagctgtgtattctacaatattctacaattgcaaatcaaacaccaatgcaaactaaatgatctagtttgtggcaaaccataatatcgttcacgccgcccacgctgaaactaccgaaaaacacttgcatgtgtctatgtgtccaaatttatagtattaggatatatcatatcatgtattaagtgtatttacttggacaaagggaatgaaatgtattagtgcctgaatccaagctatctaacataaatagcaagtgcagtaaactaaaacggattagtgatttgcattcgtagaactatgtggcttggcaagcatttcaccgattaggtatgtatgtaagataagtaaaaggcagtgtatttttagaaactataaatctattaaggttttgcgttcataaaaaataattagattggtgggtaactaataattccatataaacagtactatagatgcatcaacaatgggttgcttatacattgggtgataagtgataacacaccaatctatccacagacaaggtcaacaatgtgttgtttatacagtttggcatgaaactacatcgtggggaaaaaatgggtccaatagcaactaagtgaattagatcaacgcgaaggaaaagtataattgacaaaataaaaaaatagtaatcttacataaattagttgagcaaactaaagaaatgcatttataaacaccgcaacattagttaaatgaacatattgtgagtttgtaaccagtgctacagcagtacatatctctactctaaggctgtaaaattcaatgcacaaatgtttttactctgctcaatataacaccaactcttgctggctcagttttttttaaaaaaaatatatagctagattacatttaccaaaccattggtttgaattacttgctgctaacgacatagattacgtactctcagcttctacatagcatctatcatctcaaatccaacctagtgtaaatacagtaattacaagtttgcagcagtgaaatttcgcaatatactactagtactatctacacaaataaaactggacccacattgaaatctccaattgaattaagaagccattttttttcttgagggaaggaagcccctacagtttaatatattgaaaaaataaaaggtagaaaattacaacagattaatccaatgatcaaacaaattaagcctatggagtaaaagggagataccattcttaaagagaactctccaagagaaaagagaaggagcgatattataaaaaattaaaccatttcttttctcccagatattccaagtaacataaagcaccttctcaacaaagtgtaaagacctataggtatttttggccgtaatcaacatttctccaaatttaaggacaaatcccaaaccacaccaaattgcgcctatcattcaaagctgaaaggacataaatagtatattaaaacaaacaatacacacccacattcaaatccagttgcacaacttacaaataaaagagagaaataatatatcgcgaactatctcaaacactcacagacttatagagacgagactccaagacagagactctagatgaacctaatgtaacaaccacgtaggcacgcatggttgcatcttgaaaagtctaaattaacaaccgaaaaaattaataactaacgcatcctcaactggtcacgtcttgtgattagcccaggaacaagttggttgcatagctcttcgtaggtggagaagagcaccctatccttggcaccggtgcgatgccggttggtgtgcgcgcagaaatacttgagctgatcaagtgtgcacaaacccagtgtctccccaagcagtaggaacaaccagttgatgcgctccttctcggcagcgatcaccggacgcaagcatttctcatggccgcagtcgtcacagttcggcacgacagggttcatccaccgcgcctgcgcacggtcatgcatatgttggtggttttggcgtaagtagtcggacacctcttgaaacttagtggcaatgttgtagacgatcaccttgcgtgcatcacagcgcctgcaccgagcgtcgccttggatggtggtgatgtcgcggcgagcgagctcggcgagggagtggtgtttggccggttcattggtagcccaaggatacggtggatcaggaagagcattaccgtcgttgttgttgttgccgccaccgtttgtgacgttcggcgcagcgatgttgctaagtgccatgtcgtcgtccccgccacaggtgcggctagatcttgccatggacgcgttgctttgacgtcgagtcgaggagaattgttgatggaggtgcgataggattgatgatgacattgaaggtccaagaaaattaaagcatggaaataccgagactgcaccattggggatcaaaccactcgcgcagccggtgaacagcacaccggctgccgaggccacaaaagacggcgtgaccaccgcatcatcggcaggaacatgttcaatcgatggttgggccgccgatccggagaccacaccagtggccaccggcggccgcacctcgatcgacgtcgtcactgccggagcgcaagaagaggagtcgtcgtcgacgacgcccgtggcgaccccgtaggccaccggaccgagagacagtttcagccatggtggcacgttgtcgtcctcgccgctgccatcgtccatggcggccttcctcttctgtccggacaacgacgagccggctccatgcaccaccgccggcggcggcggcgggggcggtggcgaggacgcctccctccccatgacgagggaagagagagcgccggccggggcgatcactcgtagggctttacacgcacggccatctcgatcgatcggtggttaatttcaacgcgtttggacgacaaccgcgagagagcgcgatgcgatcgacgaccacgcgcgacgacgcggcttgactactctccgctcatccgctgtttgtttgtttgttggtcggggccgaggaaatagcaaaggctcctgtttcttttgagatggaaatcgatcaatctgaacgatgctgctgctatactcaatgcgattttcgggcaccgcgcgttcgtacacgtacgcgcgcgtgctgcatgcacagaaaattttgcgcgtctcgatcgccctagcgcgttaaacaggacgttcgagctgccggtctgccccttccaagatgcatggataaagaccaataaatagataccgtgcctatccacgttccaacaattgcatgcacgcccttcccggtctgatcgttgtttttcttttcgtccaggggcggagaaaccatctttcgtcagtcggccgaatttcacaatagtcctggttgcaataaaaaccggggctaaagatgatctttagtcccaatcatctttagtcttggttcaaatgctgtcagggtctgtcaggccctcccgggatctttagtcccgattggtatcggttccgtcatttggtccacggcaaatgacgagaaagacttaggcggaagttcaattttcttgtgagtacacatgctctatatttatattcaatctccaattcaaatacatacaagtgtatattaattagatctctcgcagtttatcatttatttatagtgcgcaaagcaaaagcagggaactaacttgtgcggctactacgtgtgcgagtattgccattgccttgcagaccaaatcatcaccacaagagagctcgatgtacgtacaaataaattcaaaatttcattgcgtacgtatcgatttgttgtttaattactaattaatttcatacattcatatagtttattcgcatgagggataacctgatcacacacaaggaatttatcgcggcggttcaagaacaactaatgggattcatcaacgaataaatccttgatcccaagggtgaattctactacgacggaaatacaattcaaaggtccttagcttctgagataacgactactactacgtcgaaatcgtagctagctaagacatcataatagattgtaattaatacatgtctatttttctatatgcatgtacacattttctttaatgtaaatatatattttggtcatatatatatatatatatgtatatatgtatatatgtatatatgtatatatatatgtatatatatatatatatgtatatatatatatatatgtatatatatatatatatgtgtatttatacatatatatgcatggtttatatatatatatatatatatatatatatataaaccatgcagcaacagggccatgaaaaaaaaaaggtcagctcgatctttagtcccggttatttcacccgggacaaaagatagcgatctatctttagtcccggattggtagtcccggttttcaaaccgggactaaagggggttatgaaccgggactacaaacgctttctccaccagtggtcttattattgtttgatttttttttcaaaatgttgcgagtatttctatatagcgtagtccctctgtccctaaatagtaaatatgggacgtcgtggactttttttaagcatgtttgaccattcgacttatttaaattttttttgaaatatataaaactatatatatacataaaagtatcactggtagagaaatgctttttactcccgattggtaactcattgtagtcccggtttttcaatcggagtttttcttttttttttctattttgtatatctcacgcccattatctcaaatcattcacagttatatagttcatcccaaatcattcacagtaatagttaatccccaatcattcacaacattcacaacacagatcattctcaaaatcattcacaacaacaacacagatcgaatcacacattcatcacagatcgattcaacacagatcgaatcattcaacacagatcgaatcacacattaaggaaaaaagaaaaaaaaaatcacgcagcagccccggcctccactgcctaccgccgcaccaacctccgcgccggcttccaccgggcgcggccctccgcgctaggccgccgcccggccggccgcgctagatcccggatccgcgcacgaggctgcctccgccgctgcccggccgcctaagaatggggaggagaggggaggagaagatgaggaagaggaagagaatgaggagaggaggaagaggaagagataggggtgaagaggagaaagagataaattaaggtgagggaggaggagatagaacttattaactgatattgcctctgggtctcgcgcacgcctcgtcatctctgccgcatatgccgatcttatttcccggttggtaacaccaatcgagactcgaaataaccgggactaaaaataataaaaataatagaggggtttgacaccgcctgctattttttttcgaaccggaactcatttttagtcctggttggtgttcccaaccgaaactaaagatcaaaaagtagctctaatcttttgaaccgggactaaagattaataatctttgatcccggtatctgttgtagatggtgtgaactggaatgttgcatgcatgcaggtacgtatatacgtaattcgagttcacatccggacacggttgtcgtcaatgggaattcctatatggcaaaggcaggagcccatgcaaattaaagggttgggatttggtctggcggtcgttggaattttgatcgattagtttagttgcgcagcacaacttggaattttgaattatctgcgtctatcttttgtatatggcaaacatacaattaatccgttgttcataccaaatccgacttttcatattttttattagtgtaaaaactatacaaaattattggatatgtgagaatcgaacataagggcaagtttaataagagagtaagcagccatctattagatgagcttacatgtcatttctatatcattaaagataatataatatttaaccgagtcattaatttttctctcaatgtgggccaaaccttggttctctctcctaggctatcaaccagtcacagatgctctttccatgtgggccaaccttaattatctctcacctattcttttcaccaatcacagcatccatcgtatgcatgccgtgtctaggcgcctgtgcacaggcgttgtcaatttagtcgacggctgctctctctctccactccctctttcttccagcaatgaaaaagagctgatgccagcggctaatagtaggtacattttccctattgcacctgccctaagcctcccattgacatgtaggcccaaattacacatagtcattgcgccttgttttggcaaattgtgggcctcttcagtttgttgcctaaatcataaattcttcattagtaaataattaatttaggaaagatacttatgatactttgcatttttaaccatcatgtatttggtgaagggagatcatatgtttttttattagaaatgaagcacacataatcaactgttatgatttgccgtggctctatgctacaccctaaaatggttcttctatgttttaaggatcagtcattatttttttagataatggatttgagaaaaaaaaaaggcctctacatcccgcaggatatatgcaaccacaaggttacatagtatgagcatttaagctcgtaatacatgttccaaacaataaaacaacccgtgctcatgttcttcactggttgaatcagtttgactcatcagtaaaaaaaagatatcaagctccaactcattacatgtagggatgaaaacggtacaaaaacggcggaaactatattttttgttttcgttttcatattttttcggaatcagaatcggaaacccagatacgaaaacggaattaaatattgtcaaaaccgaaaacggagcgaaaactgaccggtgctgatacggtaacgaaaatatatcggaataaaaaacccctcaaactaagctttaaaatatgtcaaatccaattctcaagtctcaaatttcaacattacatcacaaaacacaatcatgtcaagttcaattctcaagtttgaattgggtgtattgggttgggctgaattgagtgacataggaattaggatgctaaattgggttgggctagggaggaattatagactatgttatgggcctttgtaattccggaaattccgagaaatttcccgaaaagtctccgaccgattccgagttccgacggaaactgcccctatcatattcgattccgtttccaagaaaatatttccgaattcgttttcgttttcgaaaaaattctgaccgacagattctgttttcgaaaatagatccggaatccagaaaattttcgtaccgttttcatccctaattacatcagcatccggaccgaccaaacacttcgatattccatcattcgaaatatggcctcttctcaacaatactctccggctatttgactttttttttgttcagtgatagtgtgactttacagtttgcatgaacagccattacatgcatgtgctaccaatacttaacaactgatctttcatcgtggtatcaaaaatcacaaatatctcagctagatttagaaccggtactaaaaatgttttagtactggttctaaaagtccaagtccctgaaaacattttgtctcggttggtattaccaaccggtactaaaagtgcatctttagtaccgattggaaacacaaaccgagactaatgccggaggatctttactttcagttggtaacatcaacccagattaaaagacttgactatttgtgagctccttaacagagattagaatcccctcaagaatttgaactccgaaaaatatactgttacataaaccttggtgatatcctctttccctttacctttcttgttgaattgctttctaccacactaatgtagtgatgtttgacctcgcctccttacttgtggattggatcaactttaatgttgttgcctgtttgtattgctgctctacaggtcagatggtccgttcttacttccgacaatctgacctagtatcataatccaaccatgtttcgctttagctttcgtatttcattttaaatcatctattcacctcctctctaagcgatatcgaggtcattttacttttctataaaacaaatggttcaacctgtatcaatacgtaaatggtgccatctgttaaaaccattaatatacgaatggatgaaaatggttcagatagttataatactgggatgctttttcggaaataaataatgtcggccggatattattttttgatagttttgacaatagaaacgaatttagattttttttttcagaaaaagatacagtaaggttggtatatggcgaaaacgaaaaatggttagaaaatatatggataatttttaaatagttattcggatagctttataaaaccatttatctccatctttaggttcacatctctatcccaacatatttgttaaataattttattttagaaacaaggtatgcagctatccagtatgtcatatttgctagttacaaatcatacactatattcggtactattatctataataaaaacattatttattatagtaatatatcaaataatttgtttttaatggaataccttattattttaaaaagagtaagaagtgtccatgtcaattacatttgttcattactaataactttgaaatgaaacaaattacatttaaaattgagattctaatatgaatattgaatacaacttcatatttacaattatattttttattaaaatctagaaaaccaaagagcctaatttagaataacatattatatataccacgaatttattttcttttggataaaactgcctatatttctttgttgactttgtaagaatggtaaaaaggtctttctttatgttccgataaatattcgtgcccgtattctaactcatattcattatgtatcagtattcgataatattcgactccatttgattttcttttctgattccaaaaattataggaacattatccccgtataaacaagttaggctatgttcgggaggtaaggttgggcacctctcgacacggaaaacaaagcacgcgattatagtgaaattaattaagtattagcctaataaaaaactttaaaaatagattaatatgattttataaagtaactttcatatagaatttttttttaaaaaatatattgtttagtagttttaaaagtgtgcgcgtgaaaaatgaggcaagtgagttgggaaagaggggaaaagaacgctatcttcacgggaggcagttcccaacacaaacacgaaaacggattggtccattagcacgtgattaattaagtatttgctattttttttgaaatggactaattttatttttttaagcaattttcgtatagaaacttttttttaaaaaaaagacatagggagagatgatgggaaaaggggcatccggacacaacatagtatatacgggtacaatacatagacacaactattcaccgatctagggctgtcaatgagccgagctcgagcaagctcgtctgcccaagctcgagctcgacacaggctcgagccgagctcgagccgagcctactgcactttcgagcttttaggcaagctcggttcaagctcgagctcggctaccgagctcggccataagtagtataatatatattttaataataatctcttgataagtataattattttttagttaatcacactaataaaagagtagaaaataattaaaataaatatattgtactaacatatgctaatttattgtgtaaatagatactaatatatatatttatctattagtttattatattaataaggtaaacatgcaatataaactatgcacggtcaagctcggccaggcttgataaagctcgagctcggctcggtaaagctcgcgagcttttgctcaggctcgggttcggctctcgaaacctcgagctgctcgctgagcctcgacctttttttttgacagccctacaccgatccctgcataccaaagtcggcggctacacctgactcatcgatccactactgccgccgccgcccatggcctccgccgccgtcgccgtcgcccccgtcgtctccgacctcgtcgacttcctcaacgcctcccccaccgccttccacgccgtcggtacgccccccttcccccccgattcctatttcccttccttcttcctcctttggtgtcgatcgacgcaaactggactgtgaatgtgttgtctcagatgaggcgaagcggcggctgaaggcggcggggttctcgcagctgtcggagcgggaggagtgggcggggctccagcccggccgcaagtacttcttcacgcgcaaccactccaccatcgtcgccttcgccatcggcgccaagtgagcctctgctagatccacttttaccttgtcctcacactccttggattgctcgaggctataggattatttaatttgtcatactttttctattttttttttgtgaagaaacttatctgtagtaattctatacggttttgtggatcatgaatgtcctgattagtgcattatttattattggattatgttgatgtgttgtaggtatgctgccggcaatgggtttcacataatcggtgcgcatactgacagtccatccctgaagctcaagcctgtctccaaggtttagagtttgaactcttcgtagttgatttctgtttatgttaattggcgtggtacaattcgatgaattggcgattaaatcctgcttcttgccacgcaggtaacaaagggaggttatcttgaggttggggtccaaacttatggaggtggcttgtggtacacatggttcgaccgtgatcttactgttgctggtagggtgattgtaagggagaagaaggatggtgcagtgtcgtatgcgcataagcttgtaagagtgcaagagccagtcatgagaatccccactttggctattcaccttgacaggttggtgttagcaacttatccatttttgtgttttattcctgtgattaagtccatgaaaattggacctacattaaattttaggtcgtaattttgttagtcctatattgctagatcggaacagttaatcaacctaaactaaagtaaactataggtcacatgtgtgtccaattgcctatttggtttcttgtggcaacttatttattctacctactatcctgtagtaattaatgtttgtcaaagaaaaaaaatctggactaaaccaaagataacagtaggtcccaaatacagaaaatcgacgacatgcttcaggtatcagtttcagcttgaccctgtcagcatgcacttgaaccttttaccattagaaacttagagtagaaatccacacttcagctaactgagccagatgcctaactgaaaacatgcatcaccaatttaaaggaaactcaaagtaatacttgtacactctgacatatctagtttggatgtgttcgcttaaactgaataagagaaggaattgccatatttgatcagtagtaagatagctcgtatacagatcgtgatgtccaacattatttcacaacatcctggtccatttgttcatcttgtattgaaacattttctacagaaatgccattatgttcttttgtttcaaaatttagttaatataaattttctcatggcaacgaaaactgaaaatttgacatatcatattgattagttatgtgaactttaggtcttcgctaatgtaatgtacctagctgtttacatgtaataacaacgatacatgtggataaaaccttagcttttagcaccttacacaattgctcttaacacgtctaaactaatttaccgttcacagattaactttgaagaaatgttttgagaataaatcactatatttaattagtccaatactttggtttgtcatgcccacttgccagtactttgaaatgtcattctcaccatgcatttactttcaatagtgcaacctatgctggacataaatcctgttatgtttcgatgcttttattgtttataatagtaaagagtaatttcatttgtcttgcttaaattatgtacaggaatatctcctcagaaggtctcaagattaacaaccagaatcatcttgtccctgtgctggccacatctgttaaggtgatttgaatacattggccagtgtctgagtttccttttttttatggaaactagaaatgtatcccattaatatgacatgttaggaaatccactaacaagcgttctagatacaaactctggtaaatcttcatgcctcttcatgccaaataaacaggctcaaagaagaatctaaagccatgctgaacttggctagttcatgcacaaaattgcattacaatcactaggaccaaacatgagattaataacatccaaaccaagcaaataagtttttttggcttctataacaattactgtgccattgaagcaattagtccttgaaagtaactattgagtaaatatggcaatctggagcaatacaatattttgttcgataacaattactgtgccattggagcaattagtccttgaaagcaaatattgtattttgttcgttgaaggtttgtctatgctgttttcagttcacctatagttcctacatttatgaatttacttatttgaaatactattgcttgattttgtgtaaaatctagctccttaattacgccactttgtaaattttctatgttgttgtgtttgcaaatcgtattttctgctgagggaggaaattactttcatgcaagcgttttgctaaagaacgtttaaatatttctttcacttcaacgaacaaaatacaatatggcaatctggagcaatacaagactgaaggcaatacaatattttgcagaatgaaatgcagaaattagtggcagaaaatggttcagagtcatctgagagtaagaacaccaagcatcatccactattattgcaggtacttattttgtgtagtatactaattccattggacaaataggttcacaaataatacaaaactcctgatatatctttcttttaaatttgttgcagttgattgctaaagaagcgaactgcaagcctgatgagatatgtgactttgagctgcagttgtgcgatacccagccaagtactgtagcaggtgccatgaaagaattcatcttttcaggaaggcttgacaatctttgcatgtcattttgttcgttgaaggtttgtctatgctgttttcagttcacctatagttcctacatttatgaatttacttatttgaaatactattggttgattttgtgtaaaatctagctccttaattacgtcactttggaaattttctatgttgttgtgcttgcaaatcgtattttctgctgagggaggaaattactttcatgcaagcgttttgctaaagaacgtttaaatatttctttcacatgtttctaagtgtattattacatttacttaatttgaactagtacggggattttttataagaaaaagaagatagagaaacaacaaacaatgacatcaaaattaagttgtaaaatttgctggaagtaatagctcatcttctcaccttctattcattccaaatttgtataatggagcccctcttgtatcatgaatcgcaatcgtgattgctattgaatgggttagcgacctagcatcctttataactctagttaagtgctacaccgtgtcgtcattttgtatatgtgctgctctagaacagaaagatacctttccgttgtgtactttaaggcaataaagttagtcaactgcatccctttctaaagaactaattatttctttcttcttgcgagcaaataatatgcaattacttaacccctatactgtttcaggccctaatagaatcgacttcttctgaagaatctcttgcgcatgaatctggtgtgagaatggtggctctatttgaccatgaggaggttggatctgattcggctcagggagctggttctcctgccatgttagatgctttgtcaagaatcacagggtcttttaactcttcaaattcgagggtactaactgattttcattacgcaagaataaagcatatatttctgtttcagttggtaaccagatctgttactttcattaaacaattttgtttttgttgaccatgtaatgtggcatggcttaaaggatactttaaataaactgtttgcacatattgaaatagttctccccagctccattatgcacattacaaacaactagactgtttgcagtctgtgtacctatttaggtttacattgtgacaatctgcttttaattttcagttgctagaaaaggctattcaaagaagctttctagtatctgcagatatggcacatgccttacaccccaattatatggtaagattttctttgcatcagtatctgagatttgcagttatacagcaacaattaaattaaaccttttgaacctatttctatttatctttgcaggacaagcatgaggagaaccaccagcctaaattgcatggaggactcgtgattaaacacaatgctaaccaacgatatgctacaaatgctgtgacagcatttatttttcgggaaattgctgagaggcaccatctacctatacaggttagttcatgtatgaaggatccttctataacaactgtgaaatagtgctttgttctgaactaatcaagttgtcatagtctctaagttcaaaaatatgtctggctaatctattgaccttgactcctgctctatcaatatataaggcaaatttcttgccttccttttcggaaaaaagaatctattgaccttgagatgaataaacaaattagataagctcttgaacagtttgtgcttatccagtttaagaacaaggggctattacttgtttaaacaaattggaaatcaataaaatctaatttctgcattcatttttgcaggattttgttgttcggaacgacatgggttgtggttcaaccatcggcccaatactagctagtggtgttggtattcgtactgtggatattggagcaccacaattgtcgatgcacagcatcagggaaatgtgtgctgtcgatgacatcaagcactcgtacgaacacttcaaggcatatttcgaagagttcactgaattggacagcaaagttaaagtagattgctaagatgaagtagtgaccatactggatcagccgactggtggtgttgctttgacatatcctgtactgttgcaaaataaatgaacaataaattgggttacattatctcgtcacaggaatctcatggagaatatattttctggctgtgatttttatctcctcgttcctggtcagttgccgggatctgtgctggccacatcatcttttatggtctagtacaggtcgaaatgtgcttcttagaagtataataagttttcacctcaagtataggagaaaatcagaaagcctcctccctccgtttataactgttttgactttttcgtagttcaacttttgatcaagtttatagaaaaatttaccaatgttgataacaccaaataagtaacacaaaattgagtatactttggtagtatgtttattttgtgttgaaaatgttgttatgtttttatataaattgggccaaacataaaaaaattaatttgtctaaaaaaatgtcaaaccatttattaatttgatgaaacg
